United States Patent 7,868,149 (PLANT GENOME SEQUENCE AND USES THEREOF) - sequence listing, part 7

SEQ ID NO: 3044 - DNA, 15992 bp, Oryza sativa
tttgctgctttcagtttctacttctgcgtgttgttttttatgctacttgtgcagcatagatgtacatacatacgtatacttctagcacctgcatgtttttttcccctttttgtggtccaaataatgggagcagcagcaagaggagatgaaactgaaactggaagctgtggcaaccatcccaggctgcgcgaccaatggtccattggtccccttcctcctccaaagctcaagctggagggactgtctggtcccaacggcaagtgcttcaattccaaataatgcatggcctgcatgatgcttcgccgatctgttgttgccctttcaatgctattcttgcattaggtgtgtttcttcaatgcgcgctattaagccttggtttaaggttttgattgttctcctggcctgtgatgcctgtccgcgttcaatccccaagcttgaacaatgtcctgcgctacagtgctggaggagtagctcatggtgaaacggcgagtccgggggtcaaacctactctacacatgtgcaaccctgaaacccggcgtggtctacgtgtgctacagcgcctgccttttgtcctggatggatagcagcatcttgctgaggctgagctgtggactgtggtagtagtacgctggtatgacccgtcatgtagcagtacactagtactgtagcagtagtcgttttcctgtgaaagtttcacacaggatgggcaactgtttccatgcctcgagttgattcttggtgattggcactttggcagtgcggcccgctatttttctcagttctggcagttaagtttgaccgagaattcgtcaaagtatttttccgatcttgtctgaaatttatgcgattgctgtgttctaaatacatgcttaactgccagaaggtagaagaagagaacggagaagaaggcattttccgatctcgtcaaagaaggtagaaaaagagaacgggaatagggcataacagagcggagagcacacatgcaaacaacgtgtgatgaaattctaggaatacaaactggccaagccagatcaccggcacaaggtttgcacatgggacaggaggaagatgcctctgtccttgatcggcagcgccattaaatcaactcctaattgagcttaccgatgactccagtcagtggattacgactaactaatgatcgccgattatgccccagtcagagtgagaacccgcggaacttgcatttgttctggcggtatctgcttatcaattatcatcaatcaacttatgatgaacatgtggaggtgtagttgcactacgcaacttgccatgctcctctcttcattttgcagttgatttaaactctaacccaccttaataaaagctgtttttggctcaagttgaaaaaaaaaacaagatcagccatgacattcaggtattactgcgaaaaaggagggcttgaaatttggtcgattagccgctcaactgaacagtagtagcttctttaaaagaaaaactgaatagttgccagctgtacgtcattcgtcactgtatgccagacatacgcaaagctacagaattggtcaaagacaaggcccatctagaagagcgaaaagaatagggaaaaaatacttttatatattgcccaagaaaatgccatacatctgaaaacacgatgattccttcacaaatatgccgagaaaagtattcctggaccaatatgaccgcatcgctgcagcttgcaatgcaggacaatgttaattgtggcgtgcaaaagcaagtgatgcaggacgggcggcgctaattgacgtagaatggttgtttgatgtacttaaattgatactagtactagcatctaatgcagtcattagccttaaaagatgcagttttcagttgattgattgcttgatagaggctaggcgacggcgattgtttccagcactaatcacacattcacaccctcgctcttcgccgtaaagcaaatcacatcctccgcaaaagggtaagaaaagaaaaggtgaaacaaataacaaaatcgcaacgatcgacgatgccattttacccggtgaccgtggcgtgctttagactggatattttggctcaatttgctcggtaataatatacgtagtagaaaaggaattcctagttgtgcctcctattgcagcactcgtggtaccaattgtgtagttgacctctacaagtcacccggcccgctggtgtgaagaaaattactttttagtccttcctacgaaggagagagagagagagagagagagagagagagagagagacccacttgtcttttacaagtccggctagctttataaacctttgatacgtatttgaataaaaggtattttaaaaaaatatgataacctccctttattagtggattatggatttaaggttacacggcaaattatcaatgaaaatcttattccagaaatctggttgatatattcatgatagtttaatgaggatgaatggagaactttgtgccccttttgtttttttaaataatggaatagaatccatttgttcaaagagttacaaccaattattacaccaattcaaacaaaccaaaaacacatggcaaaaaagtcataaaaatacaggcctaaaaggacagaaacacacgctaagtactaaaaacaaaaacaagaaaagactacaaaattattgaattctatttgtgaatctccatccgaagttggcaaaaagttgtatcacatatttgcagttgtgcccaggaccagagccagtgtgttgccctgaaaagaacctgcatataagatatagacagtgatttatcaaaaaccatatcatctctactcaaccatagagcccaacatatagcggaagctcctaccagaataagtttactggttttttttatcaatccccagaagccaattctcaaaaatatgagatatactatgtggaatatttaaactagaagaaaattaaaatgctctccaaacaaattttgcataatgacattccataaataaatgttggatagttttattttttatacggaagcaacatttcagactaccataccaatttcttttaaccaatttatcctttactaagacaacccctttaaacaggtgccccttttgtaactgtcttagagattgtttgtatctttgttggcttcttttaggctttataaagaggaatattttatctactttttcatgtctaggatatcactattaacaaagtatttttgtttataggaagggatatttattcaacttttttcccctgatattcatgcaacatggtggagactgagtagtcaacctcatacctttctaacctgatctttcacctttgctgaagaggaagaataaatattctgaccttttctaggctgtgttcttccccattttctcaacccacctctctcgtttttcacgcgcacgtttttcaaactgttaaacggtgtgatttatgcaaaaactttctataataaagttgtttaaaaaattcatattaatccacttttcaaaacaaaaatagtaaatacttaattaatcatgcaataaaacgaactttgttttgcgtgcagggaaggaggggttcccaatcccctcctctgaacacagccttaagaagtgtaagctgagtgctactgtgaatcatatatacatttttaggttttgtgagatatttagagcatcgaacaaatatgtagtgtgcaatatatggtaaaaacacaaatttgtagggccacatttattagtttgtggtaattaggacttatgagcagtttgtcatatagacagcgtcatgataaaaacaccctttaaaggaaatttgatgatttattattatcattaagatgatggatttgatgatctgtccaactggcccgcacgttattgatacaaacgattcgatatgttattgtcatatgatgataagcagcaatctacagagtgataaatcatcaaatttgaccctttaaaaatgagattttacttattcgctacgatagttgaattatcttcgtgaaattgacgtaaaattaaggataaaaaagattgtacatactccaattaaactaaggctgaaactagtcccttttttatttatctacatgcgtcctgtctctactctagaccggtcaataccaaaccttggagatcagttgtcatgataactcgattaacccgtgtattaaacatttggaggttgacaattacaaaaggatgacaaaaatgatggtacactgcaagactggagtccacccggcaaagacacatgatgcgaatccgcgtacaaccttccacaaaccgagcatcgcgtgtgctactcctgatttttttttacttttaaaacattttttattttttattttaaaagtaaaccattttaaaacatatttataaaatttgaaccttggatgctagctcgtctagcatgctaaaataatattgtcatgccacttctaacgagcgggacggtttaattctaccataacaacctagcaggacaatgctatcacgcgattcaaatagcgtgggagtgtacttttgccactccaactcgttttgcgtgaccaataattcagatactaaaaataagtcttacaaaactttatttttaaaatttaaaaataaaaaattactactcccctccagcctactccctcagtaaaaaaactcaacctaacaaatagaacggatcgaaaagaaattatttagattcatgttattacgaggagtcacattctagtctagttttttttttcgaatggagtagtctatatctagcaaacagacgaacaaataaatccatttttattttcgactcggagcatggtgctttttttatttttggctgtgtacaccctccagcctactctcttctttggctgtgtacaccctgtacatacataggccgggtttaatataaaggaaaaagtacgaattaccccctgaacaattgcgacagtatgaattaccccccaaaccacaaaaccattcataccagacatataaccccccctcacactgttttgaccggttttgatttcaacttgtacacgtggcgccaacgtggcaatccagtcagaaaaaaagtaaccgttggggcccacctgtcataacccttcatcaacccaatccccccctctctctctctttctcgttgtctcgcacacgtgctcggacggctggcagcggaggaggggcacactctcagacgaccgacggcggaggcgaagctcgtccggaactccgtctgtggaggcggagatcgcccgcgtggtcggcggcggaggcggagcttgcctcagttgcctgggagtccggcggcggaggcaaagattgcccaagcggcacttgtacgaggagcacttgtacgacagggacaccggcaactgcaccgccggcgtcgacttccacaagtgcggccacttcgtcttcatggtttgactcaacttcaccaggatcggctgcgcccgcgccgagtgcttcaacggcggcgtcttcatcacctgcaactactacaaagacgaggagcagccggctgcccgtcctacctactcctagttgcatgatatgctcttcttcttctctcttatcaacaccttacttgctgcctgcctgcctgcctcatgtacatatagctacccgaaccaccgccgccgccgccgccatcttcttcgctcggaccgccgtcgccgccttctcagcccgaccaccgtcgctacactggaaaggagagggaatcggaagagaaggagaggggaaagggatgagtggcggccgtggccctcctgtgcagctccatctcgtgcgtcgccgtcatggacgcggccaccgacaccgccctccgctcccgccaggacgccctccgcctcgagtgcgactccctccgccgcgacgccgcgctcctaccacgcccgcccccgccacgcccatcgctcgctctcagccatgcctaccgcccacctcgcccatcgccggctacctagtcgccgctcccggcgacatctgagagagagagagagattgagaggaagggaaaagggaaagagagaggtgggtcccaccatgttttatttgtttttggctgacaagcgggtcccatatcttttttatttgttttgctgactagagtgccatgtatgcatccacgtaggatcaaaactgccctggatcgacataggggggtaattcatccgatttgtaaagtttagggttaaaaataactggtattagagttgaggaggtaactcgaacgaccgcgattgttcataggtaatacgtactttttttttctaatataaatccattatctaaaaaattttcgactcggaaacccgcagggcgaaaaaaaattctaagagggcagccgctgggaatttctcccacctcccctcccccacacgaagcgaagcgcaactcggcagcggaagccgcgcgcgacgacgatggccgccgccgccgccgactacgagtaccgcgcctacggggcccccgccgaccacgaccgcccctaccacggccgcgaggtggtgccgtacggggaccgccgcatcgacgtcgtcgtcaagcccccgggcaccaccaccaccaccaccacgaggtcgcctccgccgccgctgccggtgaccaaggttgggggcgggggaggaggcatgggatccgcctggtgcttcagcgacccggagatgaagaggcggcggcgggtggcgagctacaaggcgtactcggtggaggggaaggtcaagtcctccctccgcaggggtttccgctggatcaaggccaagtgctccgagttgatccatggctggtatggatcacttcttctccccctatccttttccttggatgattttatcatcacctcgaagcaagcgctctcttgattgctgtgacggccatggctggtttggggcctgatcacggtggagacccatccttcctctgtgcaatggatttttgtccaagaaccaaattattccattagccttttcttcggtttgtttgcgtttcatctttagaagtttcagcatattgaaggacagccacaggaattcagcaactcacaaactggtcactagttttggtctatcaatatactgttctacttggaagtagtagtagcttgcaagaagaagcgaagatattcatttgttcctgcaaaatttctctcatctgatctgtattccgttctgttgttttcttcagagccgtgggatcttggtggagttcagtttgggttggaacacgatacaagcctgcaaccatgtgcaaggagtgtactcgctactactaattttctgccaaaaatgcggaaggatttgtccaagagaccgaggggaactgttcttgggtggtcaggttataggaaaggaaaagaaaacttgttaggagctttctgatgagattgcttctcttgccgatgctgttgttactgtctgctaattctagcctaattttttcaacaattttcctaagaggagttgaatcttcgcaaaggaatcgatccatttgcatgagacatcgatcgctatcttgtttgtccgtgatcttgtggaggcctatactttgatttcgtacgaagaccttgcaaataaccaggtcgtcgtcttcttcttcttctttttcgttagtgttttggattgggacagattaccatttgtatagcctacgtgatgaaggcatgatcaagcgaatagttagaggagaggaaggaaaatcatttgaattgtatttccaaatgagagcaccttcagcaaccctgtttaggtgaaatcagcaaatccacgatataaatgcaatgctactacgtgcatagttgttgtagtttaccctgtttctcatgttcctacaggtagtacaggactacagagaacctcaaacctggcaactgttgttgcttgtgccatcttattacaagcctgacaaatatttgccctgcttattatagtatatatatggcatttgtcatacactaggtgtcaattttgttatattcctgatttaaggcagactaatcaagcacaatgacctgtacaggacgatatccaaagtttaattaggaaactaattactcaggagacagagttcaacgaacgctgatcattcctactactactagcagacgagtattactttcctttgatgaaaagcagacgtcaagacccatacgcactagcatcagcgtcaatcagaccatcgactaccattaccatcaactgcagctggagacgatggctgtcactgcagctggagagggtggccctgcctttgccggaaattaggccggttggagaggtttgcgaatacgagacgtacgtactgtatgccgtgacaggcccagcacaacgagaacagcagcaggtgccactacggatggaagggagcaggttgacgggaagcgattaatttcctgtaccaaccgccacagttttgttttcccggtaggtagaattgatctgcaacgccagtgccatctttaatccgactgggccgtttcgttgttgcactgacacgatagctgtgtgacattgtgcctttacatggacgggtcgacgtgtcgtgtaatcgtgttgcttgctggatgaaacaacgaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaattttgcaggcggcccccttgccgccctccgcgagggcgattttgtactgtgcggggggccgcctgcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagagattgccttcagattgtcaattatatagcgtcgttttcactggaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggattgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataagtgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggacggtgagccagtaagcctggtcgcgtgtgcacaaggacgaaagtcctagcggtgctctcgcagcgacggcctcttctgtgtacggctcccagatgacgtcgctcggctggagacggtcaaacttgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatattagtacaaaacaatcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccgatctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttgaactaagcgaattactaacacatattaaacaagagtacaaacaaacaaaagtgtttagtccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacatattatttcataccgatgcacttgtgtgccttgagcaacaactcgatgtctccgtgcctttttgattttatcttccatgtactttgtcactacgttgccaaacactatgttgtcatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatataatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggacacaatgctaacttttcaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgcttctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctttggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagtagggcttcgccgctccccttctgctgccctcccctctctctcttttgttttttttggatttttagtgaatataatgaaatttcacagaggagggactgggctttatagggggagaggcaaaaatcgccctcccccagggcggcaaggggg

SEQ ID NO: 3045 - DNA, 30317 bp, Oryza sativa
  unsure (1)..(30317): unsure at all n locations
cggcaagggggccgcctgcaaattctttgacggccgtcgcccggaagcaaacggccgtctgccacgtcattttcgccgccctctgagagggcgatttttaaaaatcgccctcccagagggcggtaggcgactccttccgtcaattttcaaaatggaaaattatttttgtaaaacttttaataaaaaaaattataaataaaaaaaattcatgaaacaacacacaggcgtaactaacatcagtgatatttgggccgaaagagcccatgtaagggttagaggcccggtccatccaaacttgcggccgcatcgcggcatccaccaacgaggccgtcatctcggcccgcgcgcgggcattgggccacggtggcatctcgggcattccggcccacgtatcggtgtaacggcgaaatcactagccgcacacgcgagcggagccggaggaggagacggagccggcaggatccaccactgctccagctctctccactctcactccccgattcgccggcgagcaggcggcggcggcggagctcaaggcttcctctccgctccgcaggtaaacaccaggcaccatcccctcggctgtggctcccccgttcctcttgtcccactctctcttggccccgaccctcgggagtccggcgctaccgaatccgtcttccccccggagctgtcgaaggagcgccgcgtgcggccgtgctactcccaccgacgccgcgtcacctcgaaggcgaaggggctcttctcccctcccctccaatggactgaggcgtatcccgtctaggccgatttcttctgttgagacggaagccctaacatagctagattgctttttccaatgatttgtcgcttgctaccagcaatcaaatccttgtgttattttttgcttgtctgtggccactccaatccacacatatagtcgcatatttgatttgattttattactcgaatggcagcttgctttgcaaaattttcagaagcgcaactgaaccctcgcgcctgatatctaaatagctgctcacgaatccacctcccttattgtgtaccaggtaccaagatgaaggtcaagattcttcagtggcattcggtggcttcttggacatgggacgcccaggatgaaacctgtggtatatgcaggatggcattcgacggctgctgccctgattgtaagttccccggcgacgattgcccgctcatctggggctcctgcaaccacgctttccatctccactgcatactcaagtgggtcaattctcaaacatccacaccactttgcccaatgtgccgtagggagtggcaattcaagggctaatggcatctgaaattatatcactagtatctagtttgcatgtttccttgtagagaactgcaggaaaacttttctggaacttagaaatgttgtcttcaagtactatgtactaatattttctgcaaatgctgatggtcacaatctgctaagtgaaactgtgagccagtttcatatctgtagtgtccttttgggagtctgatcgagcaaatgaattgttacatttgaaaggctgaataatctgaggttatcacaaattttctcttactgtttattttcagaaagattatatatttgtatttaccaaccaaagatgattaattgtgttcgtgtagactagtacaaaagcaatcatgtaacatctagcaggttgtgtatattttttccctgtaattcctaacttcatcaaagcatctctccctttgaggagcaactgatagaccctaacctaaaaatgcagtatgattcagaacgagttataccagtgtttgtttatatggtgagacccattgtacagtcactcacagaaagttttatcttaataaattcatgacatgcttacataacttaaatcactaagtgctgattaggtattgttctttgttttgcactcagagttgcacgtgcattttggattttatatattgaaagctaaattttgatataggctcgtgttagcttagaattgccataactcaaatgtaaggatctgttccaagtatccccttccacctataaaattgcatcttgtacatgttaatattaatactgtaccgctgtatatcagtatatgaccaacaaagaactgcagaaccttttatatttatgacctagcaagtgacaggatgaatcaatttgaatgaatgaaaaaaaaacattaatgatgaatgttactttgttgtattgtggtaaatgatgttatccattccctgcaaaatatttgctctctagtttacttaggaaaaagtacgaattaccccccccccccactattgtggtcgtccaaattaccccctgaaccacaaaaccagacattcttcacctccaactatgtaaaccggacgaattacccccctcgacctaatctgcggtggttttggtctacgtggcgtacacgtggcagtccagtcaacattctatttattaaaaaacatgggacccacctgtcatatcctcttccattgttcctctctctcttctctctctctctctcactctcactctcactcttcccctctctctctctctctctctctctctcacgcgcacggcagcaggcggcggcggcggcgcacacgcaccggaagcggcggcgaggacagccgcaatagttcgagggggtaattcgtactttttccttttacttatctagaaaatgcaaacaataaaatctgaaagctgtgtaattggggattgaacacctttgcataacttcttataaacatctcacttttctcatatctgcgtctattcagggcagatttatttgcatgttgctgaatggtgactatgtggctgggtgcatttcactttactcattgtctaccagtgatcagagcagaccttttttgcctgttgagtaaattgtggcctttgtggcagggcgtatacatttatgtgtctcataatttgttgtcttgtactcttgtagaatattgcaattatactcttgtagattaaatttgtgcaagtaagtaatctattgttgttggcggctcggctggtacgctttcgagaatttaatctctttctttcttttgcaaaatgagtagaatttcagccttcttggagaggtttgttctctttgcctggttactagatagcctagaagagcattttttaaatttatttagtcaaaagtgatttttagtgatatttccagaaactgtgctaaaaattaccatgtttctatatccaggttccagctcattcttttcattttgataagcaaactaggtgtccttttttcataagcaggaagggaaatcttaggataaattagtacccttcctgtttttaaaatttattataagatacgttgaagtattcttttgaaataaaattggaatttaaagcaatcttccaggccgttaattggggccatacagactgggtcttcacttttctaatgcctttcggtctgaattatgtttcgtatagctgctccttttcttttcagggcaggaagctgcacctcgtccatgttgtgctgtccagggtccaggctccaggctcgcttgcaactgtgggcaaatctcgtggtatttcgtggccgctactccaccatttcatgctaagcagctaatgcctgtcgggctaatggcatcacgcatttcattagctactgacaaaaaatgatattctctcctcctgatgatggttgccagcagtgagcgttacagttaagcttgttctccaaaaatatcatattgttctactacttgcagatctcccattctacatggcaccaaatttcaggtgaactgctcctttccaatggagccttggcacgaaagcgacctggatttttcgaggctgccactacgtgacaacaattgtgataggcagtttggtggtggccgcatgcagctgcttgccttgactgaaaattgattttccagcttgtgaccactgtttctggctgtcagcttgctccggagatacataccatgtgaccccatggatcagtggcatggaattcctttggtgttttcaggttgcttgaatttctgggaagcttcctgttaggctacaacgttaacagtgtttgagccagttcgtttttagtactccgtacatttcaatccgtggtaagacctgaaaaaatttcacgtgtgtagccatgctctgatttaagcctgttcggtcgctttgtacagcagtacaggccaggtcatctgcattggttgctgggtgtccgtatacgattttacctgtgcctggtcacctggccttgctgccttgcatatgataagctgtatcccagtgaggcttgactcggagtaaactagtgccattctgaaacgggcgcagccgcggaaattacgctgttatggtggttgcagacttgcagctcatggcagagcgctacgcggttcacatcttaatcaatcgaggaagccatgttccccactgacgagcagcagccagctaccgagcatggtgcgctgttacccttggacattggatactttggggtatcattacgaaattgttactgacgcagcaacgttgtagggctagccgggcagcggcatctgtttcccgattgcagtaaatgcaagtgacgagatcgaggcaaacatgagccggaactcttatcttttcgtctatgcttatactccctccgtacttagagagtcgtttagaacaatgtttaagtcaaatcttaagaatataaatcatgaataactcttaagttgttgagtttgaaaatataaaaattatatgtatagatttgtcttgaaaaatactctcataaaagtatacatatatcacttttcaataaatacttttatagaaataagaaatcaaagttgtgttttggagactgtgtcgctgtcctaaacgacttcctttacgagtatggagggagtacttatcaaccaaaatttaaattttcaaccttaaatttaaagatgtttttaaagtttttttattgaagtttattttttcagcctttgcttttagatcgctaagaatacatatataaaagttctatttacaaattactactttctccatttcacagcatcaatatggatgtgagaaatgttagaatgacttacatcattttacaaatatagcgtttggtggggccgctggattctggaagtaaccgagaatgatcaaggaaaactcgtcaagttctggcacttgtcagagtgaaatttcggaatactatcctcctgataattcgattactagattcctgataattacccggacgggcaaaccgtgtcagggaattcggtttgtgcatccaaggcacgaaacgggtgaagtgaacagagcggcacgtcggggcgacaagggccccaccgttcagtttcagtggcacgaagcgacgcgacgcgtgttcgcatgacccgccgcattccgcggccgtgccgaaagtgtgaacggtgaacctctcccctggcccgcgggccccaccccccaatcatcttctcctggccttcagcctccagctgatgccaactgccatgtcagcaactaacgcgctcgcttccttcccgcctcgcctcaacgcaaagcgagatccccccctatacctattaatacctcatcttgtcgtctcgtatcatctcatctcatcacatcagcacacatcacacgcgccgattccgaagaaatcaatcaaccaactactaggcgaaagcaagagcggatcgggtgctgcatttcgcggtcgttttcttcctctgaattctggtgtttgcggttgcggcaatggcgttggtggcggcagcggcggcgaatccgaagcagaaacagaagcagcagaaggcgtcgatcgggaggcgggcgtggcggctgctgcgcctggcggtgctctgggcgaggaagggcagcgcggtgcacagcctccgcctgctcagcaacctgcggcgcgccggcgtgggcctcggcgtcgtcggccgaggcgaccgcctggggtacggcgagcgggagtactcgatcgaggagacgccggcgttccggttccgcacgccgtcggcgcgggtgctccgcctaatcccctgcatcgcccccgccgtcccggacacgcccgggctctacggcgacgaggaccgctacttcttcgcccgccgcgacacggagcccgagtgcggcggcggcgtcgggtattacgactacaatggcgagccgggcgagtgcggcggcgtggacgacgagagcttccgcgacggcgcgatggaggagcagctcctcgagctgtccatgctggaggcgagcgccgccgccgtgacggaggacgccggcgtggacgccaaggcggaggagttcatcgccaaattccacgcgcagatgaagctacagaggcaaatctcatggctgcagtacaacgagatgatggagaggagcctccgctagatgattattcctacccaataagatccattttttgcgttttgtttcaccgattcaaattcatacaccagctaaaaatacagagatattgaggagtagcttcgtatacgtacagtacagatcaatacatttttaaatttatttttcttccttgagcattgatattggtttggttcattggttgcgaattgatatctgtacattttgtgcattgagaataaacgagcagagcagaaatttcagattcaggaggaggcttcttcttggacgcgcagaagaacatgcagttgctttggctcaatgtaagctgtactgctgtgtatccgcatggtacacttgcttgattcaattgtggtattactctttacctaatttgttcgttgggttacataattagatgtacgtacacctggatcttgaatctaatgatgacagcatttgacgatattaatgaaaacccgtaccaaggctatgtttagtttctaaaatcgaagagaagtttggagaaaattggtagtttagaaaaaaagttgggagtttatgtgagtagaaaaattttcgatgtgatgtgatgtgatggaaaattgagagttcgggggaagtttggtttgaactaaacagaaaatttgtttatggatgattatagtgaattcgtgtcacaaatgagtatgttcacgtcaaccattgctgcctttctagtttgatttcacgccaaaattaaaggtttggttaaaattagaacaatataacagaaaagttaaaattttatgtgtgtagaaaaattttgatacatgaaaaagatagaagtttgaagaaaaagtttagaactaaacagggccttaaccaatcagttcggctcgactgatctagacatcacagtttatgcactagtacgaccgatctgcctgtccttgtttgcgtcgtgccgaccgaccgccacgccgtggctgggtctagcggaaaccagcgacctgccctgacgccgtcaagcggcgaggattcagaatcctctgctgcaaggctggaatggaaaaaggctgctaacacaaaccgagtctggcgatcgaatcatttctgtacctgttattactggtactataaatcagctttaaaattttttatatatattattaaaatatgttatattttgggagtgtttgggaattagggactaaatttagtccctctcacaaaagtataagttcctaccataggaacttataggaacttatgcttttgtgagagggactaaagtttagccccactttagtccctccaaccaaacaccacctttgtatttggtttattttgaagtgggaacagtaatgagtgatgtatagagtaatccacgtttcaccgagctgctgttggctcgtagtttttttttcactgtttaaccactcgtctaattcaaaaaaatttaaaattattatttattttttacttactttattattcaaagtattttagacataacgttttgttttttatatttacataaattttttaaataagacaagtgatcaaacaatataagaaaaactaaaaatccttataataagacggagggagtaatttttgggcagatcgtctctcggaagtcgagagcaagaacgtgagaggttattattccttgaccgaaccgagctgatccctgtaaagaacgtggtgcgtggaagatgggccggacgatcttcggaactccatgtgaagttgcaaaagtcttgacggctatagtccttgcacgtttgattgggcttttcagccatgaacaacgcaaaaccacaactagaagtggtctcggggactgaattttcccttttgtctttttctttcaaaaaaaatattttataagtagatcagtgataaaacttatttcgagaatggaactttttcaacgtcattatcattgatgtcgtgattcaacatactaacgctagcgtcatctctctagcctcgtcgtgaaagctaggtcacttatgttaagagcgaggggccaatgacattagcactgataacctatttatattttttaaaaaatgatttatctgtaattaaaaaaactatttacaaatagttccttagagctagtgtcattgacattgaggctatatttagttaatattttttattattacaaatagatcatttttacttttttataaatagatccttggcgtcaatggcattagcaccgacccccttcatacaagtgacttagttttcacggggaggctagtgggacgtcactaatgtcattgatgtcgaaaaagagtctattctcgaaagaaattttttagggtgcctatttataaaataagttcttaaaattctaaaatatatataaaaaatccatatcttagggatagaaaatatgccatataggatgagactaagattaatgttagcggtactacctttcccatgtacagtagcttcaagtataacacattcattatttttattgcccattttaattttggctcctccattttacattcaagttcttatataattttacaacacaaactcctagataacaaaatacactcacatattaaaccaatagtcacagccgttcctcccttcaccatcatcgatgaccgctccaccatccttctcccactccggccaccgcaacatctcccgcttcttgctccggccaccaagctgctcccctttcactcaaatcttaaaagtgtggagttcatcttcatcgggtcgccgtcgcttctcctctcttaagcggcgccatgaccccccctcctcgtcgtcgtaggctacatatggataagatgggggtggctgactggcagtcgaggaggcgaggtgatgtctggcaatgaggtgagcctaggtgagacgtcggctcgtctctttcaaggccaataccggtgaatccccaagctcgacgccaaatccttatgcatagtgtcttcctgctcattgtgggcttcatctccactgtccagtcttgtcgttcacctagaacatgccatagttgcaggccaataaatgccaacatggtgtagatcaacatcaaaacaatgagttccccaatacaactgctatctctatgttcttcgaccatcatttttccctatctcctctccaattgcccttcccctttgcggccgccttctaccaagaaatcaagcgaggcagaggggaccacactggtcgcttgggaggtacgccgtcttgacacaacgttgcttttggccatgtctacaccaccatgtggcttcagggctgcaaggcactaatgttgtctacaagccacagttggctctaatgggcctatgcacaactaacaatggcaaacggtataaaatttgtcaaaaataaattatttttaaattttatttgagtctaatagggttaccgcggttttacatttaccgtatctgacggtaagcgcaattactgtgtggttaccgcctttttgtaaaccatggctatgagtggtgcttatgcaaatttgttcaggggtaagcttgcaaagttgcactgagtggtgcacatacaagttcgtcctgcctagggtgtgtttagttcacgccaaaaataaaagtttgattgaaattggaacgatgtgatgaaaaagttggaagtttgtgttcgtaggaagtttgatgaaataaaaaaaactagcatggtggcccgtgcagattgcgtgcctctgcgcgcctagcatcattatattttctttcatataatatcatatatgttttctcattatattattcaaatatattaaaataacaacataattttaaattttgcaataactttacaaaactactaatgtgtaatattcatattatattttatatacgtgttagttattaattatttttaatatcaaattttagttatttgtaaattatatatattcctatatggactctagactcatcttttaatatttctttttttaatttcgaattttctgtaaattatatttctatatagactctatgctcttcttcccatattatttatttttatttctgaatttttattatttctaattgtatttctatgtggactctaaactcatctttcaatactatttaatttttaatttcgaatttcagttacttctaaattgtattcctatattgactttaaactcttattccaatgtttttcttaattttaaattttagttatttgtaaattgtatttttatacggactctaaactctacttttaattttattatgtttatttcaaattttagttattttaaattcctatatggactctatactctacttctaatattccttattttttaattccgaatttctatttttttcttaattgtatttctatatggactctatactctacttctaatattccttatttttaattttaaaattctattatttcctaattgtatttatatatagactctatactctacttctaatcttccttatttgtaattccgaattttggttatttcctaattatatttcaatacggactctatactctacttctaatattccttatttttaattccgaatttcaattatttcctaattgtatttctatatggactctagtctcattttctaatattccttattttttaattccgaatttcaactatttctaaattgtatttctatatggactctagtctcctcttcgaatattccttattttttaattccgaatttcagctatttctaaattgtatttctatatggactctgctttttctttctatatggactctagtctcctcttctaatattccttagtttttaattccgaatttcagctatttctaaattgtatttctatatggactctgctttttcttttttctccgattaacatgggaatttctagcccatgaaagtgaacgtgatgcctcttttttctattcctttaataatataatagattaaaaatttgaagaaaaagttaaagaactaaaccaggccttactctagtcaatggctgggataacgcacctgatctagcatgtactcccagacggcaagattgcacgcccaggattacgattctatgcatcggctacaaaaaaaaaagttgtggacgatactgatcgccggatcccaagattcaaatcgatctggtggcatcggctggtgctgacctgctgatgcaatcgccggccctgccaccgaaccagtaccaacggctcaatccaatccgggcccacctgtcatacaaatatccacgacaactctcccaacaaaatcatttttttcaaaccgcccctggcccaccacccagatgtgtttgacccggggctccaagcctccaaactctcgatccgaacagcgcccacccaataggaccacgccacgtcaccgcctacggtgttcgctgctcgatcggacatccctgccgtccgtcacgcgcatcaagattcgcgcgtggttcgccgcacgcttcagccacacccctcctcgtgatgggattccccttccgcaccgagaagaatttgaaatcctggtcgcttgaaaaagagccgttgcctcctctttcatcgttttccccaccacgcacacaccacctgctcccgtccacgccacggcgcggggactctcaccgacacgtgggacccacccgcgcgtggggcccacgcgtcagcctcgctcaccaccaacggtagtgcggggcccacctccccccaccccccgaattcgaaaaaaaacccaccaccattcgtgctgccgcttgcgtgttgttattactccttggatcgactcggccagcataaatgccccgcctttaatggcttccccgatctgatgcttccgccctccgcttctcgcctcgccgccgccgctgccgagaataccgccgctgcggcgctccacgtcgtcgccgtcgccgcgaggccacgtcggtaggcaggtactcccccgtgttcttctccccgctctctgttgttaggctcgtgttgcgtcgcgatcgatttgatgaggtgtttgtggctccgatccgttggtttctgtacgggtgaggtgaggtggatttttatgattgattttgtggtaggtgttgtattggtgattttttgttgcgggggatcgagcggatcggatgctgaagaacgggggagaaaagtgttggttttaagtagagattgtttgggatttgaagggagttgctacgagcgatggggacggagaaaggtggagcaaagattggtggcggcggcggaggaggaggaggaggaggaggtgggggtgggctgttcaacctgtttgactggaagcgcaagtcccggaagaagctgttctccaactcacccggtaggtgttcgctggaatgcctcgctagttttgttcttcctctgttgccgtgctttcttagccttttttcgcgtcatctttgttacagagggtgctaagctcgtgaagagaggcgaagaaaccttgccgtctgggcgcctccacttggtgagtgatctctgatcttgtcgttgcccttgctctgcgctgtgatttgcattgtgccgtggaacttgtgttcatgggtgtttgcggtattgtatctgcagattgatgatgatgaggggattggtgtgtcaagcttcaaagggagcagcgactacagctgtgcttcctcggttactgacgaggaagggcgtgagatgaaggcgccaggagtggtggccaggctcatgggcttggatgccatgccctctaccggggtcccggagccgtactgcacaccattccgtgacacacggtcgtttagggacagccagagcctaaagagaagcccagagtactccgggagtgaccagttcagttatgtgccacgaagagttgatggctacatgaggaagccattggatctgagagctcagaagatgccgagcagcccgattgagaggttccagatagaaacattgccgccaaggtcagccaaacccttaccaatgtcccatcacagattgttatctccaatcaagaatccgggatttagttcagcaagaaatgcggctcaaatcatggaggcagcagccaagattcttgagccaaggccacaggtcagttctagggagaaaatctgctcatacagtcctgcgcggattcctttgaggatttctgagacacgggagaatatcccagcttctcagagggcagtgtctcggcagctgcagtcatctcggaccaatcttgagctgcctgatgtgagattttccagggggcagcaaatgaacaggagctggaatagcgaagatgacatagtgatctttaggacttcatctgattcttatgagattaataaccctggcttttcaaagaacaacaaggggaagtccatttcattggcactgcaggcaaaggtgaatgtgcaaaagagagaaggattgggttcttctgggaagaattcaggaggacagaaagatcgtgatgagtgcagaacaagccaaccttttaggagtcagtccaatgcccagaagaataagcagcagaagaagccgtcatcatcaggtacttcctcccctgtccttaggcaaaacaaccagaaacaaaattctatggtaagcagaggaaagtcagcaccaaacaaatcagtctcaagccagcaaggtagaaagatggctggagattcctcaactgggaagctgaagaatgcaagcaaaatatctaaaggtggcagcagaaaggatattgtagaaagcataagttgtgataaggaaggttcatcgtcaaacaacaaggactttccacaaaagaagcgtttgatagagaggaactccaccaatgagaagggtatgttcgtgcctgaaaaatcagcagctagacttcagaagcaagttcaacctaatgttgtcatggatgagcacattaagtggaacaacgatagtaaagattctacagatgtagtatcatttacctttacctcaccattggttaaaccatcagcaggaccctccagactgtcagggaagtgggatacaagaagcaattttaatttggatgccataaatgagaaggatgattcagacaaaaagtccgaagggctctcatcagtaggattgaactttgtaaatggtgatgctttgagccttctcctagaaaagaaactaaaggagctaacatcaaagattgagccatccatcaactttactaggggcgacacatttgtgcccgcaaacttttccttggaagagcccgtggtctcctcttccagcaattgggatatggaaagcggagtatttgactgcagcccttctgaaggaaaaccttctcaatatgttgattattgccaatcagcgcagtcatcaaccaaaggccaaattttccgtggaagtaaattacaggtaaacaatagcacagagccacacactacccctgttagaacaaaagtatacttccatgctggcaggaataatcattttttcagtctatattcatcatttatctttgacaaaacattttttgaagaacttcctctttatgttaaaatagaaaatttggtcagcatatccattacatatttaaatagcatttttagggcctaatgtttttacttgaaatctttattttcaatgattgaacactcatttgctgcatactggggaccaccctaatgtttatgaagaaacatcaagcttccctccataaatctgtaaattccgtcattgtgttattgaagaaaaagatgatacagttccaaccttctgcaggctgacatttttttactgttttttgaagtttgaactctctgttgtgttgaacataaacattataagtgtgtatttatgatttaagtgattccattaccagctctcgtcatttgttcattatgcttgtcttctccaccttgatcctcgaatattttgcttctcgggtagttaggtgttggtgctgagccatgtacatgtccagtagatttctctgtgttatggcacatagattattctattatactagtgttattgattttggtatgtctgtttgtgtggcatctcctagctagtgttattttatttctgagaaaattcacatctgggtgtagtatttgttatgctatgtctgtttatgtgggcatcacctagcttgagttattttagttctgaagaaattccatttcatcttaggtggaggaaccagaagaatgcagcagcataagcaacgcaaggaaagaacaggagcatgaagatttaagtcccctctctgttcttgaaccaacctttctaaatgagagttgctggtcttctgattgctgctcaggcagtagcgatggtaattcaacttattgaaattctataatttgtaatttctaactgtaccatttaccttttcctgagtctaagtcatgcttagtctttacaggaagcaaaggatattcatcatcttctgaagttaaaaacatgccaaagaatttcctaagcaatccaccatcagtggatgctgaggccaagacaacagattcagtgtcttcttcatcgattgatgcatcagacacctcagcatcaatagatgcgtcggacatctcagatatcacccaatgttcaaagaaatctagaaactcagagctggagtacattggggatgttctaggcaatgtcaacctgacaaagggtggattggggtcattattcatcagtcaagatgatgtatcggtgatggacccccacctctttaacaaattggagagcatgaacttgtatacacaagggaaaaaaaatttggaccggcgagggtacagaaagctcctgttcgactgcgtaagtgaatgcctggagacgagacgtctcacatacttcagggcaggatatgcagcatggagcaaagggatggcagcgatgagcaggggcatagaaactgaagtctgcaatgagataggtggttggaggagcatgggcgaatgggtggaggatgaacttgtcgacaaggacatgagcagtgggctgggcacatgggttgattttcgggtggaggagttcgagacaggagaagagttggagagggaaatactgagctcactggtcgacgaggtgatcggcgacgtctttgtgagacgacgggacggcaggagtgtaaatttgtaatctgatctcgagtgttgttgtttttgttctgtaattttgttttgttaagttatatccatccctatttgatttgtcgaccagacttgatcaaatcagttatatatatgtgttgatttgagactgcatagtaatctcaatcaattcaaatactgaatgtgctccccttggccgagatgatttcaaggactgcaagttcaagtgacaatgttatactgggtaatactagtgcatttgaacgttcttatacctgccaatgtaatgcaaaggttatctctacaagctgaagccaccagttattactagtaataaactgggaattgatttgcgcctcacaagttgctggaatgctcttggtgatggacataaaacccctcaggttcagcatgatgtgttgatgtggtcttcataaataagaaggttaggatcatattcatgggcgtgccgacaggtcacgctgtcctggcctagcattctcgctagaagccagatgccagcattatttgtccaatgccatcgagatcctatcctatacatttgatgtgtgatgttatttggttctgatccagttctgcagttcctgtgttttaacattggttgatgcagttcctgtatttttctgcaactgcaatctgttagtttgtgacatcatgctatactgtactactccatccctcctaaaatataatcattctagctttagtattagtttaagtaagtttatctaacacgtcaaataagtttaaaatttttagttgaaaccaagtattcactatcgtaaatataattcagttgatctaataaggatgttcactatcataaatatataagcttaggatggtttgatttagaacaaaactatacaagtgattatattttttagagcgatgaagtagctttttgcatgtggggcgcgatcgaaacacgtgatatatggtttctccagcgaagtttgatggcggcggcaacgggataaaatagaggactcgactctgtcaccgtgaaaatgggcgacctacaaaactgagagactggcctacatatggtgttgggcttgtggagggatcggactaactgttcggtgtgattgcaccataccttctcttaatttcaaaatatgggaattctacaactaagatttttttttaaaaaaaatacgtactagaccgatatatcttttcagtgcgattgcactgtaccttctcttaatttcaaaatatgggaaattctacaactaagattttttttttgaaaactatgtactagaccgatatatcttgagattgatgaagtcatcacatgcatacagctgtcgacagttatgccatctgccattgaaatatccgtaaatagtagaacatgtgtcaagtctataactaagggcttgttcactttatagccattttgaaccattccaaaatttggcatttccaaaattttggcaaaatgacaacattatcaaattttagtagcatatattaaatgtgatattgttaaatatattgtattattaagatagttttgaaatgaggcaccacattcgctgtgggggttagaaattctcatattaatcggagaaaaagaaaagcagagtccaaatagaaatacaatttagaaataactgaaattcagaattaaaaataagtaatattgaaataacagtccatataagaacccaatataagattaatagaaatttagaataaaaaataaaaatcgaaattagaaaaaagaaagaaagaagagttaagtagaaatacaattttaaaataactgaaattcagattgaaaaataagcaatattaaaagaatagtccatataagaatgcaatacgagtttaattaaaatccagaataaaaaataaaatccaaaactagaaaaaaaatcaagtaagaatacaattttgaaacaactgaaattgaaaataaaaaataaaataaattcgaaaactagaaaaaaggaaataagagttcaactacaaatacaatttataaataactaaaattgataataaaaataaatactattgaaagaagagaccgtctagaactcgagtaatcttggatatggtcttttctcggtcgatgcattcccttctagggtcgaagtaaaaaccgctcctcactagtttaccgaaattcaacaaaaaccgataaaaaccgatgagtttcgatcaacgccgtataaaaaccggctgatactgactggttttcataaaccgagaccttgcagtttcacgaaatccgattgattttcgtgaaattccatcggttttgtgaaccccgttgtacacctaggacggtagatagtctataactattcttgcactatttgaaaatttgatgtacggtaaaagaataacggttttgaattttttaaaagaactggtttatgtttcttaggatagtgagtctatatgcaagataagttcgttacgattttaggtcattttgtaaatccgaagacatcatttactacttactgtagaacagtacaacaagaaaaaaatatcttcaaaacataaaaatattatggaaccggaagggcgctacgcatcagatgtcctgagatttgcattatatgttaaaaaatgttgcaatgtttcattgctcgaaaaaaatgtttcaacatgaattgttttatgatgtttcatctttcactgaagaatgtttcaccgctttaacgaaaatgtttcaatcaaatgtaacactcaagaacggtaacaacaacaacaaaaacacattatgtgcaacatccaatattgatttaaaaaacatttagaaaagacatattgcaacatcgcaaaaacactgtatgcaacaatgctcgctagctcgacctcgtccgagcgccgccaccggagcctaggcacagtggaggcgtgcttcgcccctacctcccctcgggccgccgcaccgccgcgcttctctgctccggcaccgccaccgcctcgtcgctccgcgtccgcccgcttcttgtcgttgctagcacacacatggggagataagagagaaaaatgaatggttggaaataaagattagattgactgccggagaaagaagatagagagagtagttaggtgggacccactaggttagcgtccgattttttatcatatgccggacgtacgagttaaagcattttcggaagaataccagtactaccgctctagacatgtactccctccgtttcaggtcataagatgttttaactttggtcaaagtcaaaccgcttcaagtttgcccaagtttatataaaaaaatagtaatatttttgacttgagatattataaaattatatgtaattattaattaaaaaaactaatttagtaatgtaaatattattatatttatctataaacgtagataaatttaaagcagtttgtgttggactattcttatagcttgaaacggagctgagtatcttaccactgttgtaaatttgttgtgaaccttgtgatgccctcgctggactgttccttggatcaaagacgtggcggcagtaggcacaccgcccaagttggattagttggagcagtaaatactatacaccccatccaaggaggcgtagcggctgacccacccccccnnntnnnnannatnccatacatttcaccgcccctgccttctcctcttctctctctctctccnntcataacccctcccatcccatctccctccaccttcccaaatcccaaccctcnttccattccatcccacccccccgccactccatccaaaggcgcgccnaggcgccatggacgactacattcgacagcatctgctccaccccattctccagcgcgccgtccagccccggcaggtcgcctgccaccggcggcggctacttcttcagcgcgccggccagccccatccaccacctgctcctctcctcctcctcggttgcctccggtgtggtgtcgggggcggggtatggcggcgtgggcgatgcggagttcgagttcggcggccccggcgggcccatgatctccgccgacgagctcttccacaacggccagatccggccgctcaccctgcccccgctcccggatctcgaccccggcagcgacgacgacgacggcggcggcggcgacttccgccccgggccggtgcgaggccgcgagctgacgctgcggagcgggtccgtgcaccgccgcacgcggtccatgtcgccgctccgcggcgcgtccccgcggctcaagctgctcaatgcgctcgtccccgccccggatcttggctccgagccaactccatcgcactcggctgggtcggaggaggccacgccaccggtcaccgcctcgtcacgctcgtcctcctcctcctcgacgtcctcgtcctcgtcctcctcgtcgtccgcccgcgggtcacggcggtgggtgttcctcaaggacatgctcctccaccgcagcaagagcgagccaggcggagcccacgcgcacgacgcccccgccaagcccgagaaggcgtggcagttctcgccctcgtgggcatcatcgagagacaggatcgccgcaaagctccgcgcggcgaggtcaccactaccaccacagccacaatcggaagcgtcgtcggacgccggcggcggcgaagaggcgcaggcgacgcgggggcgcgcgaggggcggcaagggcaggcggcgctcgagcacggtcgcggcggcgcacgagcgtctctacgcggcgcggaaccgggcgcaggcggaggagatgcggcggcgcacgttcctcccctaccggcagggcctcctcggctgcctcggcttcagctcccgcggttacggcgcgctccacggcttcacaaaaaccctcaaccccgtcttctcccggtaaaaaccaaaggcaaacgcctcatcggccaaaaaaactccaaaatagagagcaaatgggaagagcttaaccaagttcttcgctgttgcccgttaattaattaatattattatttcctgtgtaagcgaagcttgtactactttgtttttttttcttttcctttttctgccttcgatttgtgcttgggttttgtataggcaggcagcgtgagagggataacaggattcctcccttcgttcggaggcgttggtggtagtagtagttgtcacaggtcagtcacatcaactggaaacatcagcggttggtaaatgtggcgcgaagcagaatgcctggtgatttttttccccttcccctacccattcttgtgtgcatggaactatcatctcaaccctgtactactcgtagtaagtggagtatatacacgttctactaagtgtcatcttcacatgagattcttgtcactgcattgtgtgtgtcaaagcacacatgagtatactagcagtattacgtacacgagcttttgcctactccaatgcgttagatttgcttttggtgaagagccgtacggccgcagcaaagcaccacctttcctttcccgagccacggtacgaaacaaaaagatcgcccacgcctccacgcgcaccggttccaatttccaaggttcgtccgacttccgctgctcgccacgagccccgggagttggcgtcaccagtcaccaccaccaccaagcatatcgtgtccgtgtcacggtggagccccgcgcgcgggccagccgcgtgagtgatgaatgaatactagtacaacaagcaggcaagcggagggggcgcacgatccacatggggggcgggggcctcacgccgggcacgtgccgtgtcggggtggtggtggtggtggtgcccgagtcgtcgtcctcctcggctcgacggctcgccctcccctcctccagtccagctgccgccgcataattggggtgtttttcgagatccgcagcgcgcgtgcggacggggaaaaaaatgggggaaaaaaatggggttccaccccgcgctgactgacgtgcgggcgccgcgggagggtgttcatccatgatcgcgcggtttatccggtcaatctcgagttcgcgacgtgtactgtgtacatgagttgctgctaataaatatattgtcccttgaacaaaccgatcgataagtatatgatcgcgaaaaggtacaacttgattaatcttatgtgctcggatgaaggtgcggttcttattaggggaaaaaaagatgatctgttttaagtgtttgttaggagacgacgtggtaggcattttgagctgacaagtacactcctttaaaaggcttttgatctagtttagtcctgtacatgcatggatgaagctagcgttaattagttatcacaacattaaccactcttccagatcagtactagtactcgtcatcacaggaacgggcttcatcttgcacgtgttaatctagctgtcgatcgagcttaattatctttcttctcttttttgcgaacggtacattcagcaatacagttgttgtcttaatcttcagggtgctgctggactgcggccatgacagatgcttagtccgcatgggtcatggctacggtctacgtagcgcgacgtgttaaccgattgtatcagtgggcacagcaatcggccaaaagatgaataatggaggaacaagctgatttgtttttcctgaaaagtttgggggacccaacaaataaacgtatcactgttgccgttagtaaatttctcttccagaagatccaaccagctagctgagatgtgtaaaagaaaacggagcaactgatctccatacaagatgctttacttcgactctgcagagtgcagatcgatactatatactgctactagtatacaacagtgtccgaacacttaatttctgttgtgcctcctgacgtctacgactcgcatacaatgcaccacagcggcagcatgattagcgacgctccaacgccaattaaaacagaccgagcaagagaactcaaaacagctcgccgatgagatcgctgtgcgatgaacgccaccggacaaacctgcatcatgccgccgcacagtcccggccggtgagcaatccaattcgcgcccaccggcagagattatatacatatgggccctgaaatccccgattatattctcgattagcatgaacaaacacgtattagcggcccaaagctcgtacgcagcgcgacccttgttcgatcgatcggccgccgcgacatcaatacaactgcatgcgaccatgatccatccacgcataggaggtttgatggtgagacgtcgccatggatgaggaatttctcggagagttcagagactttcagttaagttccagacgcgaggctgggtttagccaggtcatgtgagcgcatgtgatcggccatcaatctccttgccacaagctgacagtcgcgcagtggctggccggctgctacaatggattggtcccgcggctctcgtacgcacgctgcggcgcagacacgcacaattatttgaggggtgtacccgcgtacatagaggctaaaaagactcacaatgagtgaccccggtttgacgtagctagtagatcgatcgatcgcaaaataattgctgaaaaggagacacgtgaatttgtacacatagtgggaggaaaaagctgaaccagttcagtcctaccttagtgcaaatgatatccccttcctgtagagatcaaaagtcagttcacggcttatggcagatccacaattaatacaggtaggagtaggagtttagctacaggctagtagaaacaatacactgtaattagctaggactagggtagtataagtacactgtgattacactgtataagtctaggtaacgagggagcaaagtcagccctaatcttgtgcaccaaaaatctgactgtaatcaaagtaaaattatgtcgtcataaatatagcaataccgctggaagaaagcaccgaattgacagcatcctaaatatctttgatcatgatttagcacgctagagtaacgccatcgacgaacgggcgtacccgtacatgggcagcatcgactgatcgatctcgcacccccatttattcagaagatcttaagaatctgacgcgagtgcctgattcagactgcgacaccgaaattgaatcgatagttgggaatgctagctagccaagccacacacgtccgagcgctgccctgttcaccgatggatgagctggtacggctgtgccgatagatcgctttacctgccgtactggactaccggtagcgatcgccgacgctacagtcgccggacgctgacctcgcagcgagcgctcgccacggcgtttgtcccccgcgagacctgacggagcgagacctcacggagcggacgagcatgccccgccagaggcgcgtactagctccagatgcgcgcctgattcgatcgggacggcttgtttggctccccgtctccggcgccggtccgggctggccagtggccactcgtggctcgttgattgctgccgcgcgtgtgctcatcagctcgcgtaggatctaaacgtgttaacgttgatggcgtccttgttggccacgggtcacgggtgttctgaatttctggagtagtcgatgtccaccatgctttgtttacatcgcgaccgctgtactggtaacttgcagagttttgcgtctttgttgcgccaggtttggctctgaaattatcactgtcaatgtcttgaaggtgtcgtccggtccatcgatgattcgatggagtgatctcatcttacgacaataagaagtcgatgatttggtggcggcacaagtggacaatttctctggactatcaatagtacgtacgatagcattgtacgtagcgtgcgtagtttcattcaatagagtgaggaaaaatttcaaggctagcacccaggtaagacagtagcaaggaacgaaaaaagaaagccccagcatgcactggtagcgcctacacacaactcacaagaaggctagcaccggaccgactgtcactagaccaacaacgaagctacagtcggaccgctcaaaaccaaaacctaatagacgagcaccacactcaactctatccccgcctttgggattgaaaggagagagagtgagagagaagaatgaaaccgctcttccccacaaggcccaccaacatagccaacttataaagctaaggcaccgctacaagaggataaacatctagagagagcatgcacaaattgttggagagacgttttggtaggggtctcctagacgacatctccaagaagaagagcgacgatgagtactaacgccgtcatccgtcgaggtctcaagaaaaccaggagtccaggacatggttttcacccagcagccccactaaagggagaggaacgactcattaatgcccccaagaggaagaacaacgcccgaagcaccattgtttctcctatcgatctgaagctatcgctccatttctccaccaccggtcattctctgtcagtgtatggacatcgtcgtgccaacgcctcctgccggcaaacctctacatgcctttgtggaatacccgctgtcatcagcctccctatcgtcgccacaccggccgtcttaccatcgccgtcgcccacactgacctcccgacgccacccacgccggtcttccacaaccatcatcgtctctgacaagccccctgccaccactgtctatgtaccgtgccgctcgaccagatccgtcgtaggggctcccgtgggctccaccatcgtcatcgtccatgcacaaatgtgcccgtcagcaccatcgccgtcttctccaatgccgatgctccctgtcgtcactgtcgctgtcgctgaggttcgccacatggggaagggggactacctcccttgttggagaggccaagtcttgacggaggggcgctgaaattggccagaggggcatcagatctagcggctccgttcatggtgcgctccctctaccctatcacctttcctcctcgtgccgcctccacgctctcagcctcgctgcttgcatctcgtcctccacccttgcagtctcgccctcctcggaggcaccatgcctcctccgcgcgagcacaccgcaggactcctctgtcatcgacgacatcctcctcctactccccatcgccacaacctcctcctcctgcccggtgatgcgtggtcagtgccgccccctcccaatctggccacgagggggcaaattccgtctctggtcggatatgccgcaaccggccccgacagcgtcggacctagccgctgttgcttgccgcccctccactcgaaccttgtcagcgccccagccaccaagtcttgcgtgaagggagaacgtcctgccaccgccatccttgccgccgcccagctttgcctacggttgctcgggcagcggagagaaggaaggtggggcagtggcgggactgcgacgtcacctcccgtgtcattttggagcagagcgacacgagagtcaagttagcaacatagtactagtagtataataacacttgtagtatcgccttcagtttactaaggttgtgtttagttcacaccaaaattgaaagtttggttgaaattgaaaatgatgtgacggaaacgttagaagtttgtgtgtaggaaagttttgatgtgatggaaaagttgaaagtttgaagaattattttggaactaaacacggcgtaaagacgacacgaaacctcgtgatgggctgatgtctcgtcactgcagaaacgctgtaatatgcccatgtcgaccacgaaatctatatgccattgcttgttgctgggtgctactcttctcgctggaacagttgcatcccatacggaatgtgactgaactgacgagaatgactgtaccaaacttattcttacacactgggtgggtttaattcacatcaaaactggaagtttgattgaaattggaacgatgtgacggaaaagttgaaagtttatgtgtgcaaaaatgttttaatgtgatgaaaaagttggaagtttgaagaaaaagttaggaactaaaccaggccactgtcctggagaaacagacaatacagaactggtgaaaaactctattagggttcaggaacatctttcagacttgttttattggtgagaaacaaacaatagtctcctcttctccatctaaaatgcaattagctcaatcttgttgtaaaatcaaaggtgtttttgattattattctgtgatgaacaattgggcattggagattattggttttgttatttagaatttattcacgaggtggttttggagatgattggatttcacaggtgatcacaggattcgtcattttatgtgaccggtcagaccggactctggtagctggtcagaccggcgtgtattgcacggtcagatcggcgtagcccgcggtctgaccggccgtactgtgtcggtttcggtttcgggttgtttacttggatattcgtgattatttcataattatggcttctagatggatactatacgtatgtattactgttgtttgctactaatgagtcaagttggagattgcttggtctcggaatatggtttctttgtttatttgatgtgtatgtgacttgatgcctcgggagagtatttgcggtgatggaccggaagtcggcttgaggataagacgacgtccgtggtggtcagagatcatgcaggatacttaggctagaattgatgcacatggttgatggagattccatatggcatacgatgaaggtattgtgtgcgtatgggatgcggagtcgaatttagaaggagtccaaatttggtacgattggttatgtaaagtttctttcttgtactagtgggtttcctaaggtgtttaggactcctagtatgagtttggttcgtggttttaggctgcctacctcatgtataaatacagggggagcgtgaggcttcccggtatcactttacagagcaattgagttgagttttgagttagggtttcgagtttagtcgaaattttgtaaggagtgctgttggtgcactttgtaaacaaagagagaatcaataaagttgtcatccactttaagagttcttcgatttgtgtttcaccgagtttcggcggtccaaccagcgatataccggtggtccgactagcggcaagcggcggtcagaccggcggcggcgacagtgagcggcagctgatctcgacggtcagaccgatcgatctacatcggttagaccgacgttcatcaggcggtcagaccggtgcatacactttggtcagaccgcgatccgtcgaattcgagggtaacttttatttccgctaaaagttttcggtttttgggtataccaaccattcaccccccctctggttggcttagttcttgtgattcgatcctacaagtggtatcagatccttgttttcttctttggatttttatcaatctagagtttttgccatggttactcccgctatgttttcaactaagcctcatgttttcgatggaacggatttttgtcattggtgtagtagaatacaatcttacattatggctgaagattatgatatttggacaaaaagtttctcatccttatgttattcctgaagagattaatactgctgctttaaaaactgagtttgaacaaaattacaaagctcgcaatattcttttgagtgggatttctcgttcggattatgatcgtgttgctcatcttcgaactgctcatgaaatttggaatgccttgagtaattttcatcaaggaacaaataatattaaagaacttcgtcgtgatcttttcaaaaaggaatatattaaatttgagatgaaacctggagaagctttggatgactatctttctcggtttaataaaattttgattgatcttagatctgttgattcttcttatgatactaattatccacaacctgagatttctcgtcactttttgaatggtcttgacatgtctatttgggagatgaaagttacatctattcaggagtctgttaacatgtctactttgctttgaattcgctttacactaaattgaaaacacatgagatgaatcttctttctcgaaaagttgattgtaagtcgagtgctttggtttcttcttcttcttctttggatgttgatgcttcttcatctaagcctttttttcttgctgtttttaatgccacatccgatgatcaactcgaacaaatcgaggaggaggatttggctttggttgctaacagaattgctcgagctatgaataatgccaggaacaggaaatgaggtggtccaaatcgttgctttgaatgcggttcaattgatcatcttcgttcgcattgtcctaagcttggaagaggcaaaagagaagacaaagatggtgataagaccaacaacaacaagccgaagggttcataccaaaggaggaagatggagaatcttaggaaggcttttcaacaagtttgcgccgccttcgagccactaagtgatgtagatggtgaaagtagagatgatgataagggaaagaacatctctgatgtttgcttcatggcgtgtggtgaatctgacacagagtatgaagataatgaggctttggtggcaaggaaggagaacgtgtggatcgtggattccggttgttcgcggcacatgaccggtgataaaaattggttctcctccctcaagaaggcatctaagactgaatctattatcttcggtgatgcttctacaagtgtcgttctcgctacaggtttggttaagataaataaaaattttgaattgaagaatgtagctttggttgaggacttaaagtacaatttgctttcggtttcacaaattgttgatgaaaattttgaggttcactttaagaaaactggaagtaaagtttttgattcttgtggtgattctgtgttgaatatttctcgctatgaaagaatgtttaaagctgattttaaaaatcctgtttcacctgtgataacatgtttggttgctaagtttgataaagatgtgatgttttggcatcgtagacttggacatgttggttttgattatttcactaggttaagtggtttggatcttgttcgtggttg

SEQ ID NO: 3046 - DNA, 672 bp, Oryza sativa
aaaattctactccaacagcctctctactagaatggctaagccaaataactggccaaactcctcctctcaatggccaaatttggccagcccaaattgccttgctatttgtgggccccacgttgaagatgcttctctctcacctcctactacttgcaatcggcgcagctagctaccgccggcgacggcttcatggtgctggcttctcccctctcgccgtcgtcatcgccgtagtcttcgtcgtccctcgccgtcgagcggcgacggatgggcacagagcccgagcagcggccgcggatggcggcgatggatggggacggagcctgagctcccggcgacggatggcggcgacggatgggagcggagcccgagcggtggcggcggatggggacggaacccgagcggcggcggcggtggatgaagacggagcccgatggtggcgacggatgggagcggagcccgagcggcggcggtggatggcggcggcggcggcgatggagggggcggagcccgagcgcccggcggcggatgtcagcgacggatgggagcaaaacccgagcggcggcggcggatggcggcaccgcggcagtggatggggatggagcccgagtagcggcggcggcggtggcggtagatggtggcggcggcggcggcggtaggtggcggcgcggcggt

SEQ ID NO: 3047 - DNA, 18055 bp, Oryza sativa
  unsure (1)..(18055): unsure at all n locations
nnnnnnnnnnnnnnnnnnnnnnnnnnnnnnnnnnnnnnnnnnnnnnnnnnnnnnnnnnnnnnnnnnnnnnnnnngactacccaacaaatacccatctcgccggtgcgaagctaggccggaacaaggtcactggcttaaaccgccgtcttgtttccaggaaaaactctgtagacccagcttctggcatgtacagttacgagttaactgacaacaatggttctaccaggttcatccttgcagctctcaactcctctataccatattggtctagtggagaatggaacggacattactttggttccataccagagatgacaggtcaacgcttaattgattttacttttgtcaacaatgatgaagaagtgtacttcacatataccttactagataacgcaacgatcatgcgttttatgctggacatctctggtcagaccaagatatttttgtgggtggagcatgtgcaagattgggtaccaacctacaccaacccaaagcagtgtgatgtgtatggcatttgtggagctttcacagtctgcgaagagagcaagcttcctatctgcaagtgtatgaagggcttctctgtacgatcacccaatgactgggagctagatgatcgaacaggcggctgtgtgagaaatactccattagactgtggtataaacagaaacaccagtatgcaagacaggttccaccctatgccgtgtgttggattacccagtaatggccaaatcatagaagatgttacaagtgcaggtggatgtgcacaaatttgcctgagcaactgcacttgcacagcatattactatggtaatactggatgctctgtttggaatgatgaattgattaatgtgaaacagctacaatgtggtgatattgctaatactgatggagcaattctttaccttcgccttgctgccaaagaggtgcaaagtataaaaagcagtggacgatcaatattcattggcgttgccatcactgcaagtgttgcttcctttgctttggcactcttcttgatagcgaagatcccaaggaacaagagttggctgcttggtcacagaagaaagaattttcatagtggtagtggagttattgcatttagatatgctgatctgcaacatgcaacaaaaaacttttcagataagctaggggcaggtggttttggctcagtattcaaagggcttcttaatgagtctactgtcatagcagtaaaaaggcttgatggtgctcgtcaaggagagaagcaattcagagctgaagtaggatcaattggaatcatccaacacatcaatttagttaaactaattggtttctgttgtgagggtgatagaagattgcttgtctatgaacacatgccaaacctctctcttgatacccatttatttcacaatgacgctacagtcttgaaatggagcataaggtatcaaattgctcttggagttgctagaggactagcttaccttcatgatagttgccaggattgcattatacactgtgacattaaaccagagaacatacttcttgatgcatcatttgttccaaaaatcgcagattttgggatggcaaagtttctgggaagggagtttactcaagttctcactacaatgcgaggaactatagggtatcttgcacctgagtggattagtggtacagttattacatcaaaggttgatgtctacagctatggaatggttttgctggaaatcatctcaggaacgaggaactcaagcaaagaatttgcaactcgtgatgactatgaatatttccctctgttagtggcacataagctgctggatggtaatgctgggagtttggtggaccaaaatttacatggcgatgttgatttggagcaggtagaaagagctttcagggttgcatgctggtgtattcaagataatgagcttgatcgacctacaatgagtgaagttgttcaatatctcgaaggtcttcttgaagttggcatacccccagtgccacgactacttcaagctattgcaggcaacccatattcaaagtgagcactaagcagaatttttcttatacaaacatcttaaattgagaacttatcataatcccagaaatatatgtgcggctgagaggcatgataagagcatgatatttttccatgacatcattttgtataatatcataaaagaatatgacacatcaacattccatgccagcactcctaactgcatcttttttttttgttatatgtgcaggtagttgatgggtacctgaaccaagcttcagaagaggcaggccaactgtaagatacaatagagcaccgtgcacctcattcttgacacgaaagtagctctgatgtaatcctggggcttcccttcagtagttgcctggagtctaatctgtcaaaataaaagcagtgatgatttgataatccaagtctcctgcagaaaccaaagtcctctgctaatctgtggcacagctttgagcacctgataagtaaatttctcgccggtacaaagattatttagaacaagcttgccggtataaactgctgtctaattgtgttgttcccagtaagaatttgtcaaccttgtacctggaatatatcatgagtaaggtcatcctcaaacaactgaaatctccccagccacacttggttttttactgaaccaagacacactgcttgaacaagaagggatcgatcaatagctcaatttgatgttagccatgttatgtcaatagcaccaaactgtacatttagcaacaatggaagaggatagcactttaaatataccttatgagacgagataacagctgtgcatcatttacaggattcttcttgtgaaatggagattaagacctcacgagactgcataataatgtattatatgccaaccccaaaaatatttgtgagatgtcttctggtcctccaacaaacagcagcggcaatcagaatcagtcttcggtatttggaacatatcaccccccaaaataatctaatttcgtcgtaactctgatcagccaaaaaatacttgcatcaacgttatgtaactgtagacttgaaaattgaaatgtacaaactgctaagtgagagatgaactctaaatccccattaacctttgtctcctcaagcgcgcgccaatttctaccggaaccctagtccattccaagcgaaacgaggatcaaacaattcgtctcgctttggcgacgctcgcgggggcacctgcgaaaggatccccaaatcgtagaggaacagataccagtgtatgtaggggcgacgaagaaaacccataccttgccacggagaggctccgtcccatttctcggcgtctccgccggcggcgccggtggcggcgaccggcgaggtcggcggcggcggctggccgccgacaaggaggcgaagagagagaggagagtcagagagattctaggccaccagcacaggccggcccatcacccccatgcgagcgagcttttctgcgcgaattcgcccacaaaaaaagtccacattacgtcccttagctatgggtccgagtttcatccgcgtccctcaaccgcgaaaccgggatacacattgtcccccaagctataaaaaccagtgtaaatcaacacgagcccctcaatgatttgggtgtcgattccatcttagggcacccacaatggttatctataagctctctacaagagatccatgtcagcatattttcctacttggaagagattaaatgaagagagagagcaaagctatctactaacatgaagatagtctatagagaaaaacgaggcaatggattagagagctatagatacccatgtagacataccattgaagtggtttactattaatctagtctattgttgaggtgtacatattttatagatagcaccttaccattgcgggtgctcttatgtgatacattgacatagttttcatccgatgtggcgtgtacttataatcttcatcctatccctatcagttcatccataacctctaaatgaattaactttaatcctcttgttttttcgcctagtccccctctctctcagctcaaataatcacatgacgagaggacgacgagaagaagaaacagagaagaatgccttttttttccttactagcaaaagtgcccgtgcgttgcaacgggtgaaaaaattctaatgataatatacgtttttcatgaataatcatgtcaatgacaatgtttgtattttaatgagcggcttgtttttttataaatggtgttttttttcttgcgcgattttctcaaaccattcagaaatggcacatttctttctaaaagtttttttatcatttttcttttgcttttttacttacaatgaaaaccatatttttctctcttttgtgccttttttttctagtgtgttcttttgtctttttttacaattattttctcacgcattttttttcttgttttttcttcaaatgttctttttttgcttttttccaatacaggacttacgggaaatagaacttttgttgttgttgtttttctttttatgcacctttctgcttttgttctctctctttttattatttttaccaaaaacgaccacaagtatcttgttgtaagattatagggactcaaatgtaaatataaaaattacagggactcaaatacaaaagtacaaacccaaaaaataaaataatataaaaatggaatgctctcgacatgtaggtttcgtttttgtaaacagatcttcaatccggcacattattttatttcaccaagatttgagagataacacggtacagattgaaactgagaggaggggtggcgggtatctcggactcaaaaggactggcgccttttatttttcgggggaatcggatctatagtcggatttttttcgtttttgagagagaaccggataggagtcggacttttttattattattttttcgctatttttttcaagatttttttcgtccttttttttggcacgtacggaatcggattattttttcgctttttttttatcggacggttacggtttttttatcgctcgtctagttttttcgccggtttcttttcgcccttttttgcagggaatcggaatttttttgccctttttttatcggacaattacggttttttcgcctggtttttttctcgctcgcccttttttttttgccggttttttgacggacgatggaagcatctcttattttttaagtagtagagataaatccaatacaaataattatgaaaaattctaaaaaaaacaatgtagggtatattgacatgtattgttctgccagaaatcgaattcaattttgacctacacattaaggaactaaaataagaaaaattcaaatgtgaacaacgcgttactattctatgctgaatttatcttttatatcctacctccatcccaaaataagtgcagccatgaatatccgtgccgaacgtttgaccgtccgtcttatttgaaaaatttgaaaatatttagtcacacataaagtactattcatgttttatcatctaatagaaataaaaatactaatcataaaaaatttttaaataagacgaacggtcaaacgttgaacgtaaatagtgtaaaactgcacttattttgggacggagggagtatatcttacgtgtgagttgagtttgtacccaagattttatatagtggtgtgtgtacaaatcttctgaatcaagtaccgactgtttgttctgaatcatttttggatgagtctgtttgttccttactcctgaaaagttaggattaaattttagattaaagtggcatgcttttcaaactactaaacggtgcattttatgcgaaaactttctatatgaaagttgttctaaaatatcagattaatccattttcaagtttgtaataattaaaactcaattaatcacacgttattaccacctcgtgttacgtgaaacacttcatcttcatcttcatcttcagtagattcaaacaccaccatcactctatgcttatatagtgtccttctgaactattcttctctttaccttagaaatataaataaggtagattagttgtatgaattgatcaataaatttgagctaatttattcgtaatcccccttttcaattcggttttcgtgtggggcaagttttgacaagcttttctctaacttcattcttcttctagaatttgatctaaccgttagattttagggtgtgtttacttcacaccaaaattggaagtttaattgaaattggaatgatgcgacggaaaagttgaaagtttgtgtgtgtaggaaagttttgatgtgatgaaaaagttgaaaatttgaagaaaaagttaggagctaaaccagaccttagtgtggaatttttgttagctctatagtgaagtctggtttctacaagcaaagtttgtcatagttctatcggttactttcaattaatctaggtttcagtaaacatatgttttcgttcagattaaagtttgttagatcccctcaattttatccattgcttttatgtctcttgacaaaaaaaaaataaaccaggcttattcttcaagatttctattatatggatttgaattgccgacgttcagtccgaggaagctttgctgtttttctccgttggcttcccacgtactgtagctgcgctactgtagtactgttttgaggctttttgcatattagggtgactaatttagtgttttagtgatattagaataactttattactacctccgtccaaaataagtgcagtcatgagaatccgtgtccacgtttgaccgttcgtcttatttgaaaattttataaaaaaaatttttaaaaaagaaatagtcgcacataaagtgctattcaagttttatgatctaataacaacaaaaatactaatcataaaaaaatttcaaataagacgaacatttaaacgctagatatgaacggatagagtattattttcactgcggttttgcattttttctaagaaaagaaacaggtgatcattcacttcttgtcatcgacaccaccccgatataaaatctaatgcctagaaaaaagtattacgaattgcttctttcttaaaatcgaatttaaaattaagtttcaaaatttaaattcacggataaaccaactagcaaactactccctttattctaaaataagtcaacctcgtaataggatataacacaattcatatcctaacacaagattgatttattttgttacgaagagagcatgaagcgataccgagagaaggtgaccgagcacaatctctagaaaaggcaccggaaaagttgagaagtggactggataatcattttagcattgaacattgtttttagttgcagcacgcgtagccgtacagacgaccagaagcaacgcaacaaacagagtcaatgataagcgtcatcacctgtttgctggggttgggatcacctgcataatggcagccatccgtttttttttaatgaacggatcagatcgttagctacaatatcgatgtatttagtactcatcgattctttccgtagtgatctacagtaaccagatgcatccttcaactccaactctaactccactcctcctggagctggagctcagccaaacagtttcagctccaccaaaactgggagtggagttggatggagctctctcacaaaatgtactagagttgtggagctggatttaggcagctccacaacgccactcaagactcaactcctgaagttatatttaagaattggagctgtaccaaacagatccttaacactcaatttcagatttaacagctagaagtggactatacaagttgtagtcatattattaactgcactggatccaaatcctgcctgcggaagtgctgtactgctgtccattttcactctatttaatctactaccaattagaacatttgtgcaaggaactggtgaagatggaaatactctaggcatggctgatacattaaattttcatatttcaaatcaaaatgatttaaaatcaacgtacatgtggaaggaaagaaaaataacttgtgacatgttcgaaagagctagctgctgcaacattgctgctacgcttacatcaactagccagcagcaactacagcagcctaagagcacctccaacagtctctccaaatgtctatttggctaactctccatctaatttagcaagtcaaactcgttgtttactccaacagcctccccattcaccctctctattctaagtctattacagtgggacccacgcgtcagtctctcaacatttccttcttttcatctttctccccctttccccaagcctcctctgctggtctgcccccatccgctgccgccatctaccgccgccgccgccacctaccgccgccgccgccgccaccatctaccgccaccgccgccgccgctactcgggctccatccccatccactgccgcggtgccgccatccgccgccgccgctcgggttttgctcccatccgtcgctgacatccgccgccgggcgctcgggctccgccccctccatcgccgccgccgccgccatccaccgccgccgctcgggctccgctcccatccgtcgccaccatcgggctccgtcttcatccaccgccgccgccgctcgggttccgtccccatccgccgaccggcgccaccatccgtcgccgggagctcaggctccgtccccatccatcgccgccatccgcggccgctgctcgggctctgtgcccatccgtcgccgctcgacggcgagggacgacgaagactacggcgatgacgacggcgagaggggagaagccagcaccatgaagccgtcgccggcggtagctagctgcgccgattgcaagtagtaggaggtgagagagaagcatcttcaacgtggggcccacaaatagcaaggcaatttgggctggccaaatttggccattgagaggaggagtttggccagttatttggcttagccattctagtagagaggctgttggagtagaatttttttgctaaaatagctaaattttaacttggagagactattggagagtttgttggagatgctgtaacagagtaacagttgggatgcagtacagacctgcagcccaacaaactgtagaacagaccaccgaagaacagtgaacagaccaccaaacgttccactgatttcaagtaaaaaaaaggtactttatcctttcaaattactagttttatcttaaattaaaatatttatacatttttttattaatttttagaaatttgtataattcaataacatgtgaataattactagaaagcatttctcatgataaatccaaaaacataaatcttataataaatctcataatgttaaaatatatgaacgtctagaaattggtgataaaaatacaaatgtttgactaaagagaaagctagggtggcaagtaattttaaacggagggggtaaagtttaaatgtagttgcataaatgtcacaccctgaagtttccccccttttcttgctttaaaaattggttaaataaattgcccgaagaaattatcttaattaacctagagctaaatccctagttaataaattcaattaataatcggaaatagcgtggtggaatttttcttgagttccccatgctccaatgcattaacaagatttttagtggaattttcagagccttggaaataattttaaccaattaaaaatcaccaaagtgcaattttaaatcccaggaaaaatcctttcttcttttctttttcttttccttctttttctctattgggccgtcggcccactccctcccgcgctcggcctccttcctttgggctggcccgttcccctttcccctctctccgggacgctgacaggtggggcccacctgtcaggtcgtccccttcctccaaccgcccgccccacgacggcaaccgccgccaaaaccgtgcgcgtcgccgccggttgccatggccggccggccggttttgaagccgagccgagccgtgcctagccgccgccatgccgtccgatcggcctcctggccaatccggaccggcggtggaccacccgcgtggtcccggtccacggtagaccggccaccttgagccactgcccgtggggcccacatgccggcgcccccttcctctcccctttgagccgctgacccgtgggccccgcctgtcggcgccgccccccctggatgacgtcagccctgggtattattgcgcaataattaattaaggactttttctttattagtaaaaacacagtttatcttctaaaattcataagtaattcatccgagctccatttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcaatccgcggtttctcgaagacgttgctgaggtctcatcagttcgagagcaaggcaagtcatgcaatacgtttgatcatattgtacccaatttaccaatatcccgcatttctattaaatgttgcattcttttacaatgtaatgtgggatgggtcctattcctcagccacatattggttaccttatgccattgataacttgggtatgaaaatgactagatgttggcttaggaaatgcttagccatgcttagttcaactaggacacaaatggggatcacattattacatagactctcactattggcatagctttagattggtgccaccgcaagggtgtcagttaattaaaatattctgaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgagatgttcggttgtccagctgccggattcaccgtggcgcaagaggggaccgcccactgccttttgagggggtaggggtgaaaccttagcgtgatgtggatggttaggggagggttatgtggagggtcttgtcacgatttccccctttgcagtatcatggtgatacttcggggcatggcgacatgtgtggaatcatgtcttgtgggtacagttgtacacctctggccagagtaaaactattcgaatagtcgtgcccgcggttatgggcgatcaaccagattcaccgtgattagtctcacccctagtttagcttaataaactggtgtagttcaggtggttggttgggcctgttgcaacgtggtgtagcgttagacagtgattggttaatattgattaattactacagctgttttactgctttcaattactgttttgaaatgcctgctttatgcaaaagaacccctagcttcctttggttatatcctacatcatacctcctcttccgatatgacttgctgagtacagtgggtagtactcagtcttgctctcttttcccccacaccagagttgaagttcttctcagttggagccgtctcagagaggttggtttcgtcgctgtcgtcaaggtttgcctgtggagtggagtcgcccgctgctgaagtcaagcttcccggtttagctcgcttttatctttcccgctgcatttgtaatcttttatatttttgtaagacgtgggtctgtatgtcaataattgtcgtttgtgtaccctggctggtcctggacagggatttaatgcacattcagcttagaaattctggttcgagaatttctgggtgtgacaagttggtatcagagccgaccttgaccgtaggacaagccaactggaaacctaagagccctctgaaccctttttttttcatatgcatatgcccttttgcacttggattttgtttcgggaaaattttggggtttgttcttttgatttgtgggaaaaatcttggtcgcttatttaattggatttctcgactagggacagtctagggatttagtaaaagtttattcggaatttattcggtagtcggtcgggaattgtcgggtgatatgcattaggtcgtgtctatgttcggtggggtaagtttatgcgtatcagtatgactatgcatctatttcatgcattaagttattgtttagtcagttgcattagtgtcttttgtctcggttcgtgaaaaatgttgttctatgcgtaaaaatcatcatgctcggttatttatttgagtcttcttttgctttgtttaatttggatttgagcattaattagttcctatcccttgtctactttagatgtcagtcctatccctcgtttgcgagcgccgccccgagcttcagagtcgccgcccttagctttatcgccttcttagtctgtttgcttgctagttttcgtgtttaggtttgttgcttgtgggttagtcggcggtcattatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctattcccttcagatggagacaaggaatggttcacgcgactccaacaacgccagtggcagcgaagagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaagtgttgcagcaggtgcagcagcaagcacagcagcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaagagaaggttgcttttgctacacaccagttgcaaggtcccgcttctgtttggtgggacaactacatggtgactcgtccagctggggcagaggttacttggatagagttttgtcatagtttcaataaagcacaggttcccgagggaattgtggcacaaaagaagagagagttccgttccctgcaacaaggaactagaacagttatagagtatttgcatgagttcaaccgcctcgcgcgctacgcccctgaggacgtgcgtaccgatgacgggaggcaggagaagtttctgtctggtcttgatgatgaattgactaaccagttgatctctaaagattatgaggactttgagaagctggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccggcagcaccgtccctaccacccgggtagcttcaacgagaaccaccatagtggcagtcacaacaacagtgagcagcatagcctcaaccctactccgagttcactaaagattccagctcaatcagttcagctagctctgccagaacagcccaagaggttgggagaaaaacccgaactctgcttcaattgtaacaaacccggacacacggttggaaagtgcccaaagccaagatgtgctggacccaagttcgttcaggcctgtgtcaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccaaccaacctcattcttctcgaatccaaggacctggatgtcatacttggaatggattggttgacaaggcacagaggagtgattgattgcgccagccgcaccatcaagttaaccaatgcaaaaggagaggtggtaaccttccagtctccagtgccgcagaagccagggatcagtttaaaccaggctgctggtgaagaacaagaggtagcagtggagaaaaccactaagaagctggaggatattcccatagtcagagagtatccagaggtttttccggacgatctgacaacaatgccaccaaaaagggataccgagttccggattgacttggtacctggaactgcaccgatccacaagaggccttacagaatgggagccaacgagttggcggaagtcaagaagcaagtcgatgaacagttacagaagggatacattcgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacaacattcatcactcggtacgggttgttcgaatgcacagttatgtctttcggactcactaatgcacctgtcttcttcatgaatttgatgaacaaggtgtttatggaatttctagacaagtttgtcgtggtttttatcgatgacatacttatctactccaagtccgaggaagaacatgagcagcatctctggctggtacttgaaaagttaaaagagcaccagctatatgccaagttcagcaagtgcgacttctggcttaaggaagttcagtttctcggtcacatcgtgaatgctcaaggagtagctgtggatccagcaaatatggagtcagttaccaaatggaccccaccaaggacagtcactcaggttcggagtttcttaggacttgcgggctattaccgccggttcattgagaacttctctaaaattgctaagccaatgacagctattgaagaaggaagaaaagtttatctggtctgctgaatgcaataggagttttgaagaactcaaacgacggttggtgtctgcaccagtcttaattctgcctgatcagacgaaagatttccaggtctattgtgatgcatctcgccaggggctaggatgtgtgttgatgcaggatggcaaagtggtctcttatgcttcacggcagttgcgtcctcatgaaggcaactacccgacgcatgatctggaattggccgcagttgttcatgctttaaagatttggcggcactatctcatcggtaaccgttgtgaggtatatacatatcacaaaagtctaaagtacatcttcactcaacctgatttgaatctcagacagcgaagatggttggagctgatcaaggattatgatatgagaatacattatcatcccggcaaggctaacgtggttgcagatgccttgagcaggaagagctactgcaatgttgcatgggtagagcaactatgttgtgaggttcaacgcgatttggaacatctgaaccttggtatagttgagcacggattcgtggttgccctagaggcacagcccacactggtggagcaggttcgcatagctcaagcaagtaatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcagtattccattcatcccggtagtactaagatgtaccaagacctcaaagagaagttctggtgggtcagcatgagaagggaaatagctgaattcgtagcactctgtgacgtctgtcaacgagtaaaggcagaacaccaaaggccagcaggtttgctacagccacttcagattctagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagtagaactctatctggcaagaattatgtgtttacatggtgtacctaagaagatcgtgtctgatcgaggaagccaattcacttcaaagttctggtagaaattacaagaagaattgggaacccggttgaatttcagcactgcttaccatccacaaacagatggccagaccgagcgagttaatcaaatactagaggatatgttgagagcctgtgcgcttgactttggtggagcatgggacaaaagcttgccgtatgctgagttctcttacaacaacagttaccaagctagtctgcagatggcaccgtttgaagcactgtatggacgaaggtgtcgtactccgctcttctgggatcagacaggggaacgccagttgtttggtacagaagttttaaatgaggcagaagagaaagtcagagctatcagggaaagattgagaatcgcgcaatctcggcagaaaagctatgcagacaaccgccgaagggagctcgctttcgaaacaggggattatgtgtatctccgtgtcactccgctcaggagagtacatcgcttccaaaccaaaggaaagttggcaccacgctttgtgggaccatacaggatcttggaacgtagaggtgaagttgcttaccagcttgagcttccctccaacatgcttggcatccacaacgtgttccatgtctctcagttaaagaaatgtttgagagttcctgaggaacaggcaagtccggatcacatcgaaattcaggaagatctgacgtatgtagagaagccgactcgtatcctcgaaaccagcgagagaaagaccagaaacaaagtaatcagattctgcaaggttcagtggagtcatcactcagaagaagaggccacttgggaaagagaagatgagttaaaggccacccacccgcacctcttcgccagctcttccgaatctcgaggtcgagattccgtttaaggggggtaggtttgtcacaccctgaagtttccccccttttcttgctttaaaaattggttaaataaattgcccaaagaaattatcttaattaacctagagctaaatccctagttaataaatgcaattaataatcggaaatagcgtggtggaatttttcttgagttccccatgctccaatgcattaacaagattttaagtggaattttcagaccttggaaataattttaaccaattaaaaatcaccaaagtgcaattttaaatcccaggaaaaatcctttcttatttttctttttcttttccttctttttctctattgggccgtcggcccactccctcccgcgctcggcctccttcctttgggccagcccattcccctttcccctctctccgggacgcacctgttaggtcgtccccttcctccagccgcccgccccacgacggcaaccgccgccgaaaccgtgcgcgtcgccgccggttgccatggccggccggccggttttgaagccgagccgagccgtgcctagccgccgccgtgccgtccgatcggcctcccggccgatccggaccggcggtggaccacccgcgtggtcccggtccacggtagaccggccacctttagccactgcccgtggggcccacatgccggcgcccccttcctctcccctttgagccgctgacacgtgggccccgcctgtcggcgccgccccccccccttggatgatgtcagccctgggtattattgcgcaataattaattaaggactttttctttattagtaaaaacacagtttatcttctaaaattcataagtaattcatccgagctccatttaagtccattcaagtctcagtaaatcaagaaaaatgcaaagaatccattaaaaatggttttgtttcctgtttcagtagtcttatagcatgttttgcttgtgtgctttgtttgtcgcgtaggt

SEQ ID NO: 3048 - DNA, 3178 bp, Oryza sativa
tactgctttcaactactgttttgaaatgtctgctttatgcaaaagaacccctagcttcctttggttatatcctacatcatacctcctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcgcccgctgctgaagtcaagcttcccggtttaactcacttttatctttcccgttgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacaataaatctcgcgattctgctactactaaaactacatattttgatattcgagcattaaggaaaacaaattttagtggagagcagatgcaaacaggctcctgtacagccccgccctagttaattgccccatgtacaaccacgggatcggacgtctttatcgtcacaattctaggcacatcacaaataggacggagccgagtcactcatcggctcccaagctcagatcaagtcggcatctctacttcgcagccgctgtcaacactctcttgccgtcgcacggacagcggatgaaagaggcggcagaggcagcggctgcagagtagagatgccgatgcaatctgatcacaatgcaatctgagctcatgtgatgagaggcttcaaagccgatgagcgacttggctcctccatttaatctatttccgttgcatgcgccgggctgcatgcgagctagtttgcattcaatatccaccatttttttttcctaaatcctatgcttgttgaaatcccacctatacttgcattcattttcgttgatggatatttgtctcctaaagggatgtcctcttctcttttacatggcattgcatgtcattaaaaaattataaaaatatttgacagtgtagatcaatacatgatatcttactccaaaacctatgcaagtataaaagaaaataacaaaataaactctaactagtacatgtactactgacaattatacacagtttgtataagtcgaacttaaacttgcatgtttgtgaacttatatatcacacattgatctatgttatcatttttttcatattttttcacaattatttgaatagcatgcaagccatgagggtacatcccttgaaggataaaaagtctttcccttttttgttgaatcttgtgctaactccctcacttcttgcctctcctccaatcctccacacattcttcttgacttcttttttgatggtcatggcccatgcactactgcattattgtgcaacttgtgtgaaacggttccctgatgtcggccaatatgtcatttgaagaacttgattgatcaggctcctggtatatactccttggagttaggactcaatggggatggtcatttgctatggaactcaaccgtggcgtattggtccagcggagactggaaaggccattattttggccaattgccggagatgacaggctctttcatgccaaatttcacatttttccacaatgaccaagaggcttacttcatatacaccttgtctgatgagacgacgatgatgcacgctggaatagatgtatatggaagaggtttggtgggcatatggttggaggaattgcaggactggtttatctattacaggcagcctgtagtgaattgtgatgtgtatgcaatttgtggacctttcacaatctgcaatgacaataaggatccgttctgcgactgtatgaaaggctactccataagatcaccgaaggactgggagcttgatgatcgaacaggagggtgcatgaggaatactcctttaagttgtggggctggtaaggacaggacaggtctcacagataagttctaccctgtgcaaagcattaggttgcctcacaatgcagaaaatttgcaggctcctaccagtcgagaagaatgctcacaggtttgtttgagcaactgctcttgcactgcatattcctatgggaatggtggctgctccatttggcatgatgagttgtacaatgtaaagcaattatctgatgcttctccaaatggggatgagggggttctttacattcgacttgctgcaaaagagttgcaaaattcacaaaggaagatgagtggaaaaataattggtgttgccattggtgcgagcattggcgttttgtttttgatgatccttctactgatagtttggaagagtaaagggaaatggtttgcttgcacacaggaaaagcctgaggatggtattgggatcactgcatttcgatatactgatctgcaacgcgcaactaaaaacttttcaaataagttggggggaggcagttttggttctgtgttcatggggtacctaaacgactctaccatcgcagagaaaatgcttgatggagcccgtcaaggagagaagcaattcagggctgaagtaaattcaattggaatcattcaacatattaacttagttaaactgattgggttttgttgtgaaggtgataataggttacttgtgtatgaatacatgccaaactgctcccttgatgtgtgtttattcgaggctaatgatatagttttggattggactactaggtaccaaattgccattggagttgccagaggccttgcctatttgcatgatagttgtcgggattgcatcatacattgtgatatcaagccagagaatatacttcttgatgtgtcttacatgcctaaaattgcagattttggaatggcgaagatgttggggagagaatttagtcgtgctatgactacaatgagaggaacaattggatacatagctcctgaatggattagtggaacagttgttacatccaaagtagatgtttatagctacgggatggttttgtttgaaatcatatcaggaaggaggaaccgaagtcatgaacatttcatggatggtgattattccttctactttcccatgcaagttgcacgcaagcttctcaaaggagagattggatgtcttgtggatgccaatttggaaggtgatgttaacctcatggaggttgaaagagcttgcaaaattgcatgttggtgcatt

SEQ ID NO: 3049 - DNA, 27842 bp, Oryza sativa
  unsure (1)..(27842): unsure at all n locations
ttcccaatctcctcaatccccttctcctcaaacacaccctaaatgctatcacaggaggatcacactcgatgacaacacaatattttgattcactataaatctgtatactgattcccaatttcaagttatgtatcagaacattatatatcatcttgccctttaagaaaagtaggcataagatgtaagatctctaagagatcatgtcttgtatttgaatgaactaagtgtcgtaacatgtaattaagatctctatacccgagaaggaaccagccttactaacaaaatatacttggtttctgttgtctctgtgatatgtaagatctgtaggtatcagtgtgcccccatacaattgtcatatgatgtttttgaaaaacacaggcgcgactgaattgtcagttcagagtggattgttgagcctaacattggcgaatgtgtgacatcctgacagttatgttcaaattatgcacacatcggctatatatcacctatatatacgaggcataattgttcactcaaacaaaagggagaagcctggctgctagcctgaaacttgttttttcaagggtaggcacattaatttggcaactacaacccaagaacctttttgttgagaatatgcaaaagatgtgcacatcattgtattaagatacaagagtttcattacaaaccttgctagatagtggtatagatatgtgtgtgtacatggtatttagctgatatttatgtaaattcgtggaaattggaagccataagaaataagactgttttcacacccagccaatacagtacttgtagcttgcaatagtgccaaagatttgttcaagattctttcagatcagtactaacaatatatgatagcttgtgcaagttgaatcttttgtcttggccaataggacctttgcaccactatccccacggcaggatattttttccattttctagtcaagtcaagccactgtcattcgtcacctaaaatttctatacacgccgtggatgtttcaaaaagatcttacatcaccgtacagaccctttcgactatataccattttgctctccatcattatatacaagttgctagtttttcttttgtcctcatttccctactataaatgaaagcagaactgagaaatgatcaccaatcctacagtttgtaactatagctctcctcatttttatattactattattcttcctacgtatacgcatcacagaaagttctaccatgacagacaccatctcagttgggaaagcatttgacgaaaccgacaagctcgtctcaaaaattggcaggtgtgcacttggcttctaagagactggtagaaaagcatctaaaaaaatagcaagtggtacttaggaatatggttcaatcaggttcccaagctaagtcctgcataggttgcagacagggataagccaattgatgatcccacagcagtggagctaacaatctccaggatggtaatcttgctgtcttaaaccagtcagcaaagaccatcatttggtctacccaagctaaaatcactaccaataacaccattgctacgcacttgagtagtggaaataaatctcatcctaacaaacccttcaaactctttagaagtttctcggtggagctttgactatcccacagatacatatttccctagggcaaagtttggatggaacaaggtcaccggcctaaaccatcatattatttcttggaaaaactcaagagacccagctatcggtgtgtattgcaatgagttagaccctactggtgttgatcagactagcctttcgccattgaaactccgattcctctgttcttcagtttcgtcaggttactgtagcaatctgaaattctcgcttcagaaatcagaacgtgcgagtgatacacagagctgagtggggaggattgagagataggttagctaatcacaacacggggcacggtataaacttcggccaacgacaaccgcggttaatgccgtccgaagtggaaccataatcctgatctcgtgatctctactctctagagcgctaattaatttctaccggaagttgaaccctagccatcccaaacatgctatatccgtctctcgattcgctcgatcggcgacagcgacactcgcaggggcactgagaagaggggtgacgagacccataccttagccgcggagaggctccgctcccgttactctccatctccgtcgggggccgccggtgccggcgagggtcgcggcggcgagacggcgacggctggccgccacacaacccaaggagacgacgaagataatgcgagagagatatggaccttccgtcccgtggtgccgcgtggtgaggcccaagagcggggaccaatcggaaacccagccacggcccgtttcgatgagcggtgcagcccaataaaaaggaagaagttcacttgacatcctttatctaagcgagtcgagtttcaatcgtatcggtcaaccgcaaaaccggttataatgcatatctcatcttctaaagccagcacgaatataatccaaagacagtattaaggttgtgttcggcatatgatgattgatgaagatttctctcgttcgccgcgtgtacgcttccgaactaccaaaaaatttgctttaaaaatcatattaatctatttttaaatttaatatagttctcgatcttctcttttcctctcttatcaacacagcctaagttgttttagatgacaagatactgacatggcactgaaagataaaggaccagaagtgaacttattcccaataaaaatacacgtaaagaaggcccatcaaccacgctcaacgcccattcagtgcgccgatttgtgctcagctcaacgacaaaatgctctctctcactaaacatggagatctcaaggagatttggaggccagtgccaaacttattgggtacccatgattacgcgacgacgtgacatgataatgtattaatgttgttaaggcaatagttaatttgctaatcattgtttgccaccatagtttttttttttttgatctcctgccaccatagttttggtggttgactgtggccgtttttttaacacgcttctgtgtgctgcagtgcaagcccagccacagctttctgctccctttcacacccttcttttatttatttttttagacttaccctttttttattttgagcggcaaatctatcgcctattgatatactctccgtccctaaatatctgacgtcattgacttttttaaacatgtttgaccgttcatcttattcaaaaaaaattaagtaattattaattcttttgatatcatttgattcattattaaatatacatatagttttacatatttcacaaaagcttttaaataagatgaacggtcaaatatgttttaaaaagtcaacggcgtcaaatatttaggtacggatgaagtatgatttgctaatatacgtagattcacgtatactactagttcatagttcacacaatcactcgcccaatcggcaatgcaagaattcttgagaaggcgacatcactgttgaagtagagtactccctccatgaaaaaaacaagagacaaacttaaacatgaatgtgacattataatgaatctagataggtttattgtaccagaaaatattatatccgtgtctaggtttgtttttttacgaagtagataatcactttagcactgttgaacaatatttttacttgcagcatgcgtagccgtacagacgaccagcaaaaactcaattaccagagtcaatgataagcgacaccacgttgcagtgctgtccattttcacactgttccagagcatatgtaaaacgttctagcattggcatcacgccacacaaatctgccaattataacacttgcgtaaggaacttgatgaggctggaaatacttaaggcatggctaaacactctaaacacattgtcatgtgcactcatatttcaaatcagatgtttcaaagaaaatcaacatacatgtggaaggaaagaaaaaacaacttgatctcaagtaaaagaaaaaaatagtttataccaggtagttgcacaaactacagatttcggtgttccagcattagcacagttgcaacctcacactgagcgtcattcagtcaattcctacgcttgtctcgtttcaaaaaattctgacgcctatacttgcatttttgactgtttgcgttgactccctcacttcttcttgcctcctctccaaatcctccgcatccttcttggacttctgttttgttgttggccatggcccatgctctgcactgtgcaactccgtgtgtgaaagggttttctgatgtcggcgaagatgctaattgaagttgatattttacatcccttggtcatgaactcatgatcgagtggtccaaatttgtgatcaaaatcagacaaatttgcttttggataagaatataataattgatctcatcagtgcccactacaaagtctagcctaaattttctgtctcctagcttttccatttggacctgaaaccattaaaaacaaaattggagcaagtagagtacactgcattggtgttgggaaaatgggaaggaacttgcagtgtttcgcaagggtttgaaaaaagagttcacataaagaatacacctactcacctgcgtatggctggcagaggaataaacaaccaattttgatctcgaatagttgggcacagatcatttctgagtccaaacgctccagcgttgaggtttgaccaagatgacaaagattactattatactgatgataaccaatcatacttctcgaggtttgtttcaggttaaacacaatatcgttagtggttacgactgattgagatgtgtgctcagacagtcacaacaccacgttgacctgcgattctgcgagctgaactaaatccatggtctgaattcttaacagcaactcaacctgcttgcagcatcgtgctgtgtataagctagcttcaaaccattcctccttcagttttccttctccaccactcttcccccgtgttcatcttctgcttccccatgcttctcccttgtcatgtccttcttggcctcctgctcctctccctgcacactccggcgagctccgccgccgccacggataccgtgtcacccggccattcacttgccggcagtgacaggcttgtctccaataacagtaagttcgccctcggcttcttcaagccaggtaatgagtcctcctacaccaaccacaactcctaccttggcatatggttcaacaaggtctccaagctaaccccgttgtggaccgccaatggcgagaatccagtggtggaccccacttcaccggagctcgcaatctccggtgatggaaacctggccatcctggatcatgccaccaaatccatcatatggtctacccgtgccaacatcacaaccaatgacaccattgccgtgcttctgaacaatggcaaccttgtcctacgaagctcctcaaactcatccaacattttctggcagagcttcgactacccaacagatacacttttcgctggtgcaaagattggctgggacaaggtcaccggcatgaaccgccgtcttgtttccaggaaaagttcggttgatcaggctcctggtatattttccttggagttagggctcaatggggagggtcatctgctatggaactcaactgtggcgtattggtccagtggggactggaacggtcgatacttcggcctagcgccagagatgataggcgatgtcatgccaaatttcacatttgtccacaatgacaaagaggcctacttcacatacaccttgtatgatgacacggctatcgtgcacgctggactagatgtctttgggataggttttgtgggtatgtggttggaaggaaaccaagaatggttcaagaattacaggcagcctgtagttcactgtgatgtgtatgcagtttgtggacctttcacaatctgtgacgacaataaggatctgttctgtgactgtatgaagggcttctccgtaagatcaccgaaggattgggagcttgacgatcaaacaggaggttgcatcaggaatactccattaagttgtggaagtagcaaggacaggacaagcctcacagataagttctaccctatgcaaagtattaggttaccccacaatgcagaaaatgtgcaggctgcaaccagtggagatgaatgctcacaggtttgcttgagcaactgctcctgtactgcatattcctatgggaaagatggctgctccatttggcatgatgagttgtataacgtgaagcaactatctgatgcttcttcagacagaaatgggggagttctttacattcgccttgctgcaaaagagttgccaggttcagaaaagaagaagaatagaaatataagtggttttgccattggtgcaagcactgccactttgtttttgatgatccttctactgatactttggaggagaaaagggaaatggtttactcgcacattgcaaaagcctgagggtggcattggggtcgttgcatttcgatatattaatttgcaacgggcaactaaagccttttcagagaagttggggggaggaagttttggttctgtatttaaggggtacctaggcaactctaccatagccgtgaaaaggctcgatggagcctatcaaggagagaagcaattcagggctgaagtgaattcaattggaatcatccagcatattaacttagttaaactgattgggttttgttgtgaaggtgataacaggttacttgtgtatgaatacatgccaaaccgctcccttgatgtgtgcttgttcgaggctaatgatatagttttggattggactactaggtaccaagtagctactggagttgcaagaggtcttgcttacttgcataatagttgtcgggattgcatcatacattgtgatatcaagccagagaatatacttctcgatgcatcttatgtgcctaaaattgcagattttggaatggcaaagattttggggagggaatttagccgtgcaatgacaacaatgagaggaactattggatatatggctcctgaatggattagtggaacagttgttacatcaaaagtagatgtttacagctatggaatggttttgtttgagatcatatcaggaaggaggaactcaagtcatgaatgtttcagggatggtgattattcattcttttttcccatgcaagttgcacgcaaacttctcaatggagacatcggaagtcttgtggatgccagtttgaaaggtgacatgaacctagtggaggttgaaagagcttgcaaaattgcatgttggtgcattcaagacaacgaatttgatcgaccaacaatggctgaggtggtacaggcccttgagggtctacttgaactcgacatgcctccattgccaagactactaagtgctatcacaggagactcacattcagtgacaccacaatattttgattcagtgtaaatctatatgctgattcacaattaaaagtagtctaccaggacattataattcatcttgcctttttagaaaattagggataacatctaaggtctttaagagatcatgttaaataaactcgtagttattaagatctctgtgcccaagcaggagatcgtgccagccttccagacaaaatatattttgtgtctatgtaagatctgtaggtattagtgtaccgtatacatttttcatgttgccaattgagatgtttccggacacgcaggcgcaattgccttgtcagttgagagagtatattgttgagcctaacattggcaaatgtgtgacaacctgacaactatgctgctcatattatgcaaagttgcaaacatggcctatatatggcctataaatacaaggctaaattgttcactggcaaacaaaaaggagaagcctggctgctaagctgcaacttgtattttcaaggatagccacattctacaactataacacaagaactttgtaagccagaattacgcgcaaatcctaacactaactaccttaactgcaaggaatttaaaagttggggtgtgtgttaccaatcactgaaggagataacggatgagcatgtttgattgtctctctttcttcatctacagttgttgctgctgctgcagttagttgcgatttataggccattccatctgccaaaggcaaactgtatactgcatcagtttccatcaaaactattgatctgagaaagataagtgccaagatgagtaaataacagaacataatagaagaatagaactgccgctgctaaaccaaaagttacctttggtgaacaggtcaaggcaagtcgatggtaataaccagctaagtagagttggattagcttcacaagtagttgttgtgtgcatgtgccaagcctcacaagtcgtcacaagaagcaaggtaactgcaagaagcttcaaaagaagttgacacatcaacattcctagctggatttttttttcatatgtagagctagttgatgggtacctggacagaataagctttacaacaagcagtgcaccagccaattaactcttgacatgaagataggtttgatgtaaacctgagaggttcccttcagtagttgtctgaagtctgaaccctgaatatattttagtatatgtattgttataattaaattttctcttagtacataaactggatagagaaggctgcatctctcatcatgcttacttcaattctgttcatcgtgaaatggcatccaatccaatgacacactgcatgggatatatgaaaaaaaacaatacacaacaagaagccttccattgcgactgtagaaatcaaatagcacaaatgccttccattcactgtagaaatcaaaaccatctgtagcgctgctttgagcacctgacaagtaactttctccctggtacaaagatagatcagagcaagctcaatggtatgaactggtgtcttgtttgtttccagtaagactatagtattactgtactatgagttaggcccaaatgcccaacgaagttaacactgccaatcttacgattcgcttgttcagtgaacgatgaaccataaatacagcattctttccctcgaacaaagtactgacaaaaatagtaggaaaagaaaaacctaatatgttcaaatctatttttccttttaacgaacaacaaaatggcgacggtttccaatcgaataatctaccggagagcacgacgcatcccacaaatctcacgcttgcgagcatccgggctagcccccaaggatccctcagtatctcgagcgattcgcatcgtcctcagcggcgcatctgctaacattttgtggaataacaaaatatgctttcccccaaatcgaagaaacaactggtacaaaggagacgtagcggcggcgagaccgtaccgcggagggagatgctccgtcgcacatctgccccatctccgtcggcggcgacggcggtcggcggactggcgctgctcgccgctcgccgctcgccccgcgcgcagaggaggaggatttcacgactcgtccgaggctgcaggcccatcgtcttcatcaccgtggccgaagaagcccaccacagcccacctaacttacggacaacgggacaatgccgcgacaggtccagcgatacataatgcccgaatgcccgataaaacacatgctgcgcttggagagttggagaggtaaaattaatacgtaactctagaattgactcgtgggttacctattaatttgatttatactttctccgttctaaaatataagagcaagtataatagtaggctataagtcggctaaatgctgagttggaggaaagaagagaggagagagaggagaagcgggctataaacttacagccggcttggacacaagaaccaaaaactctgtgagagagacaagtgggtcctgtattaattgtgacaagctaactattatataggtaggctgagagaaggctacaaatgtccttatagctagcaggtcggttgtattattagccttgctctaaggcacaactactttttaaagttgtttcataatataaggcgtgcatgcatgcatgtaattaattagcacattctctcccataaattattattattttaaatcctacactcacaagattttaattctattggttgcatgtattgtactagttggggtgatttatgacaatgatgtgatattaattatttcttggacttcgggttaaggttggttgtgccttatattttggaattgagggtgtaaataattttatggatcgacccacttgcatctctacgtggtaagtcggaccataataggcccacgggttgacatataagttcgcaggtcagtcctcttttcatccctagctgcgctccatgttattagttagtttgtgctttaaatcgtcaatagtagttgtgtatatgatgtaaatttataatgcaaacttgatagaaacttccttgttattgtgatacggtgtttccgatgccctattctaatacttccccatcctagtttgatcattagttttctcaaaatgatcatcatctaataaaatctctttatttatttgtgaaaaaagtaaatgtgcatcgcgtaatgccctgcatgcatgtatgcttgaatgataattaatttataaatgatgaatgttttgatattcttggtctaggtgtccttttgtttagtggatgatcatattgggacaaagggagtagcttcgttcatgatattttccgatattacggtagaatcggtatcattttcgtttctggctctaccgtttggtttgtattgttcaagaaaatagtaaccctttcctgatattttcatccttactctaaagtcttaattgggtgtggcctacgctagaatgtgactcttcaattatattgcttaggccaggtacaatgatctttataagtaaactctctctctattatcatgtaagtaaaatttgattacatggaagaaaaagaggggatgaaaataaaaatatggttgctatctaagccctcttagcaattagtaaaaaaaaaagaattgttgcatggatacgagagaaaggaaagaaatattattttggtacattaatgtttagacaccatgcttacagagataacatttaatgataaaacaagtcacaataaaataaataataattacataatttttttaataagatgaatggtcaaacgtatataaaaagtcaatgacattatacattaaaatacggtaaaatacggactgagaatctgtttagacttttgaaaagtcctacaattccgcgagctaaaaaaactgtgatgcggtgtctgcacccgcgttgcacccgcgttgtttgacctcactaagagcaagtttaatagtatagccaaccgctggctttaaattatctatagtcaacttaatagttaatttatacaatatatatacagtctgcatcaatctcttcaaaagtactacttaataaagagggttgtaaacgaaatcgttagagttgcagcatatttcaacatgacagaattttgcaggatgcgaagaagtaaaactcaaactctcggctgataaaggtcgagctgcataccaaactctcagcagcaacgagctcaataaaactactgaagtagcctggcaaaggctcggtttaaaacagattgttgagtagatggttgccccgcattattacttgattatagtgatagattaaatattttaataaataaacttaaaaaatacagtggaataaagttcttttttttgaaaaaaaagtatttttaaattgtgtagcaaatatcccttttcaacaatctagcactaatttaaacgaactaagcctaaaagatggagttgcctatcgtgagcaggtcaattcaatcagatggtcagtaccagctttgagtactcgtgattaagcactaaacggcatgaccaagtcaaggcatttttcattatttgtctccattatttccaaggccgatcaagcattcttttttttttctttttcaacacacctgtgccaccccagttacgattccattctctttcacatttgagggagctacttcatggctcacacggctgacagggcaagaaaacgatctctgaaaaaaaaaataaagtgcagtggttagttataaattgatcactacgattgtatgaaaatgatgtttttctatctgtcctgcagcatgcattcacagttacgtagtcatacaggtgacaaacgaacagattcattgaccaaacttacccatttgtagcaggtaatggagtctaaaattggcatcccaagcaaactgagcacaaacaaaatataaaggggaggagctgtggctctgcagttctcattcctaaccaacactctgcatccatccatcccaatttctcgttcagaatgcctctcgccctcacccttcttggattattactcttgtcactacacatctctgcatcttgtgctgccatggacaccatgacacctgcgcaagcgctctttggaaacggcaagctcatatccagcaacggcaagttcgcgctcggcttcttccagactggcagtaagtcctctcataacaccctaaattggtacctaggcatatggtacaacaaaatccccaagctaactccagtatgggtggcaaacggtgataacccagtcacagaccccaacaattcagagctcacgatctctggcgatggcgggctcgtcatcttagatcgatccaacagatccatcgtttggtctacccgaataaatatcacaactaacgacacagttgccatgctattgaacagcggaaacctcgtcctacagaatttcttgaattcatccgatgcgctgtggcaaagctttgactacccaacacatactttcctccctggtgcaaaacttggttggagcaagatcagtggtctcaatagccgtctggtttctaggaagaattcaattgacctagctcctggcaaatacagtgttgagttagatccaagtggtgcgaatcaatacatctttacactgttgaactcatccacaccatatttgactagcggggtatggaatggccaatactttccctcaattccagagatggcaggaccctttatagtaaattttacatttgtcgacaatgatcaagagaagtacttcacatatagcttactagatgagacagtggttttccatcatttcttggatgtctcaggtcgaacaaagacatttgtttggcttgagggctcacaagattgggtaatgacctatgcacaacccaaagttcaatgtgatgtatttgctgtttgtggacctttcacaatctgtaacgataatgaacttgggttctgcaagtgcatgaaaggtttctccataaaatcaccaaaggattgggaattagatgatcggacagatgggtgcatgagaaatactccattagactgtgctagcaacaaaaccgcatcaagtttgactgacaagttccattctatgccatgtgttagattgcctcaaaatggctacagcattgaagctgctacaaatgcagataaatgcgccctagtttgcctaagtaattgctcttgcactgcatattcttatggcaatggtggctgcttggtctggcatgctgagttgttcgatgtaaaacagcagcagtgtgatggcataactgatactaatggagggaccctttacattcgccttgcttcaagagaggagcaaagccagaaaaagaacagaagaggattgatcattgcaattgcccttggtctaagcttcgctgctctgtttatgctggcaatcgcactagtgatttggtggaacaaaagtaagaggtataattgcacatcaaacaatgttgaaggtgagagtggaattgttgcgtttagatatattgatctgcagcatgcgactaaaaacttctcagaaaagctgggggaaggtgggtttggttctgtattcaagggatttctccatgactcaagaactatagcagtgaaaaagcttgctggtgcacatcaaggagaaaaacaattcagagcagaagtgagctcgattggactaatccaacatataaatttaataaaactaattggcttctgttgtgacaatgatagtaaactgcttgtttatgaacacatgccaaatcgttcccttgatgttcatctattcccaactgatattaaaattttgaattgggatactaggcatcaaatagctattggagttgctagaggactatcttatttgcatgacagctgccgcgactgcattatacactgtgatgttaaacctcaaaacatacttctcagtgaatcattcactcccaaaattgcagactttggaatggcaaagtttctaggaagagattttagtcgagttttgactacaatgagaggaactataggatatcttgcacctgaatggattagtggagtgcctatcacaccaaaagttgatgtttatagctatgggatggttttgttggaaattgtttcaggaaggaggaattcaaatggaggatgtatcactggtggtgacaaagatgtttatttcccagtgaaagtcgcgcataagcttctggagggagatgtagaaagcttgatagatcccaacttacatggcgacgccaacttaacaaggttgagagagtttgcaaggttgcttgttggtgtattcaagataatgagttcgaccgacctactatgggtgaagtggttcaaattctcgagggaatatttgaacttgacacacctccaatgccaagactactgcaagctattgccggaagctcttgttctattgcagaataatattttcacaatcaaatgattctatttaatcgatagggttatttttacctttcttgtgcataagattgtcagacgtaaatgtaagctacattgtggatctatattgaaatgttaattagtgaaatcaacacagcaggtaccattgcttagcctatagcaatgtttaaacctacgacttccctttcccatattcttttgaagctcatccccctaggcttttcaaccaagcggtctaattactactttcgatttttcaacaattatattcgcatcatttactagatagccataatccctatgatattttttttgtcccacagttctgcatcatctactggatgcatcttgtcaaataaaaactactaaccacccatctggctggagatatcactggattggttgtaactaacaaatgttttctcctctttaaatcttaatgagattggtcggacaacctttggctgacccggcaaaaaaaaatgtcactggattggataatgtcctgtactaaccataaagattggaaagatgtagcaaaaatacatgatattagtagttttttcagtcttacgcaccaggaaattgatcgatcttctctagttgcaaacgaacagtatagaccaatctgtctgttgaatgtaagtttcaaaatattcacaaaagtcttggcaaataggattgcgttggtagcccaaaaaatcataaagccttctcagacagcttttttaaagggtaggaacattatggaaggagctataattttacatgagaccttacatgagatgcataaaagaaagaaggatggtgttattcttaagcttgattttgagaaagcctatgataaggttgattggaagtttctacaacaaactttaagaatgaagggctttgagcctaggtggtgtaagtggattgatcaagtggtaagaggtggcagtgtagcggtgaaagttaatgatgagataggaaacttctttcaaacaaaaaagggactgaggcagggggatcccctctcccctttacttttcaacttggtggcagacatgctggcagtgttaattcagagaacaagcgagcatggtaagattcatggagtgattccacatttagtagacgatggtctttccattcttcaatacgcagatgacacgatactttttatggagcatgacctagaggatgctaaaaatcttaaacttgtactaagtgctttcgaaaggttatctggcttgaagattaattttcataagagtgaattgttgtgttttggcaaagctatagaggttgaaagagagtatgctctcctctttgggtgcaaaactggttcatatacactaaagtacttgggcctcccgatgcattacagaaagttgtctaataaagattggaaggaagtagaagaaagatttcagaaaagattaggtagttggaaaggcaagctactttcggttggaggtcgtctcgtgctcatcaactcagtgttgagcagccttgcaatgtatatgttatnnnnnnnnnnnnnnnnnnnnnnnataatcaaaaagctggactattatagatccagatttttttggcaaagtgatgaacacaagaagaagtacagattggctagatggagtgttctatgtaaacccaaggaatgtgggggcttagggattcagaatcttgaggttcaaaatagtgcttgttgagtaagtggttatttaagttgattaatgaagagggggtctggcaaaacttgtctggcaaaacttattgaggaaaaaatatcttgccaaaaagactataatgcaggtccaaaagcaaaggggggactcccacttttggacaggtctaatgggagtgaaggatacctttagctcttttggctcgtttaaacttcaggatggtttacaaatcagattttgggaagactgttggcttggaaaccaatctttagagaaaatatacccatcgttgtacaatcttgtaagaaataagaatgtggtggtggctaaggtgttggagagggttcctttgaacgtctcctttaggagagccataataggagataatttgaaagcatggcatgagattgtagctaacgtggttgatataaaccttagagggcaaaaggataggtttacttgggatgctagtaaaaatggaactttcacagtcaactcgatgtataaaaaactcatgtttggaaatgtgataccaaggcaatcttttatttggaagctaagacttccgttgaaaataaagatcttcttgtggtatttaaaagagggggtcattttaaccaaggataatttagctaagaggaggtggaaaggtagccttagatgttgcttttgtaggtctcatgagacaatacaatacctcttctttgattgccccatggtaagatatgtgtggagcgcagtacatttcacttttggcatctgcccaccgcacaatatgtctcatttacttggtagttggctaagtggtgttaacattaggctaaaaaatcaagtttttgtgggcatagcggcgttgtgctgggcggtgtggttaaataggaatgatgtggtttttaatggaccatgtacttactcttttatgcaggtaattttcagagggacacactgggcaagactttggtctttgttgcttaaggaagaggatggcaacatgttgaaaaattattgcaaggtgttagagatgagggtcttagaattcttctctaattatggctggaatttcagagggagaattgaagcttacactgttgtttaagcttgtttgttgagtttgcttggttgtcttgttagctggcatattagttgaacttggtacttcttatgttacttttaagtatgttttgtaacccatgtaatgggaggagccttagtgctcttgtatggacttgattggcagtgtacattcttcgggatgtagaagccggggtttatataaatcctttatctaaaaaaaagttgcaaacgaacaatatggtggccgacctcgtgcgcccctaatcccaggtaagctactaccagctcttgccaggtgacaaacgccggccaaggtgaacgatggtggaggacgagcaatcaaatgcagggcaggttgcatccccccaaatatttgcgctgatttctaccggaatcttcagttttttgcaggcacacacggagatatatatatattcttcgacgagatgttgatccccaaaacgtacaagaacagagagaccaaaaagcgtaagacgacgagaccttaccactgggagagagagagagagagagagagagagagatcccccgccgccgccgtgagtctggtcatctccggcggcggctcgccgccccgaggttacatcgcccacgacgccgacgagcggtgcagcccaaatgaaagccacgtcatcagcagcaccgggccggcccatctccccttcccaagcaaatttctgcgctcgcggcccaacgcttcgtggctcttcctgctgtggagaatctggagatcacgtggattttttttaatatatttattttaaaaagatttacaaaaataaactaccatttcaaagttttttttaaaaaaagagtaaattacacccacagtacgataacttagtagatgcgtgcgatttagtgcaagaacttgaaaaataagtagagtagtacataaactgacaatcacgtgcattttagtaaaaacattgatacgtaccttttgattaatcctggtattataagcttaactgctagatcattagctcatggattcaattttgtgttttgccatgttcatagcccaagataatgaatatgttgattaatcgaatcgctcggaaattatgcttatttgcatgcacttacttttgataatcatatatctttcggtttcaaatcgatagaattattttattattattataactaacaaattaaaagcaatacataatacatgtagatccttgtcgagatggaataagtggctgcttttttatatggcataaaaagtatggtgtggaatactgatcttttaaccaaaatgcacgcactagccaagttgttgcacatatatgcttattttttaagtttttcactagatcgcacccacataccaagttaatgtactatagacgcaatttactctaaaaaaaataaactccacgcggcgctctatgatagggtaatctatgtgacgtggcaccggccgcaccccgcgggagggggctacctacagaattaccacggtgcaaagtttagtgatgcatggggtgcaccaaggcaaattatatttatatttctatagaacttcaaaatgagaatttatttttgtaaatctttaaaactaataaaaacaaaaaaatcgatcacgagtaacctttcaatctgccaaagcccaaaggccatcgtattcgtgaggatcaggactgccaaagccctaaaccaatcaccagtggaacgaatggtaaggagtaattggtaggggtgaaaacggtacagaaacggatggaaaccatccttatcgttttcgttttcatattttttttcggaatcggaaacctcggatacgaaaacggaatcgaatattatagaaaccgaaaacggagcgaaaatgaaccggcgcgaatacggtaacgaaaatttatcggaataaaaaccccctcaaactgataaatccaattgaataaattatctatgtttaaaagagtaatgttgttgataaattctaatgtagtacaaaatattcttatataattttagatttgcataacaaacattttttaaaataataacagacaaacaccatggtattcactatttagtgcttaaaaaaagaatccagggtatttcgatcacaaaatttctagtaattccaagaaaatttccggaaagtttccgaccgattccgagttccgacggaaactacccttatcatttccgattccatttccgagaaaatatttccaaattcgtttccgtttctgaaaaattccgaccgacagattccgttttcaaaaataggtctggaattcggaaagtttccgtaccgttttcacccctagtaattggtaagtattatttcttttcttttcaacgtgagtgtatacaagtatagattagtcaggattaaagattcctacttactccgtttaactatgtaagacttctatataaatgtgggtgatggtagaaagtcttacattatgaaacggggggagtaatagttacgctttaaatacaattttcaatctgccaaagtccatgtattcgtgcgtgctttccattggttcagccgatgattgcgcggagaaaaggtcaaactgggtgaaatatacttaatcacactattatgataagctgtgctcattggcaagcactcatgggccctgtttggaagattagcccagggctaattttgagagctaatgtttagtcatgaattggtaggctaaacattagcctaacatgatatgtttggatccataggctaattcaagactaaaaggtggagagagagtagaaagagatgagagagaaggagagagagagagctgcttttttatggtccccacacaaaattagccctattagcactctttggaggggctaatgttttgaggggggctaattcacattagctcaaaattagtccacctgtttggatccttgagggctaatttgagactaaaagatgagagctgaacattagcctatggaaccaaacagggcctggtagcctggtacacatggcgatcgaggaaatttggtggttagtgccacgccttcgagtacccatagtcccgtatcatgatgtacgcaccgatttggcatgataatatagttaatgtgttcagcatttttgcctcctttaattccgccgtccaagtccataagaatggtttgcaacacgctttggtatgaccaagaagagatgtacactattccagcattaactcatactccttacgtactagtaaaggaagtcgtttaggacagcggcatggtctccaaaacacaactttgacttcttgtttctataaaaatatttattgaaaagtgatatatgtatacttttatgaaagtatttttcaagacaaatctatacatataatttttacatttttaaactcaacaacttgagagttatttatgatttatattcccaaggtttgacttaaacattgtcctaaataactttctttatgagtacggagggagtattccattatttctataaaaaaaacttctagccgcatcataactagaaattggatttttataggatggagggagtagtcacgtacttatatacagccgcacctgagcgttgacatcctgcatcctgtgctcaacatgaaactgatttgattttggagaaggaatgtcagatttgatctcgtgtgccacactggaaactggacaaaattttgtctactagctgaagttttcatttggacccgaaacatttttttgctcaggaaaggaaaatggaacaaagtagagtccacagtgtccactgcattggtatgtgggatgaacttgctgtgctttgcaaggtttagaagaatatataaacctactcacctgcgtacgtgttgatggcagaggcataaaacaaccatttctgtctggaatagttggcaaggatcattcctgagtccaaacgctccagcgttgaggtctgaccaagataagaagattatttattattcagataacctatcatatttctcgaggcttgtttcaggctaaacacaacgtcgtcagttgacaaggtctgatttctaaacagcaactgaagctgcttgcaggaccatcatctgcttcaatcccactcttccctcagtcctccaccacgccttccccttgttcatcatctgcttcctcatgcctctccttcatcatgtcctccttggcttcctcctcatcctcctctacctacggactccgacgagctctaccgccacggacaccgtgtctcccggccacgcactcgtcggcagcgacaggcttgtctccaacaacgggaagttcgcgctcggcttcttcaagccaggcaatgagtcctacaccaaccacaattcctaccttggcatatggttcaacaaggtccccaagctaaccccactgtggactgccaacggtaataacccggtggtggaccccacttcaccggagctcgcaatatccggtgatggaaacttggccatcttggatcatgccaccaagtcgatcatatggtccacccatgccaacatcactgccaaggacaccattgccatactgttgaacaacgggaatcttgtcctacgaagctcctcaaattcatccataatcttctggcagagcttcgactacccaacagatacacttttccccagtgcgaagattggctgggacaaggtcaccggcctgaaccgtcgtcttgtttctaggaagaactcgattgatcaagctcctggtatatactccttggagttagggcccaatggggatggtcatctgctatggaactcaaccatagcgtattggtccagcggacagtggaacggccgatattttggcctaacaccggagatgacaggcgctctcatgccgaatttcacatttttccacaatgaccaagaggcttacttcatatacacctgggataatgagacggcgatcatgcacgccggaatagatgtcttcggcagaggtttggtggccacatggttggaggaatcgcaggactggttgatctattacaggcagcctgaagttcattgtgatgtgtatgcaatctgtggaccattcacaatctgcgacgacaataaggatccgttctgcgactgtatgaagggcttctctgtaagatcaccaaaggactgggagcttgacaatcgaacaggagggtgcatcaggaatactccgttaagttgtggcagtagaacggacagaacaggcctcacagataaattctaccctgtgcaaagtattaggttgcctcacagtgccgaaaatgtgaaggttgctaccagtgcagatgaatgctcacaggcatgcttgagcaactgctcctgtactgcttattcctatgggaaaagtggctgctctgtttggcatgatgagttgtacaatgtaaagcaactatctgattcttcttctgatggaaacggggaagttcttacattcgccttgctgcgaaagagttgcaaagtttagaaaggaagaagagtggaaaaataactggcgttaccattggtgcaagcaccggtggcgctttgcttttgattatccttctattgatagtttggagaaggaaagggaaatggtttactctcacactggaaaagcctgaggttggcgttgggatcattgcatttagatatattgatttgcaacgggcaactaaaaacttttctaagaagttggggggaggcagttttggttctgtatttagagcaatgctccggtgctttctaccggtagtatatactaccagtagaactaatctgaaccgtttatttttaagggtagattagtaaagtactgaggtagatttgggataaatttggcacttaatttatttttgtcgtggatcgctcggatgtttctggaaaagcagtgctgccaccgcttcctcatccatcgcaatcgagcggaggtggagagagcgactccttccgccgccggcgcttgtgcatcacgttcccttccgccggtggcaatactctccggcgccccctcttgttcagttccccttctctgccggcgtctacccgcttccccgccgcaggagcttctggtgccaccctgaagacttccggcgtgcgcacaggggcagcggtgcagaggagccccgcgtggttccacctcctctcgcacgacaccgccggcggtggtggcagccgcgacgacggctacaggcgtgcgtggagccggctgttgaggaggctggtgcaggagagcatgagcttctgtagcctcagcatcagcaggcacggtaatgttaattttcgtggatgacttcaccagaatcaagaatctgattctgaatctgaatcaagaatttaatttggagatggacagtatgctctattgctataccagaatcaagaatctgaatttgctatgaaaagaagtagctcaacttctgtgagcctgatccattaaatttgtgctttgcttcctctttacccaagctaatgtaatgtgaataggcccatcttgttggaattctgcgtgaaacccattccagcaatccagtccacgaaggcttccccttgcgagtcgtcacggcggcgagcgggtggcggtggcgccatggatggccagcaggaggagcagcacgcagggcggcggcagctgaagcccgggaaagacaaaagtatccctccgcaaatatttttttttggacaaaaatatccctccacaattctactaccattaagtgtgatggtagtagaaatagatctgaaccctatgatcaaatgagatcaacggttcagattattttctactacaattagagggcaccggagtgggtatcctgtatttaagggctacctaagcaactctaccatagcagtgaaaaggcttgatggtgcccgtcaaggagagaagcagttcagggctgaagtgaattcaattggaatcatccaacgtattaacttagttaaattggtcgggttttgttgcgaaggtgataataggttacttgtgtatgaatacatgccaaacagctcccttgatgtgtgtttattcaaggctaatgatatagttttggattggactactagatatcaaatagctattggagttgccagaggccttgcctacttgcatactagttgtcgggattgcatcatacattgtgacatcaagccagagaatatacttctggatgcatcttatgtgcctaaaattgcagattttggaatggcaaagattttggggagagaatttagccgtgctatgactacaatgagaggaacttttggatatctggctcctgaatggattagtggaacagttgttacatctaaagtagatgtttacagctacgggatggtcttttttgagatcatatcgggaagaaggaactcaagtcatgaaaatttcagggatggtgattattcattcttttttcccatgcaagctgcacgcaagcttctcaatggagacgttggaagtcttgtggatgctagtttggaaggcggtgtgaacctcgttgaggttgaaagagcttgcaaaattgcatgctggtgtattcaagataacgaatttgatcgaccaacaatgggcgaggtggtacagtctcttgagggtctacttgaactcgacatgcctccattgccaagactactaaatgctatcacaggaggctcacatccagtgacaccacaatatttttattcactataaatctgtatgttgatttgcaatttccagttgtctatcagaacattataattcatcttgccttttaagaaaactaggcataacatgtaagatctctaggagatcatgtcttatattaaatataaactcagtattgtaacatgtaattaagatctatgtacccaagaaggatattatgctagccttacaatatggattatctcttaaaagatacttggtgtctgtgatatgtaagatctggtatcagtgtaccacatacacttgtaaatattaccaattaagatgtttttgagacacgggcaattcagatgagagtggatagttgagcctaacggtggaaatgtgtggcatcctgatagttatactcatattatgcacacatggcctaaatatacaaggcaaaattgttcactggcaaacaaaagggagaagcctggctgctagcctgcaacctgtttttaaggtaggcacattttacaactacaacataagaactttgtaagctggagtaactcataagtcataacactaactacctggattgcaaggaatttaagttatggcatgttgttcagtgggtaccgaatcactgaaggttgatgattgacgagcacgttctgtctctttcttcatatacagttgctgctgctgctgctactgctgccacagataatgtgattcataggctgttccatctgccagaggcaacctgtatcatgcatcagtttccatcaaaactgaactggttattgatctgagaaacataagtgccaagatgagtaaacaacagaacataatagaagaatagaactgtctctgctaaacaaaaggttaccttggtgaacaggtaaggcaagttgatagtaagaaccagttgagttggattagctccatgcttgatatggcattctgacttggaccattcaggacaatgtcatgtattattcagttaaacccttctctgactgtgtactgcccagccacagttccgtcttttcaccttcttattttacatgacaaggtgagacttgagagatacaccataatttatggatccaatagtcagtacaacagggggaaaggtaggagaacacaattaaggaataacaatcaaattgttaggcatgtttacagttagcaatggtttttcatcaactctgccaagtgcagcagcatattcatacaggccagtgaaaatcggaattattgctacaatctttttactttcaattagtaatgaaagatggaattgatatgacaccatttgtttactagtaagttaggaatgcgcctgttattagagggtattttgatcacatttgtccaaaacatgaaaaccttggtatgcataattttgtgagtacactggtgaaatgttacatcctaagctatcagaataccagcctctaggtgaactgctagatattgccagacctctagacctcattgtaggttatactgaacactgacctacctttggatatttagcaatagagacaattgcgcttttgaccctgttttaaaacctaactatcaatttgaccctacttttttagggtttgatagataaacactaggtagtttatatgcaacgtcgactataatcaatgaaataactaaatattcatcctttcctcttgtccaaagtgattctacagataaccagacagccccagtagtcatgtacataagtcgacctccctagggtaatgaaaaacagaaagactagggggaatgacataagttaagttgtggttacatcttgaagcatttcctgcgcacaaaaggcagacgccatcttatggcctacaagttgtacatctgagaatatatatatacattcatacaggctaaggtaaagaggtaatccagctcttagtaccaacctgccaactacaataagaaataatcaactcaagttgcaagaaagaaagagtagctagtaactacagctacttgtactaattgaactgctacataccaatgatgtatatgcccatttctagctggtccatgccatctatagtcgatggatgacatctaatcatctcgagcctccaatctacaagacgccaagatggagcttacatgttccgtgctgtgctcaaaagagagaagcacagcaccttgcaatgaggcattcatatctacaaggcctacagagaagaatggagattgttcaactcagatgtttttgtgcagaaattctcatcaggttgctgaagaaaacaacaaaaacaaattttcaataatttcccaagctttacatgtgaagtgatagaagggcacccacacatatcctatgatcatttacctggttgtgtgggctgctacttgacacctgagaagtgtgataggttgcaaaacctagatgctgaaaaagtgtcaatcacgttagtactatttccaatactcaaaggctagaatgggttcaatcaaaagttcttaataccgtcgtgaaagtcggatttaagccagagggcatttcatcatagctaattgggcccatcggacttgaaagatcaatcccctagattaaaaaggaaataaacaactatctcaatcccctggattaataggaaataaacaacttccaatacaacaccactaaaagaacatcatatgtagggaagcaatttgtatgtaacttcataccctgtaggttttataggtcggagtttgggtacccagtggggacatgttaggaggacctcgaaagcctgcatgttgaaaaat

SEQ ID NO: 3050 - DNA, 9485 bp, Oryza sativa
  unsure (1)..(9485): unsure at all n locations
cgggccgtccgcgaggagcgagcggcgccggcgacagttagctagagcggtgacggccgtgggctggagctgaagcggcgggctgagtgccatgtcgcgccgctcaccgttcctctcacaccaccaccacccgcacctcccgccgaggaggtcacctcacgccgtcacccgagaaggtcacctcacgccgtccaccgagaagagaagcgccatgatccggtcgccgccgtcgccgcttcctctcgtcctccctctgccacaagccgccgccgccctcgcccgcccgtcctcccgccgccgcccgctccctatgtcctcccactgccacaagccgtcgtcgccctcccccgcccgccctccctccaccgccgccgactcccgcccgccggcccccgtccctcagccaccgctcgcactgttgccggctcccctcgtcctcccactgccacgagccgccgccctcacctgcccgccctcccgcccgccggttacggcgtcgaagacctagtcggcggccgccgagctcgccgtaccccgccacatgtgcctcccgcagtcgctgatgtggtcttcgccgcagtgcagctcagcccgggcgccgccgtctccacccgccgcgggagagagagggagcggcgaggagagagaaggaactgagggagggggagaaaaaagggacacatgggtcctacaatctattttctgtgtcaatgacaaatgggtcccacacatattttttaattctaaatgccacctaaacaccacgtcaacgtcacgtgtaaaggagacccggtcaatactgccatgtcagcgaaaccgtcctccaaaaccgttgagggagtcaaattgcaccggttccatagtttagaggtaagatattcggttttgtggtttagggtcatggattagatttcaattacttttgagggtcaccaagtgaacttattccttgttgcagtggctgcatcagtgcagcccagcccagcccagcgatgcgccctctctgtggaaatcacgagcgttccatcagtaatatgaggtatgtagattaagtagatgtgcgtaaaatgggaaagttattagcacataattaattaagttttaattattataaacttataaataaatgtatttaatattttaaaacaacttttttataagaaagtttttcatgaaatgctccctttaatagttaaaaaggcgtgctaacagaaactgagataaaatctaaatcttataatcagaaaataacagggccacttgaaccgattatcgcgcggagaaaggtcaaactggataaaatactcaacgacaggctgaaatcattagcaagcacttctgttacacatggtgatcaaggaaatttggtggccttcgagcacccatgattacgcaacgattttcacatgataacatagctagggcccctttgatttggaggaaaaacataggaattttagggcccctttgattcgtaggaaaagtttaggaaatttgaaggatttcaatctaatggaaaaaattcctatgaaaacatttgaaacaaaggattgaatcctataatatcctttaaaattcctatggaatgggtaatcatagagagattttgtaggaaagttagcaagaggtccaacctcttggaaaaattcctttgagcctatctctctcatccgaatcctgcgtttttcctttggttcaatcaaacgatcattcctatgtttttcaatcctttgttttacacctgcattcctgtcagaatcctacgtttttcctattcctccgtttttaccttcctgcgattcaaaggggcccttagaggatttcaatcctataggaaaattttctatgaagccttttgaaacaaaggattgaatactatccaatcctttgaaattcctatggaatggacaatcctatagagattttggaggaaatttagcaagagcttcaacctcttgctaactttcctttaagtctatctctctcatccaattcctatatttttcctgtggttcaatcaaacggtcattcctgtgtttttcctattcctacgttttctcaatcctacgattcaaagggcccttaagagcatccccagcagctcgtccaaatttgatcatccatatggctatatagatggtcatccaaaaaagattcctccttcatatttctccccatatttctccccactccaacagatcatccatattacatcatctatatcacatcctcctatatattaatagtatccttcaactaccatcaattaatattatttttttcttttttcatcattatcttctctttcactcccttctctcactccagagagctcgagagacacgagctggcggaggagcggaggggcgacacgagcggctcgccgccggccggagcggagggtcggcgcaggcgaagggtcagcgcgagcggctcgccgccggccggatcggaggggcggcgcggggggctcgccgccagccggagcggaggggcgcgcgaacggctcgccgacagccggacaaagtggcggcggcagcggaaagccgacgaggccgaagggaccttcactcgatctaccttcactgcttcacctcttcctcgatctcgatccggatggggacgggagaacaaatggcagcggtggttgcgggatggcgtgaggagagagaaacaccaaatctagcgtttctctctccgggaatagcgcatgcgccatctatggaggcccatatggcgtatccgttggagccggattttctccccccatacgccatttcctggatggaagatgggatgccggaactgctgggatgctctaaaggccaaagtcaatgtgctaaccatttttttcgtttttgcctccattaattccggtgtcccactgatcggttttcaacacgcttgtctgcaagccccagccacagttctgttccctttcacgcccttttctcagcaaacacatactacaggcgtacagccgcacaccctgagaaatatatgctccaacaagtcctcctcaatatacaaatgaacctgatgacattatttggaggggatcgatcagccaaatggggaataatactctgcaagacgtacaaatacaacatgcgatttcaaggcacaatcaagttacaacaaattcaatgttctctggcaatctgaagcccaaccgaaacatgtcagactcgttgggtggctcctgactcatcaggcgtacaaggtcaatcaattcctatgcttgcttcgtttcagaaattcttgcatcttacatccctcggtcatggtctgtgcttaaaatcagaccgatttgcttttggagaaggaatgtcggatttgatcatactggaaactagactaaaaattctgtctcctaactgaagttttcatttggacctgaaaccatttcttggtcaagaaaaaaaattggaacaaagtaaatccactgcattggtgtgaggaaagaacttccagtgttttgcaatgttttaaaaggagttcacttaaaataatatacctactaacctgcgtgttgatggcagaggcataaaacaaccttttctgtctgaaatagttggcagggatcatttctcagtccaaacgctccagcgttgaggtttgaccaacatgagaagattattattcagatagcttatcatacttctcgaggtttgtttcaggctaaacacgatgtcgtcagttgacatggacttagtgattgagacaaagtgcccacaccaccacgttaacttgccaatctgcgagctgaactaatcgctggtctgatttctaaacaacaacagaaccggcttgcagaatcgtactgtgtgtgagctagcttcaataccattcctccttcagttctccacttctccttcccttgttcatcatctgcttccacatgcctctccttcgtcatgtccttcttggcatcgtactcctcttcctgcacactctggcgagctccgccgcgacagataccgtgtcacccagccaagcacttgccggcagcaacaggcttgtctccaacaacagcaagtttgctctcggcttcttgaagccaggtaatgagtcctacaacaaccacaactcttaccttggcatatggttcaacaaggtccccaaacttaccctgctgtggaccgccaacggcgataacccagtggtggaccccacttcaccggagctcacgatctctggtgatggaaacctggccatcctggatcatgccaccaaatccatcatatggtctacccgtgccaacatcacaaccaatgacaccattgccgtgcttctgaacaatggcaaccttgtcctacgaagctcctcaaactcgtccaagatcttttggcagagcttcgactacccaacagatacgcttttcgccggtgcgaagattggctgggacaaggtcaccggcctgaaccgccgtattgtttctaggaagaattcgattgaccaggccccaggtatgtactcattggaggtggggctcaatggggatgggcatctgctatggaactcaactgtgccatataagtccagcggggactggaatggccgatactttggcttagcaccagagatgattggagttgcattgccaaatttcacatttgtttacaatgaccaagaggcttacttcacatacaccttgcgtgatgacacagcgatcgtgcacactggaatagatgtcttcgggagaggtttcgcgggtacgtggctggaagggtcacaagactggctgatacattacaggcagccgatagttcattgtgatgtgtttgcaatctgtggacctttcacaatctgcgacgacaaaaaggatccgaataacaacccattctgcgactgtatgaagggcttctctgtaaaatcaccgaaggattgggagcttgatgatcgaacaggagggtgcatgaggaatactccgttaagttgtggcagtagcaaggacaggtcagacctcacagataagttctaccctatgcaaagcattaggttgcctaacaacgccgaaaatgtgcaggctgctaccagtggagatcaatgctcacaggtttgcttgagcaactgttcctgtactgcatattcctatggggaagatggctgctccatttggcatgatgagttgtataatgtaaagcaactgttggatgctgcttctgatggaaatggggtagtcctttacgttcgccttgctgcaaaagaattgcaaatttcagaaaggaagaagagtggaacattaattggtgttgccattggtgcaagcacaggcactttgtttcttattacccttctactgatactatggaggataaaagggaaatggattattgctcacccactggaaaagtctgaggatagcattgggatcattgcatttcgacatattgatttgcgacgtgcaactaaaaacttttcagagaaattggggggaggaagttttggttctgtatttaaagggaacctaagcgactctaccatagcagtgaaaaggctcgatggagcccgtcagggagagaaacaattcagggctgaagtgaattcaattggaatcatccagcatattaacttagttaaattggtcgggttttgttgcgaaggtgataataggttacttgtgtatgaatacatgccaaactgctcccttgatgtgtgtttattcaaggctaatgatatagttttggattggacaactagatatcaaatagctattggagttgccagaggccttgcctacttgcatactagttgtcgggattgcatcatacattgtgacatcaagccagagaatatacttctggatgcatcttatgtgcctaaaattgcagattttggaatggcgaagattttggggagagaatttagccgtgctatgactacaatgagaggaactattggatatctggctcctgaatggattagtggaacagttgttacatcaaaagtagatgtttacagctacgggatggttttgtttgagatcatatcaggaaggaggaactcgagtcatgaaaatttcagggatggtgattattcattcttttttcccatgcaagctgcacgcaagcttttcgatggagacgttggaagtcttgtggatgctagtttggaaggcagtgtgaacctcgttgaggttgaaaaggcttgcaaaattgcatgctggtgtattcaagataccaaatttgatcgaccaacaatgggcgaggtggtacagtctcttgagggtctacttgaactcgacatgcctccattaccaagactactaaatgctatcacaggaggctcacatccagtgacaccacaatattttgattcactataaatctgtatgttgatttgcaatttccagttgtctgacagaacattataattcatcttgccttttaagaaaactaggtataacatgtaagatctctaggagatcatgtcttatactcgtattaaataaactcagtaccgtaacatgtaattaagatctctgtacccaagaaggagattgtgccagccttattaacaaattatagttggtgtctatgtagtatctttaggtattagtgtaccgtatacacttttcatgttgccaattgagatgttttcagaaatacaggggcgattgcctcgtcagttgatagtggattgtgagcctaacattggcaaatgtgtgacagcctgacagttctgctcatgttatgcaaacatggcctatatgtggcctatacatacaagggaaaattgttcactggcaaacaaaagggagaagcctggctgctaacctgcaacttgttttttcaagggtagccacattcttaaactacaacacaagaactttgcaagacggagtagctcataggttgtaacactaactacctgaactgcaaggaattcaagctgtggcgtaccgtactgtggttaccaatcactgaaggttgataatggatgagcacgtttgattgtctcatgttcttcatgtacagttgttgctgctgttgatagttgcggtttataggccgttccatccaccagaggcaacctgtatacttcatcagtttccatcaaaacttaactggttattgatctgaggaaggtaagtgccaagatactgatagaacatagggcctgtttggtagagcttcaagaggtggagctggaggtggagctgtgacaaacagacccataatagaagaatagaactgctgctgctatatattttttacaggaaaggttgaaaagcttttttgaaagcataagagccttacaggtttactgctgggggctccagcttgtctatacatcacagggcaccgacatccccaaagcacctgcatgctcaaagctacattatagacatcacaaaacacctggctaaggctaaagtgacaaccacaaataaactttcaccaaagactgatgtcaacccactccagatcttgatagtcctcaaattttgtccagtgccttggatcaccatgatcagagcttccatttcttctgcttcagatgacttcagtaagatcttccattgcataaggaacagaattcgaaaaacaattattaggggtgaatgtaaactttctctctaaacataatgtcattcctgaataaccacaactgccaacagccaacacacatacagaattctatttcttttacgcccagctctcccaataacaaggtgaaagaaatgatcaaaagagaaaggagaactttgccaacccaaagcatcgctaataacacaccatttgctgcagatcaactggagataatatgttgcgaatcctccagcacttgcatagcatgcaatgttctgaaccctcctaatttcttttttttttcaattgtacagcagactggattctatctctactagccaaccgtagaaagtgttagggcaaggagctctataatttccatccctttactataatgtacccccctaaatgtcaaagcatacaccgtacagggacctggatgagtagcccttgttcctctccatgcccaggtcaaggtatctactccctcctgttgaggtgtcatctctattaccattctcaatccccaccatgcattcatctcttcactcccaaaagatcttctaaaagttaagcagttaatacctctctctagaatttcagccactaggatatctttgctggttgcaaatatcaaataaattaccaaaactaactctcagtggccaccgctatactcacaatcgatttaccggataggtacaatcgatttttcagcacctatattcacagcatttactggacaggtataattcctatgatattttttcccacagttctgcatcatttactgggtacctcttgtcaaatcaagattgcacccatctggctggaacggacacctcacaggattggataatgtattgtgcagttgtacggtaccaacaaccaaccacaaagattgaaacgatatctatcctacatacattcctactgatagtagcagttcttccacaatctaacgcagcacgaaattggtcgatcttctctagttcttccacaacctaacgcagcaggaaattggtcgatcttctctagttgcaaacgagcaataatggtggccgacctcgtgcagcacccataatcgaacaggagtacagttaagctactacgcgtgcagctaaatgcagggcaggttgcatcccccaaatatatatatactccctccgttttaaaatgtttgacaccgttgactttttantntntgtttgaccattcgtcttattcaaaaaattcaagtaattatttattcttttcatatcattggattcattgttaaatatattttcatatacacatataggtttacatttgaataacacaaatgggcaaacatgtgctaaaaagtcaacggtgtcaaacattttgaaacggagggagtatttgtgttccccttcagtgctctgatttctaccggaatcttcagcttttgcggcgaaagggagatcaggagatctattcgacgagatgttatccccccaccacaaaacgtagaagagcagagacaaaaaggagtaggaagtcgagaccttaccacggggagagagagagagagagagagatcccccgccgccgcgcgtgtgaccatctccgtcgagaatggcggcgccgccggcggccgctcgccgccccgaggttccgtcgtcatctcgcccacgacgccaacgaacggtgcggcccaaatgaaacgcggaaaagaggccatcggcgccgacccgacccggcctggcccggcccatcttcccttccaggcgaattttctgcgctcgcggcccatgctttgttgcaggtaataagttcacttggtgacccttaaaagtgatcgaaatctaatccgtgaccctaaactagaaaaccggatatcttgacccctaaactattgaaaccggtgtaatttgattccctcggcggttttggaggacggtttcgctgacgtggcgcttgcgtggc

SEQ ID NO: 3051 - DNA, 28955 bp, Oryza sativa
  unsure (1)..(28955): unsure at all n locations
tgttctgagtgaaccttctgcttctttcgtaaacctttttcaatgcaatttcttgattggatcttatttttctgccccttcttctttgactcttttgctgttgtgccacttgatttgtccatgatattttctgcttgagtgccgtttgtaatagaaggtaaggaaaccttaaggttctgaacatcagtctgggtcagagttgcatcgacacaagtttgtttctgtaggatttcttcaactttgttgctaagatctacccaacattggtccagtactctgtaggattcctcacattctgatgctcgagcaacaagcctaacatactttgggcacatgtattgatagcgactggaggattctgataatttatctgcttgaattgcttgaccttgaacatctccagacatcaaagtcctagcatattttgtccagcgcttcataatatatctgtctggtagatattttatatccattgcatctaaaattttcagcgcgtggctacacaagaaaccatttctttcaaacttcttacatgagcatgaaacagtctgctcagtagggtttccataaactgtatatcgcttctctttctcaacaactgaaacgacatactcacgacaagggccactttcatcacggtttacaatgtaagctgactggaattcttcgtattcttcttgaaaaagcggaaagatcgtattggtataagcctcaaaagcttgtgtcaggataggagctttaattttaaagtacagcaactttagccttgaactatactcaacctccaattctttccgccgcctatcattaataactgtctcaagatgcctcaacaataaaagaatatttacctcaggtctcaaatgatcccgcacatcagactggaagcggtcgttcaatcgtgtgcctttcattccagctgaaaagacccctctcatataaggtctagcccatttttctttttcttcaaatacctttttcaaccatacattatcatgaaggttatgcttattgatcatagcatcccaagaagtgagaaattccgtctcctcttcatacaaattgatgcatgccttgaactccttcatgaaatcactgtcacttttaagctgatttatgttcctcgttgcagcatgctttaggtgccatgcacatataacatgggttgtgtctggcatcactatagagacagcctttgctacaaccgcatcttgatgtgaaaagaaagttttgggtgctcgtccagacattgcatgcaagaaagtctcaaacagccactggaaagactctgcagtctcgtcatacatgagcgctaacccaaaaacaataggctcaccaaaattgttacaaccgacaaaagaggcaaaatgacggaggcttatactgttcctagacaccacatcaaatgcaataacatcaccgaactgactgtagtcagtaatcatccttggatcggcccagaaaacatttgccaccttatcctcgacatccaactgcacggaatggtagaacgaggggttagccagagactggtcttgaaaataatttaacaaagcaccagcttctccatacttcatctcccattgcctcctggttcgcagcggctgccggcgcccttcccctgcactcgcggtactattctcttcggtagaattctgccctcccacctcacccccgtccatcagaagatcaggcggcgtaacggcatcgggcaatgtcgtccagtgcacgacattgggctgcagaggattgggcatgcaggatgtagcgaagagcgggtggttgtgccgcggctggaaggcgtaaacctccagcttggcgccgggcttcttgcggcggatgacgaggtgcgcgttgcagccggtcctcgagtccggcatcggcaccatgtggttgccccgcttgacgttggccctgtagccctcgcgggagcaggcgaacttccgggaggtgatctcgccggtcttcttgctcttgttggcgtactccttccggacgttgaaccctactttccagccgtagtagcggtagaactcgtacgcctcgtgctcgctctcgaactccatccccatccgcggcgtgtactcctccgggcgtgtaggagcggcccggaatccgcccctccccaccgcggcaacggtggcggtggcggcggcggctcccgtcaagggatttcgggatgccgcgtgggtcgtcgtggcatcagttgccctcaagggaattcgggaggccactgcggcggcggcggcggcgggccttcgggacaccgaggtggcggtagtggtggtggtggccctcgtggcggtccgggacgccgcggtggtcgccgggatgttccgggcggcgacgggggcagtggtcccggggggcttccgaggtagcacaccggtggtggcggcggctacccccgaggccttccgggtcgccgccgcgggggcggcggcggatgtagacccggattcctttcgggatggcacgggggctgcggcggcggcggtagccggcgatccggatggcggcgcggcggaggcattccgggcaggcgcgggtgtgattggggggttaggttttggtggggcggcggcctcattgcctgaggcggcggggtgtggaggcggggaagcgggcgctggcgctggagctggagtaggggggtgctccggtggagggggctctgccggcgagctcatcgccggcgggcgcggcgacgggggaggggttggagccggtgctcgccgccgtagctctgtaacgctttcgtgcaaacaagacagctttcgggagaggaggggaagtgcactgccaaccaggagatgacgctttcgaagaaagaaggcgctaaaatcatctgctgtttccacgagaaaaaaaatcgtctaaaaaaatgcaccaaggaaagctgatagcctgatactgcctcgaatcaaattcattgacctgaaatattttttactggagggagtactggatgggtcgaattaatttatgaacccagttttgttttctcactgattaaactcattttctgtaattccatatttttcaggttagtttatacattaaaaaaacggcatattagttgttattccactactgctcaaaaataaaatgcaagttcccaaactacataggaagtacatgaatactcacaaactacagaggaagcatatgaatgcagagtactccttccgttttgaaatgtttgacgaacaaactaaacatcataagaaaaacaaactaaaacaacatcataaaaaagaacaaagggagtagtagtatttttccagctgagagaataaaaaaaggaacgaaacaacgagaagaaattaccgtaataacatgacggtgatgtttccctcaaaaactggcatttgattatagttaattcacttgattcacatgacttcgggtttcaacccaaaagaggaaattaaaaaaaaaaaaactacagcgaacttcagtcaccaactctctatcagatttaaaatagaaccacaaggtgtgtgtgtacaaaaaagaatgtatcttgaactgaaaacatattcataaaatggagtatacagctaatgtcattataggaaaaagaatgttcgggtccctgataaaattacatcaaaggatcattcacgcaaccaagaaaaatcatatattcatcagctggaacagtgataacaccaggagtccaggagcagctgtcactttcgcggcttccttccctcatggccttgaagctcaagcagcctgctctgcaatagccactttaaaatcagactagcacgcggcatggcatcagacaatactaggcatatctccaacccagctacaaactgcccgtggccatcgggttctaatgcagtccaccaacggtgcatgctgagaagtttgaacaggtggagcaagtgaaagaacactgtcatccttgctcccgctggtggacgcgcttacaacatcagctagatactcatcttgagtccaccttggcgggacactgacatttaacttgcacagtctgggtctctgtattgttgaacctccaatgttagcattcccattaagcacggacttcgcgattccattgaaatggtagatagtgaattgcttcttgcccataaggcctgtaggatccttcatgcctccagcccttttatccaattgtagcagcgcctgccagaattcactccatactataatgccagcattacagaggtcctcaagcttatcagaaggaaaatttatgtcagtgtccctcagaacttgttggaacccctcaacgctaataaagcctccacctccactttgatcttgtgcatcaaatgccctccttattttagattcccgctcttccagctcattctcttcttgaacattgggatttagggcaaaaaggacggagtagtgactttcacttcctaccacccatattggccatttcgggcactttaagtattgaccaaccttgcagaagtttagtgattccagaagggtaaggaaaccaacttcaacatcatttggtatcccattcaggaacatgccaccaccaaagtccaccttgccatcaaatacatttgacacagcctctccacatagcaataaattcacaacttcctgcaaaaatcacactagtcacatttgggtcgaaaacgttggctcaatataactgttaccaaagtgacttcactacattgcaagagtatgtggcagtgtgaactgacacggtattatctactctgctaaataaatatctgcatgtcaatgccatctatacctgtgaagcatgcccaaatggggcagtgaccaatggtaggcttggatcatccctatccgcttgaatacgttcctgtgtacaaagacgtataaattgcaagaaaatgaagataatatcgagatgctttgagatgaccatcaatgagtggaagaagtgacgattaataaaacaaatggaagaaacaaattgatggcaatcatagaaaaaaaatactgttttcttatgagaagtaggaagcataactaaattaccttcatagataacaaggcagaactaaactagccgtccataagatcctaactgaattaacccaaaagctaacctatgtaacactcattatcattaccacattctagaccaatcaactaatctatatttccctgtcattatattactatgttgataattttaactgtagtatgattttgtaatatcaaagcatgcaaaagtcattggtggttatgccagggcatgtacatgaaatttctgacagatttaaatagtgttgtgttcacttattgaacatggattaacagaatgcataaaaagttgagaactaaaggataaacaaaggcataccaatcctcgagagagaagagcagatataaggaatagcatggctcctaatcgactttcaaacaaagaaatgtttgctataagactgttgaatgcatccttccttgaggtaaatgtacttattctaagaactttctgcagatccatagctgagtcaacagaaaggccttccaagactgcagcagttttctgcaataagtttcataagagtatcactggcatgtcgaagatgaaggtataaaaaactcgagtcacctgatcttcaacacgtccacttaccgcttcattgacacttccaatggttgctacaactgctctgttccccgttccgcataaaaatagaatttccagcatggcatgaaccagtgctctaacaaatgacaggaatttgatagcagtcattttaatgtaaagaatattaaggaagcactactctgtatatattctgcaccatgaatatatttcgtgacacatttagaatatcgattgtacattataaatgaaatagtatataacaaaaggaaaagaggaaaatgatagttctaaaagcattttacgattccaataataatatataaaacactgatgttgttccaataaatatttaaatattcatttgtaaaagagttctgttggtaaaacaagggcctatgttttcttggctaaaatttaaattgtcaatccctaatatgaacttgagtggacaaataatcaaaagataatgctgacaccagtattatctaaaaggagcaaaagaaaccacctcatctttctgtcatcagtcagagaagaaaaatcatccctcgcagcaaaagagctctgataaaagcgcctttgtcccagggcataaaacggatcactaacctccggattacccaattcatcagagaaaaacaaaagatatttaagaacataggcctgcattaagaaacacaccatcagaaatgttgagctttcagaaaacagaaataaataatgaagaaatagtttgatcttgtgtctgtctatcagatagcgatacactagtgtcacaaatcaggaaaaaagaattaaaatcaggtcaaggtgaccacacaaaataaacatctaaaaaagctacttacctttaaatagcatttttctattaaatctaatgaaacagcagagaagtccagcctatctcctactaacatatatctgtttgtacattgaatcatcaaagatactttgaatttctttcattggtatctagtgttctagacaggttgcttaggtccagtttgagttgtgaggatcatgtacaggcagtccaaccaaaaaggtccactaaacgtagcttgtgttgacagaacaggtgtattaaaatttagttgcagcaattagaagggtttctcaaatgcatttagtagcttatgtgctacaaataaactgataaaacatgtcacagcatgagaaagaagtaacaataaatatgaagtcagtatggaaatctgagttcagaagaagactggaactaaagattaacatttctgtccaaaagggacaattaattaatcacattatttaggtaaagcaagggagcggtacctgtactgtagctaggacaccacaagggccaccttcatgctgtaccagtcccatggttgtttcaggatcagagctaaatctgttcatttaacaataattaaacaaaagcagattaattgcatagcattgaattgtgcaacaaaaggcatgatatgattaacactgtaccatatccaagcaactgtttgcatctaaattaaaatgtgctgtagtagttctcatctaacgtgcaaagtcaattgctgtacagctctaaccagtcagggactagaatgacagattaaattaactaagagctgcttctcgtgttccttatgtggattatgtagggctgaaaatatcacacttcatcccatcagtagttagcaccattctaaacaggtggacacagacagcattctaccaaaggcacagggattcgttgtgtaattgtgctacaaaaaaaacttctacacataaaaaaaatgcatacagatatgttcaataccacaacagtcctactttcagatgcctcaaatcaacccattaacaacgcatatatggatgatagtaaaatttgtaacacctatcagctcttgttttcacaaatactacggaacaagagctatcctttaaagcctgaacttagtattacatgtacattgtccgtaactgcaaagaaaacacatggtctcatttaacatccaattctgatattggtatgaaccagatcaacaacttcaaatcatcagctgaaagcacaaacaaaaacaccaacagcctatgtatggcagcaatagttgactacaaagaaaaaataagaatgaattttcagcctttacagtttacaaacattgagaaccccgcaaaaggaaaaaagtttacaccagctactatgaccattcttcaaacccgatttatggtgtgttttaaccattcatatcaattaagcaggtgagaaaacgacacaagaaaacagctgtattaccctttataactgcctcggaaaagcaaggaggggtcaacttgtgtagtttagtaataaatattatggagaaagaataataggggtaatgatgcatcgtaagggtagacatccatcagagggaggctggatggagacaacttgacgtgaactgcagtaggtgaaggaggaatagatctagaatatgtcataggagagaccacgtcggaagtataggggttgggatttgtctatagatttttggttgctacgtagaaatacaatccccatccttatatacatgggataacttgaccttcaagaagctgatctggtctaatctctaacaataaaggaaataaataactcgatctaatctcatcagtaaaatgctgctactgccacgcatggtcagtattcatgaataataatttcggccagtgaaaaaagaactcattaagcttttaccaagccatctattttgtgaccaaaatagaaaaattgagtgcttttatatttcccgcgcatggaatatttattaactgcccgccatagacgatactcttgagtgaagctaagcctagttgccaatctgacaaaccacaagcaccacaaatagctcttatttcctaccctacaatctcagtctgaacctctaacataaatataaccttgaatcaacagcgtctaacacacacataaacaactgttcatgcaaactaaaacctagagttgcaccagatcctgaaggattcagggtaacatcctaatggtcatttccagacgtccatccttatactcatcatcagaaatagaaagcatccaagtaatatacactcctgtggtcgattgacaacaccactgaaacagaaatatgttgatatgtatacaatcttacgaccagataacaaaatgctaagcatctcgcaggctgatagtcgtttcagctggccgcagctgcagctgcagctatagtaaccagcagtagagctgtgctgtgactgtgcaaccgcaacctcggatcagctgctcactataaaagccacatcttgcatacatctacacgcatattagtacagagtatccccaacaccccttcttcaaataatgaaggaagaggtactcttggaccctgagaactgcaagcttagtagaccttattcgggttttttttttccttacgttcctaaagcactaggatttgatcattttgttacatctctcaactttgaatttctataaccggaccctttcttcccctaatatatcgaaaagataacagatctcctgtaatagccgtccaacaaaatgaaagaaagagacagtagagaacgcaaggaagaagagctcacctgatgccttgattgctccactgcgccaacacctccttctcaagcttgcgccgaacaccattagccacagcttctcggccacgtccgtaggcaaccgctcccctttctcctcctccacctcctccgccttcgcctcctccatagatacccccgatggccccgggtccgccttcacctccacctccacctccctggcgaccacctccggggccggcggccgcggagccgccgcggcgggggagggggcgaccgcgcggagccgcttctcggcggggccgccctgagctcgcgctgcttgcggcgcgcctccgcctccgcgtccgccgccgccaccccctcctcggcgggcggcgggggcggcttgctccgcttcggctcgggctgctgcgccggcggcgagccctggaggctcatgcggagcgccatatgaagctcctcctcctcctcctccccccgatcccccatccaggatcgatccggggggggctcctcccaaaccctagcacgcgcgcggggggtttggcttggcgctctctctgtcagaggcgaagaagattaccgcagccgacgcgaggtggagaaggtctcgggattcgggcctgtcgcatcgggatccgggaggtggcggcgtatttgtaggggcggcgtcgcggcggcgcggggtctctggggtgtcagagatgcgttcggctgcggcgcggctgctgctgcagtgctgctgcctgctggtgatgggggggattgatctgccgcgcgtggacgccggcggtaggatgccgtcatagtagtcgatgacttgtggggacgggtttgagtctggcccacttgtcattgactgggggtggtaggccgtggggtggccggttggacgttccggacgttttcttttcttgctttggggggttttggacaatctggatccgtcttcaggtctgatttgcgcacgatgccgttggatgcgaatacgatgttcgtgttgcgacaggtcgcattctgattcggtttaggactgctccttcagtcgaggaagactgaagatcaacttttaagttttaactatattaatctaaacatagtctagtccagattcttttgaagagaggatagattttaagaacaacacacaccaacattaaaactaatttggaacaaagaaatttataggattttgtaagtgcagttctattcaggaggtgtttggaaactagggactaaactttagtccctctcacaaaaacattgtcccataatacgaggcgtgtcttcatatagtgattacgtgattattcacttcatcggcattcatacacgtgcgccctaacatttcgtatgtgcgtgtgacacttcattaaccccttccatacacatgtatgcaagcccctaacgtgggtgcatggaattatttagaacgacgtaccgtctccatgcataatacgcgcatcaatcaccgcaattaatcttatgcatgcatcgtgcatttatttacgggaatatcatccagaaacttccttccatatcatctccctaataaattttttacatgcctataaattaggacgggtaatattattttcctacttaatgacgttaaattctaagtaagtgagtgatattaaaggataccatagatgaatcaaaagacaagatggatgagtgatccccgagcgtgaggagcactatcgaacaagaatgtgagaacatacacctattatgaatctagttaatctctttagttgatatgtaggttttttacgataaaagtgtgtcttacaacgatcttaatggtatcctcatgttttggcaaacaaaagtaaacaggaaatcaagaccaaagtgaatgttttggaaataatgaagatccaactatgcaaggttaggtcaagatccaatagtgtttgattgtaccattgaatttaaggaagtccaaactgtgtcctatctgcacaaggcattatgttatattgattcataatcgtcatagtttttttttctatgttagaaatcgtcgcctattaaagtatatcgcaataacttagtagagacataagagatctaacaaccattctctctcatttattgtgtactgcaccattttgcaagaaccatctcttcaaagcagcaagataatttatattgtcaactaagacggaattgaattaagcaatacaagtaaccaatcaggtctaaagtaaatactccatccattccaatataagtgcattatagtacaagatgtaacatatcatagtattacgaatctagatagacgacgtcctagtacaaatgtattctagtccaggatgtgacatatcctagtattatgaatctggatatataggcatagatccatagtactaggatatgtcacacattgtaccagaatgcactcatattgggacatagagagtaaaactcacttgtctctatgataattgataagccattactcaagacatataaagctatcacctttgcacattgtactactgcataatagctacattcatgttcaatatacaaaacaatacaaaggctatatattactaccccatcccatttaagtgcagctaaacatacaaaacaacacaaatgctatatattactacccccattccatttaagtgcagctgtggatttctgtgtccaacgtttgaccgtgcatcttatttgaaaaatttatgaaaaaaaattaaaaatgctagtcacacataaaatactattcatgttttatcatctaataacaacaaaaataataatcataaaactttttcaaataagacagacggttatacactggacacaaacagtgtgaaactgcagtctttctgggatagaggtagtagtagctaatgttgagctttgttaacctagatgggaagactatcttgcgcaaggcgccaaacaaaagctctaattattttggatacacccgcatttcagatcgtagaccaacaaatgctttaccaatttaatcatacgatgtttatcctaattttatttttctcagagcaacacacatcatttttttctatccaatattaatgatcaaaattagcaaaagtggataccaattttatcagataaggttatccaccatcttcattgaatactccttatctggccactccattcacccttatccatcaatcaaacatacttaaaatttgaaaacccttcttcaatggctaagggatatccctctaaatcacacacatgaatccccatcatttggcttatccattttattttgtaaacaaaaataatttatgaataaaacttttatatacgtgttcttaacgatataaaagtaaaggttgaaaaataaacttcggtgaaaaaaccccctaaaatcaactactccctccgtcccaaaatataaatatttttagcatagtgtcaaagtcaaatattagtaaccttgactattaatagtaaaaatataaaaaagattaatcatgtaaaattgatgttactagatttatcattaaggcaatgtttggctaataggatagagaaataattttccacccaccaaaagacatatttaaatcctaaccatccattccccctctcccatttaatcctaacccttcattcatttcccaatcccgattccactcctcattttccattatccaaacacaccctaaacaaactatcagaatatgcaactctttttatttaaaacatcttacttttataaacatcgttggtcaaagtagcatatctaccgtgcccacctgagctcgcttcgccgccattggcagcctcccgagctcgctcctcctccgcctccaccgctggccactcgagctcgctttgccgccgccacccacccctgctaggtccgcctccgccgccggccaccgctaggtccgcctccgccgccggccacctgagcgagagatacttccgcctccggtcacctgagcgcgcgcgcgagagagagagagagagcgcgaagggggacttggagggatttggttgaggaatatgtatgacatgtggtcccagggaattttttttattttctttgctgactagattgccatgttggcaccatatgtataagctcaagtctaaactgctaagaacagtgtttagggaggttatttgtccggtataaatacttgagggtataaaatatttggttttatgatttagggggataattcgatcggcggccgtgatagttgagaagtaaatcatacttttttttttctttctgaacgaaaagacgagtctggtaagcaaaccaccagccacacgcggaccggtacgcaaaggtctccgatgctcggtcagcaaaactgctgatccgtaaaatcaccaatgttcacatgcgcgttttcggcggttgcccctgccgaaccgaactcgcgctagagtacgccacggctgccggtaaaacaggccaagaaacgaaacgaaatctaaacaggccagacaaccacgcagccgcacacgagagaccgagagacagagagcgcgagcacggaatgctccgcagatccaaccgccgttcggtcccccgttccgtgcagctgcacctgcatatagaaaagtagaaaacccaaaactccgtagcgaaatctctcctcctccacctcctcgcctctctctccctctctctcccctctcatcactctctccccacccccctcgtcgcctcgtcccagatccggacatggcgagcgacagcgacgtcgacgaggacgagctcctccagatggcgctgcaggagcaggcggcgcgtgacctcagccaccagcgccccgcgggggccgggaagcccgtcgtcaacctcgtccgcccccctgccaactcctcccgcggcggcggcggaggaggacgcggcggagggggccccgccaaggcgaggcagcccagccgcggaggcggcgacgacgacgacgacgactccgaggtcgagatgctgtccatttcctccggggatgaggatggcgccccctcctcccgtgaccgtggccccccgcccccccgcggcggcggccgcgccggggcacggcgggccgcgtcgagggatgatggggatttcgacgacgacgagcccaggagctggaagcgcgtcgacgaggccgaggtatgtggggggagatcggcgagatctcgatctcggccgctcgtcttccgtgctagttttttgggggtcgcgtgctttgatgatccgaaaattttggttggtctcgcgggtttgttaaggcagcgagccgagtagcttgttatgaacatgtcagaatcgtggttgagtgcatttagctagtagtgtaggttatgaaatttatgctggtttgatcagtttgtttctgttccttctggggatcgcacaaattagctgtggtgctgcagagtggagctgcttgttgggtcgcctggggggggggggatttgggttaattcctaagacttgcctattggtgtgaactctgggtactggtgtgtttcaatcattcatgttgtgtagtactatgatatatggaggtataagggattaattaatggacttatagacaacatttttacaagtttgctggtctgacacacaatgcttggtcatcacatcaattgcatttgtgcagcgtgcattactgttggcacactctttcggtatagttcattttgatttccttctagctgcacattcatgttattcaaacctcctctctcagcttgtttgaaattgaatgccatgcttttcattttctctgttgttgcatttgttcatgtatcatttcatatctgcattctccatattagatgttaaatgcaccaaatacaaacatctgttttaacatgttatcttgtactgaatatgcctaatgtcagtctgcctttgctccacccagcttgctcgcagggttcgggaaatgcgtgaagggggggcagctcctacagttgatcagaaagcagctgctgcagcaactcggaaggcacttaccaatgtacagactttacctagaggagtagaagttctggaccctttgggccttgggtaactatctggatcacaaaactcatggtcaatacatgacacgcatcatcttcttttatatattttttccacattaatgtaccacttgaccacttgataaacattttataaaatgcaatcacctcatacattgatagtatgttagatagcaaacacattcactggttctaaaatttttgaaagtgagctgtacgtaaccttactgaaacatcaaactttgtattatcaatatattttggcagcaacaagtattaacctcatatatattaataatgtcctgctctgcattacctagtacatgtgtggtatgctctttatcatggagaattaaaattaccaatccaatgtcctctctatattcgtgttttaatagcatttattttcttaccagagtcattgataataagtctctgcgattaattactgatgcttcagtaagttctcctgtttcaagggagaaggctcagggtttagaccccagtatgcgaggtatgccttttggtcatacatattatttcattctgttatctgttcttccataacaagggtatgtttttatttgcagagaaagttatatattcttctccgaattttgaccccaaggtttttctttcgtgggttcacaaagatacaagtgctgctgacttagagtctggtgcgcttaccttgaaaactgatctcaaagggagaacacagcagaaaaaacaattagtcaaggagaactttgattgttttgtttcgtgcaaaaccacgatagatggtatctgttccttttttttcttcttctgctctgttgtagataattctcatgatcttaatttttgcacctgtttttaataccgcgagtttttctgcagatattgagtcaaagctgagacagatagaggaagatcccgaaggtgcaggaactgctcacttgtactcagtcacccagaaaattagtggtgtagcaaaccgtgcatttgagcctctatttgagaggcaggtataccaactaagttttctctagaacttcatttcactaatcatggtcattattactgcaattcttgagtgcggtaacgtaaaccgttgtgcaggcccaagctgagaagatcagatctgttcaaggaatgcttcagagattccggacattatttaacctgccaagtgcaattcgtgggaacattagaaaaggagaatatgacctagctgtcagggagtaccagaaagctaaatctattgttcttccttctcatgtacgtcaacttgatttattttatctgcgtctgttatttgaagatattagaagtggtgggaatgatggggatgggtgccaactgatcatagcgcactatctggggtaccgacacccgtaaagtgaaaaacaatgtgatttagtgggaaccacaatacccatcaggattcttacattatcaccgtcttacactacttctagtttagtaacacaagagaaacatgtacccgttctttttatttgatggctttgacctttcacggtccaagatgtaactttgaccattagctatatattgatatagtattatgagagtacctctcgggtacatacctagtgttacagtttcgtatagccaatctcgagttctcatgtattgatgttcaaagtaacatgggttctaggatgtcaaataagaaagaaagggtattgtctgacctacaggtagcatgggtttatcaaagttttaatgcggttgcattaacatttctgttgcccctgtttttctttttggctattttgtgggacatcccttaaccatttggagatcatgagaaaagcatgaaatagttttatgttggattaaaaatgcgatgaaatagatttgtggattatattctctttcttcctttcatgatggctcatatgcctgatacatgctatatgattttctttgttttccaagatcaattatcgtatgcttctttgttctttccttgcacaaaaattttgcatattgtttcctgttcatgccaatttcttgcacatgtatttggtaattaatataacatcataataactaataacattacatgattgattcacacaaagatctaagaaatccatagtttagatggctcatgcatgtccattacttgattttattatctctctattgtatgacttacaaaatcttgagtattttgatgctggagtaatagggactaaaaatttaactattgtcttgtgacatcccttctattttaggcacaatacgccacaacaaattgttgcttaagcacatccagtatttttactatattctttttatgatgaataactgacacaggtggggatactaaaacgtgtacttgaggaagtggaaaaggtaatgcaggaattcagaggcatgctttacaagtcaatggaggatcctcatcttgacctcgctgaggttagttgactttccaatattcaatgtagaatacttgaagttccttactagtgttgatagtcaaatactcaaatatcactcaactcgctaattttgattatagaaattttggtagttacatgaggaagttacttgatacctacacgtaggatgctgctggctgtaaactgaactactgatcgctagttgtttatatttatgctatttagatacaatatgattcagttctatctgcctcctgattttcttgccaactgccagcttgagaacattgttcggctactgttggagttggaacctgagaccgatccagtgtggcattatcttaacattcaggttaacgctcttgaccaaaattatctgtgctttatgtcatggccatacttgcttgtaccactacttatatgttctatcttcatatcttctcagaatagcaggatccatggattgtttgaaaaatgcaccttagatcatgaagcacgaatggaggttctacagaataaaattcgtgagaaaatactatctgatgcaaaatggaggcaattgcaacaagattcaaataaatcagtgagtagtttgggttcagcatagcactcatttgatcatctactatgatgctacaaatttacatggtatttgcaccttgtcttagttaacatggcacatgttccttatgtttgcatagttggaagttgattctgctaccggtgactcttttcaagatgatcaactgtcaacaaatattatggctgatgaagctgatagcttaagggcagcctacattcgtaggttaactgctgtacttatccagcatgttcctgcattctggagattagctttatctgtcttcagtggaaaatttgcaaaggtatgaatgggtttagctttaacatttgtcagatatagttaagatcttgctccaaaacatatgaatacatatgaaccttttcatcccacctcttctcatagattgcaatgcgtatgaaataagcgccttttatatatttttttttcatatagtgtattctgaaatactgtgcctgcttcatgtcacctcatgaaaaatgagaaccaccatctttttatgatttatgagaaagacttacatgaatttgttacccgtatctattgtttacaggcagctgcggggaatgtactttctgattctgatatgaatacaaaacagagtgtaaataagactgatgataaaggtggagaagcaaagtacacaaaccatactcttgatgaagttgctagtatggttcgtgctactgtatctgcttttgacaccaaggtagagttactgcatgttttgcaattctaacatttaatcagaacccttagtggtttgattgtatttgttacaattaagcatgtttttatatcaacaggttcagaatactttccgtgattttgaggaatgtaacattcttcgtccgttcatgggtgatactataaaagaaatagctaaggcttgccttactcttgaagggaaggattcatctccaactgctggtatattttattgcccttttttagaactgtagatacacttaacttcttttgtatactgaatgtggttaacaataattccagtgaaaatgttgcgggcccttcattatgaaataacgaagctttacattctacgactttgttcatggatgcgggcaacaactaaggagatatcgaaatatgagacctggtttactttaaccacccttgagaggaacaaatctctatatgcaatttcaagcatgcccttggagttccgtgatatcatagtttcggcaatggaccgcattgatttgtaagcatattttttgttcaatattgcactttctctgatgatatcttatgcatgctgtaggtataattgtttgtgctattaatgggtagtttatgatttcaatactgtctgtggaatctaataatggggaattggggatatttagtacagtaatattttgccattgtgttagtcgaaaatagattagatacatgcttttgaaaagccatggcaatgacaaacagacctaagcataagatttgtcctaaagtaattgttaggtgtgcttcacataatgaatacttctagtttgttagttcatatcatatcatggctatgaaatcagttcttcgttgtgatttataatggtttgcttacaatcctattcactgtaagagaactgaatgttgttttcaacttgttaataaaagaatgataataaatatcaaattgtatattgaaataactgcatttgaagtgtgcatttttacattcaagatcaatctaagtcttgagnnnnnnnnnnnnnnnnnnnnnnnnnnnnatcgtgccttcattttttatggtttcgaactgcctcctgatctatgcttttctattgcagtatggttcttaatctgaggagtgagactgccaagtccacgatatttctcaacacctccatgaaattcatgaatctgtcagacttgcatttctaaattcttttctggattttgctggtatggattttctttgtaacgtaactactgaaggtcttacaaattttgtatctaattgttgcatcatccattattgacaagctgtgttagtgcatcaggttatctggagaggtttggaggggaactagctcagaacagatcaaataaagaaaacaaccatacccaaaatggatatgtaaatggtactaacagtgaaacatctgctggcatggatggggacttgtacaagaagctgttggttgttctgagtaacattggatattgtaaagctgaactttcagatgaactgtataccaaatacaggcacatttggtccccagtcaggtacccgatcatcttagcttatgttccactaacattgtcttactgtcctttataatttttggtgcgagtcgttatccctgaatagattgattgaaagcttgttatttcatctaaaagcaatgctttgatacatttgcttcactcagttagtgttcctctctcagggataatgatgagcgtagtgctgacatgcgagatctgatgacttctttctcagcacttgaggagaaagtcctggaacagtatacatttgcaaaggtatggtagaaaatccagaattgttgattaatcattattggccaaaagatttagttataaccatgttagctttaatcctttcgtgtcttggtgtgcaaagttacaagtttgaaacacctgatttagcccactatttgttcttcagtagtggtatgcccaaaaaggccttaatggaagtaatgatcacttctttttctgaagttgttctatgggaatatctgcgtagacatgcacatgcctctatgcgtctactggttgatctgatgtgaatcaaatgaagcatttaacttattgcatgtttattcaagatccgttgcaatatgtagtcctaaataactaatagctagatcaaaatgtgcatagttctattttctgtgactgaagcattttattattgataccctagttaatgtgctagttttggatttattactacctccatattttaatgtatgacggcgttgactttttgaccaacgtttgaccattcatcttattcaaaaaatttatgtaattatcatttattttattatgacttcattcgtcatcaaatgttctttaagcatgacataaatattttcatatttgcacaaaatttttgaataaaacgaatggtcaaacggtggttgaaaagtcaacggcatcatacattaaaatacggagggagtactagttattactctggaatatgtcagatgtttgtccacttcatagattattatattgtttgatgactaggataactttaattcaaaattgtttggaatgcctacagtggaagttcatatatcatgcttgatagtagcatgatttttggggctataaattcggagtctatgcacattttgctatcttcctttgctttgccctaatttttgttttgtagtcgaacttgatcagaaatgctgcacgaaactatctgttggattatgggattcactggggagcagcaccagcagtaaaggtatgtagcataattaagataatcgtactgatgttaacgcttccaaatgtgtaccactaaaaaaaaactggaaacaaccaatagtatactactgatggatagtctgtaactttgtatatgcagttcagttgcatgtactatattatttgctgcaagaaaattatcataatattttgtgcctgcattgctatgtgctggccatggctagtagttgtgtgcgcatattaatggtagcctcatataacagttgtacgactgcctttgttatcttacatgaaattaacatcttgataatgctcttgtggcatttacattctattacaaattattcttctcgcagggcattcgagatgcagctcttgatttactgcacatccttgtagctgtacacgcagaggtttccatttctacatttcccctgattattaaaattgtgcatctctccttcgcactggatgtacatcaattactgataaatcataaatttacttcaattgctctttacatactttcttctttgatggaatactgtatctgtggtttcaggtctactccggtgctaggcctctgctggaaaaggcgatgacaattttggtagagggtttgattgatatcttcctcagtattttccatgagaataagaccaaagaactcagaatgttggacgcaaatggtttttgtcagctcatgcttgaggtactaattttgtttcttttagcttcaactgcattagcctcttcagagtcttaagttgtgtaaacgattcaattatgaacttaaagaactgttctgtttgttttacgggtgcagcttgagtattttgagactatattacggacatacttatcaactgaggcagagcaggctttgagatccttacaagagaatttattggagaaggcctgcgaaagtgtgactgaagccttggagaatcctggacaccaccgtcgaccaactcgtggcagtgaggatgctgcatcagatgatagacaatcagtatcacctgatgatctgcttgtaagttctaaaagatgtagaacatatggattaattcttgcatcagtgacaactgaataacacttccagtaggttctgttgcattaaatctgccaaatatacatcccgtttgcgttaggcatctatattctcattgccctggattttgaattttggaaaacactaagtcaggacttctggtgctttcatcatctaattatgggaagctctctttagtgaaagtttcatcctgttctgattttgcaagggagcatggctaaccaggaactatttattttttatttttcccaggcacttgctcagcaatgcagtagcgatttgcttcaaggggagctggagaaaacccggttaaatattgcgtgctttatggagtcaactcttcaatcaacgcctgcaccggctggatcaaaacctgctgcttatcagtcatacaaggcacctgcgacacaccaaccagttcaagtgtcctccccaagttttagaaggcagcagacaagtacaaattcacctgcagcctcgaggcggcgtcgatgaagaaaatgcatcatgttgagagaaccattccttcatctacgtgcctcttccctaaattctcctctttctttgttcatctttcccatgctttcgtttgttacctgtaattagtatcatgttgtcatgtattatgaattttgacccattcttttggtgttgtaagataaaaggggtgtacaggggttgctgtacggggctatctacttgtataatttccatgagcctggaattattgtcgccattttttctaaagacaccatctcaacttaactttctggaactgagtgtcagatttgtcggtggctgacgaactcattagtcattaccaccattggacctcactcttccgattttctatgcggacttaaatgtgtcttgtaccaggctgaaacgatagttggagcacgcgatcgatcttatttgattcgtggatctgaatacctttctttagtctaatgtaacatgtttttttcttccttctcgatcgatcattttgctgtttatacgactaaacgtggaagccccccatccccctttgttttgttgattagttctttttgtttgaatcaaattattacattcttgatcgataatgatctcttcctcttatcctgctgtcaaaattcctgaactcctgcacgcaccacgcactacacgattacattatccacaaaaccaccttgcattacacccccagttgttatatgtacccaaagattcggccattgcatccatgttctccatgcatggctgcacctgaacttgtcctgcactcctgctgctccaccatcgctcgcacgtgccccaggatcaatgagcctctcgtggccctttttcttttcttttttaaaattcccctcctccagctgtgtccggtggtgtctcatctctcatgtgccggttgatagatactcgggctttgtttagttctcaaaatttgttttccaaaaacattacatcaaaatctttggacacatgcatagcattaaatataataaaataaaaaattagttgcacagtttctatgaaaatcgcgagacgaatcttctgagcctaattagtccatgattaggcataagtgctacagtaacccacatgtgctaataacggattaattagacttaataaattcgtctcgcagtttccaggaaagtcatgaaattagttttttcattcatgtccgaaaactcctttcgacatctggtcaaacatccgatgtgacatctaaaattttttttcgtgaactaaacaaggccaacaaggcatcagactataaataggtgataccctgtgcttgtactactgtctactgctccctccctccatcccttgctcgctcgcgccacaacgttatcctctcctcgtagatgtggccacagtttttgcagccggaacgagctgtccaggctactactcctactagccatctcccacccacttatcacgaggctaacccgcatgggcgcgcgccaaggaggcgggaggagtagcacaccgccaccatcaccagcagcagcatggtgcagctgagccgccgccggcaccgcgagcacgctccatagccctctgccatggcggcagcttccgtcctcctcctcctcccttcccccttcctccgtccgtcgtccccggcgcaccgcgcgcgctgcggcattgccaccacgacgacgacgagcacgagcgggaggagggggctcttcctcttcgcctcgcgctgccgccccggcccacggcgacgcgcggcgtcggcggcggtgcctcccgagcacggcttgtcccagccccagccacaggcgcgggcggtgggctcgtacgaggccgccctcggcgacgccaaggacgcgctctacgccgctctggaaggttccatctctctctctctctctctcgcgcgcgcctgttgctgctgcctgctgctgattgtcaactgtagcagcgtcgctgttcgatcgattcgctggcagcctattgattaattttatttttttgcctgtttgatgctttggaggaaaggcatgaacagagggatattcgggatgacctccgagaaaaggtcggagattcacgcactggtggagctcctcgagtccaagaacccaacgccggagccaaccgacaagctgcaggacaaggtattactacatacatgccactttccaccaatgcgcttatgctactactaatcaattcgagcgttaatttggaagtctgatcacctgatattgatcaggattttctttaccttttgagtttatgatgagcagggattgttgttagaatctaggtggaaataggtgtgtactagtttaagataaacaaatgtagtatgaaattgcctctttggtaatgttactgatagtttggtgttgagacgatggaaggtggatggatgctggaggctcgtctatagcacgatttcgatactggggaagaagaggacaaagttgggactgagagatttcatcagcttaggagatttcttccagatgattgatgtcaaagaggttagtgaaatttaccgagaaatgttgtcaagccaaattggtaacgttggtgctgtgcttgtttgctgtatggcttgttctatgtttatgcctgaatttacaagtttttcatcggtgtatttctcctatgttgtatagagtttgattgagtagaatttgacttcagtactcttcaattcttggacaataccaaaatgatcaaaacttatgttggctaatggctaccgcaacggaagtacatgacaaatgctctgtttcctaaaaagacaaagtacatgcttttgtgctataagcctattaactatgaagtaaatgttattgaaaaagaacagtgaatattgttacatgatttttatactggcaaaccaagtcagttttgatttttgatatatcttgaaataaatggagatttagcatcaccttctctacacccaaaggaaaaggcggtaaatgtgataaaattcagtgcaagggcgttgaagatattatctggccaacttactattgaagcttcgtacaagataactactaaaacagtaaggattctatctgcttctcatcattggttacgtcgtcctagaaatttttggaacctgaccacttaaattctgaagcacattattcttttatccaatttttgttttcagaaggttgatatcacgcttgatagttcgaccatcactcctgatcaggtataattcatgatattttcacttagaaactagcttcatatacataagcagtacttcaatactattggaagggtagagttatgagtcaaaacttttgtaacaaatctttttacaaataaccttgagcagaggcacattgttttccttcacaggatgcatgtgcaactgtgtgtgatgtctattttcttctatggacataagtaaccattttaattacaccatgtaaagcaactgtaattttctctgatgttcactttgactgtcatgtgcagctgatgaatattttccagaagaactatgatatgctccttgctatattcaacccagaaggctggctagagataacgtatccttttcggcttatgtgaaactgttttgttcttcgctgtttttctaattttacaatctctgctacaaatcactagtttccctacgctacattttttctttccagaagtggtgtggatgcttttaacaccaataatttcgggtagcacatgtatagcagcagagtaacccaatttgcatccagattccagagttctcctcaacattttggtcagatacgttgatgaatctctacggataggaagagatgacaaggcaaacatctttgtgctggagagggcagacccctcagaagtttgacaagatttatctgaagcaaaatgcctgcatatacatggacattccggcaaagatgcctttgcacatacccgtcctgtaacacggtggtttttaacagccagtgcagatcgtgtgctcaactttccatttgcgttagattatactactgctatttttttttctttctggagcaaaaggcatttccctttgcgacaaaatcatgcaagctgggaaagctcatgcaagttcagttacactacatagagaattggtacattaagaactggtgtacttttgaattttgaaatacaccattttcaattattcatccttgtaagacataatctaatgagtgtacagcttggcaaatggcaataccctttagacaaagttgttgttgttgtttttttttttaaatgatcgctgggtgatcccttatatcagctctttgttcctgccacgccatgcgtcatgtaataataactgggcggaaagaaattcttgcgttatgtcattttggtggagctttgcacctttcaacaaggacatctctcttcgagtctttgcctcgggtagagactggaaatgccggaaaatattttaagcccttgatgttgcatattctcattttttatacagtcacgtggagcattcaaagtcaaactgaacatcacatggagaaaaagcaacatatcaaactacacaaagtgatataacactgaatttgttatttttgtttttccatgtttgtgaagggatatgtagcacaactcgtttatgtttgtccatttttttttataaaaagtttcataactatttgtactatgtgcaacaaacattttaaaataaggtatgcgataaatatacttccgtaagaaagcatctttatctacagtctaaaggtgcattaatattcgatggtcgaaagaagctagcatcaagattctctctacctattatctaaagatgcatcatttatatttgacggctaaaagaaattatcatcaagattatctctatctattgtctaaagacgcatcatcatctgtgatcatcaaaagaagccatcatcaagattcctgaaaaggcctatataaaaatcccaagagaagccaagagaagtgaggatccacttttggaaatgctagactttgtttgcattatatatagagtgactctaatccatagaggaacgtggagagctccttggaggggtgcaccttcttgcgcgtcgagccaccatcgtccttgttggctcccgctcatcatcatccaaatctagagtcggcctcaaaggcaccgtgcaatagtggcatggcatcataaccatcgggaagaggtggcgagacgaggtggcaattcgttgggcgcaagaccgatgacctccctcaactgccaccaagcgaaacaacaggtcgtgggagccctgggcggtagaagcagtaacaggttgtgcgggtggagaccggttgaggccacatctatcttgcctccactgagtgcggtaagcttcacaacattccctattcaccgcttccgtgggcacttctcgagccgccgccgtcgttgccattcatccatgctaccaagcttcgaggatgttgcctccataattggatccatggtgccgagcttcaggctattgccaccaccgaggattcacgccaagctccttggccgccatcaccacaagccgggtcgcgctgtccgctcctcctccaccaccgttgacaaccacaacaccatcctctccggccacccacctctaccgccgcattcactggatttttcacattttgatccttttgaaaaacttatttcgcaaatagacctctgaaaaaacttatcccagaaatggtcctttttggggcgccagagtggctggcgccgtcatccaacgggac

SEQ ID NO: 3052 - DNA, 19221 bp, Oryza sativa
ggcgccgtcctgttgaacgacggggccagccactctggcgccccaaaaaggaccatttttgggataagtttttctagggatctacttgcgaaataagtttttcaaaaggaccaaaatgtgaaaaatccagccgcattcatgcagacggctggcgagttcgagctcgccgggtctcttgccaccctcctcttcttctccgctgccacgaaccaccagagcccctcgtcgtcaacctcccagtctcccactgtcactgctgcctccagcggacgggctcgccagccaccgcccctttccctgccagctagctcccggggaagagaggggataagtggaagtccacttacatgtggcccctacatgtattttttttctaactagaatgccacgtcagcaaaaacgaccatccatactgtcttacaccgttattcaacccagttttgcaaaacatcagggttcgaaatttctagtatcgcggtttgaggatacgattcaaaacgttaacatgagggacctaaagggaacttattcttccccgacaattataccggctctcatgggcctacatgagtcgccaggtggtgtagttgggcctgcattgagtggttgagccgcgaaaggaagcccataccaatggtagcgcgcgaaccaattatacgggctttgttgggcctgcaatagcggaattaatccagctcagtgacgtctctttcttctccgggattgatcgccggcaaattaaacctcgatctagcggtgagctagcgccatggggcatgataatggtcgcagaggtgaagtcaaaatgggtgtgcctctcattcaacgatcaacttcagatctagactcaaccaaaccccttaatttgaagccacatagcatgcaaaacaagagatcagtattaggaggcacatacgcgtggcgtgatctagcaaagtgtgttgatctctcttgttctctttgtgaagcaagggcatatgagtgcctctgctgcccacgcttagttctctcaaaataaaccgtcgcaagtttttttctaaaagctttgaaatgtacctataatataattttagttcaactacaatataattgtactatggtggtgtttgaatctcctgaagatgaagatgaagattaagtgtttcacgtaaaacgaggtggtaataatgtgtgattaattaagttttaattattacaaacttgaaaaacggattgatttgatagtttagaacaactttcatatagaaagtttttgcacgaaacgtaccgtttagcagtttgaaaagcgtgccacgagtatccaaaatttaatccaaaagttgttggagaaaagaacatggcctatatataactataccataacctctaaataatttatgtatgaagttacaggtatttttttttgatacttgtatataaattagataaaagttatttataatgtgattataatatagttatatagtgtaattacagtacaattacattataattatattgaatttttttaataaaaaactcgtatagtccctaaataaatcgtcgagggttgtcaaaaacacacttaaatctttcttgtttaatcagtgatggagccagaaagttttttaaactagtatttgcttatttgctatagaaattttatcatcaatttactgtaaatatattgaaatttaatgaagttttcgtcggtgagcctgggcggtggctccgccgctgtgtttaataaagaacgatgtgcaacaaaatctcatataaccatggatattcggatgacaaaaaccgggccgaagagtagtcatattcatccgtccacgatcgatccattcgatcgatctttcgtttttggtgtctttgctattatctagcggtgaccgcgatcttcatcatgcccttgtcgcagtcgcccgggaagccggagacgaagaaggtgacgccggggggcagcgcgacgcggtcgtcgccggagccgtacgccgtcgcgttggccggcgccctgcacagcgcgtagtccacgtcgcccaccaccaccacgttgtgcgcgctcgcgtcgtagctgaacactgcgttttacacgcacgccgcccgccgccgccgccgccgcgggcgccattagcaccggccatgacggatcagtttcagtaaaaagaagaagaagaagaagaagaagaagaagaagaagacagatgaagcaagcagagggagagcaagctaagctagctagacatggatggagcaattagctaccgagcacgtcgcccgccttgaagggcttgtagttgggccacccgacgacgccggggctccagccggcaccgtcgccgacgggccactccctccgcgccgccgccggttcgacgccgcattgcagcgccaggatgacaaggagcaggagcaggccgaggtgaacggagcagatggccttatcgccgccgcggccgccgcgtgccagcgccattggagcaggagtagtctcgagcgaagaacgcggaagagcttaaggctataggcctcggtaaaagtccttgggtcaaaggctctccttttgtggcaacaacaggcctcctaccattcttgctctctccattttataatataagatataatttttttctagatattttataatataaaacgtccatacatactatatagaattagctagcacatcctccttattgaaatataattaactagtacattctctaattttattgggtacatatattgtatttattagagtgatttaagctaggaggtgatagtaattgttttttaatgtttggattaaggataattatacactatattttgaaacggagggataataatttaaactcttaggcaaaacaagggataagtgttagcaggtattaattcttggcttcttgcctttgtgattgctcattgctcatcatcaacaccgggttcacattctctaccataatgatactatcattatagatactaacgtgtgggacaatagaagggtagaatccatatgtcaatgattgtaatggtagtaccaccacaaaaatgactctggtcctactctcattccaaggctttcttcgtgacgcttctagcatgagaggaaaacctgatattcttagagtgtcatttattttagaacaaattttgaattttaagattgtacttattttgaggtggtgtgagtatatattttgtaaaccaaacaacatttcacattgatttgtgaatgtattcagagctttaaatgcacaacggtttatacaagaattgttgaaaagtattttaatagaattcttgattttttagtgcgtgggttccatgtgcccacttactagtatatatggagtgcgttcatttcacttcaaactatatgtaaatatcattctcttgatccgttacaacttacaagcatacaaaattaatcatcttgaccaacttccttcctaattggtcgaaatgcatatatatatatagggcaggaaatcttttttctgccgtgaggactaatttcactacttgatgcatatgaattcattttttcttttaatccacggtcgagtgcgacgtccttcaccggcgagcatgcgttgcgtatagcttgttaattattgttacgacattactagacagtttgcatctgtacattagtggtttcttgatcatcatggccgtgttgttgttgcagcacaggcacagcttccttggctggatgagatgatgatgatgatggtgatgcctccttactctttccccagagaacgaaatacaggcccatgataaccaaagcagaacctatcacactgcacatatatagctagtgtcaaataaaacatgatcaatatgatgacaatagtaattactcactccatttcagattataagtcgttttaactttgtaatattactctatttatctaaaacttggtcaaactttaaatagtttgactttaacaaaagtcaaaacgacttgtaatctgaaacggagggagtaattaaacatgacaaatacacataactataacgtactaactccgttttaaaatataatgatttttagaattcaaattttataccataatataaggattcgatcatacacttattgtcatgattccaaagccaatcacatgcttgcaaagggaatataagtaattcaaaatttaagaattgacaactgaaatgactaaaagagaattttaaacaagctaaaaaaatattatatttttaaaacggagagagtacttacgttccaaggtgaagttgctcacggagaacgatgacgttgatagcagctgcaatgatctggattagaggcgtgaatgcagtcgtgaacaccggccctctctgctccacacaccatgacattgccaagaaccctattcctgacccaactatcccctgcatatatagatatcaattcatccatccatcagttgcaattaattaataacaattgttctaattaattaattaaggtatggtacgttaaaacgcactaagaatgcgcaataactaaaacatgctccttacatagtaaaatttttactgcgagttatatcgttctcagatatcatattcttcctccgtttaaggttataagtcgttttgactttggtcaaagtcaaattgcttcaagtttgaccaagtttgtagaaaaaaatagtatcaacccgagacaaatttattttgaaaatatatttaattaactaatttggtattgtaaatattactatatttgcgtataaacttagtcaaacttgaagtagtttgactttgaccaaaatcaaaacaatttataatatgaaacggatggagtagtaaacattttactactaggctcaataagagtatccgacaaatttgactactaagctcaataagagtatccgacaaatttgactactaagctcaataagagtatgacaatgattgctctcgcagttaaaattatacaatgttaagtttgttttagctatattgcaatataggtgtagtatagcacggagtatatctatagtcacgtaccacaaagagcacggtgatgatctgaagcttggtccttaagatccatgggggcaagctaaccctgtcgatggccaaggcgaccacggccatctggaggaagctgaggaagaacatcagggccgtccccgagtagagagccgggtacttcctggcgatcctcgactgcaggatgaaccacagcgaccagcaggccgacccacccagcaacgccaccgacccgatcgcccatctgtgcgcgccgccgacatgaccggcggcgatcaccgccgccgatgccatcggagaggaagaagatgatgatgaagaagatgaagatgatagcttggtgagcgatgggccctggtagagagcaaggaccattgctccgctgaatcctaacaccgtgcctcccactttagctatgccagctatgttcaggttaactttctccagcctgcacatatttcaatcttaaatttgattagaaattttaagtatctcaagatatttaaattttacactattttttttatctcgggatacttagtaccgaagatactaaaatctaagtaattttatcatttttgaaaaaaatattagaaaatagcatattttctagtgtaaaatttaatacatatacttaagcaccgtaaattttctatcaaaatttacactagaaaattcggtacctatcgataccttctcaaatatggtaaaattaccctaatttgttcttctatactcatttcatattttcatgcataccaattaaaaagtcctgttttccatgcagatgtatgtatgttttgagttagttaattattatatattctagctagggggaaattaatgaatgaatgaatgaattgtaattacccataaggcagagctacaaggaaggtgaagatgggagtcatgttgatgaaggcgcaggcgaatgttgcggtggtgtactgcagccccaggaagaagagccactgggtaagggacgctctgcacgcaggtacacatttgatttaatcaattcatcatttgttagtgcatatatatacacatataatgatctttcatcacgttaattaaactatctatgtagtgtatatatgaaaaatgacttgcccgagcaccgcactgaagaagagatacaccaagatttcagctgttagctttggtcttgtcttcctgcatccattccatgcagcacaatatatatcagttaattccttaaaacatacatctatatgttactatatatacagctacaatatatacaataacaattgtcgctaattaatctatcaattggcatgctaatatatactgatcgcgaattggtgaagaactgaatcgatcagaaattcagaatgcagatatgctatatacctctcccggaagtaggcgatcggggcgaggaagagggtggcgatgagctgacgaagcgtgatgaggacggtggcgtgcatcccctcgttcagggccatcttgatgagggtgttcatcaccgcgaacaccaccacaaccccaaccattgtcaatgttggcttccaactattgcagctacccatatcgattcaggatcgatcgatctctatctagctgatcaatggctagctagctacaaagctaatctgaaatatgtgtgtttgtgtgtatatatatatgtggttgttaattgctttggcactgctaagtatattggcatcaaggatgctgcaggtggcaagaatttatatgcatgcctgccctggcctccaagtgatgacaatctgacaatattccgttccttgcttaattacatgtatcacgcggtacgggcgtatttgccctttgctttaattaggtgcactcaagaatgatgccaataaggtatggtacgaacaaatgtattagttattaattagctttactttaattcctacaccactcaagatgaacaatttataattaattatcacctgcatgaccaaaatattttttttaaaaaaagctgaagaatttgttcatcaactttatgcaagcattttttttaaaaaaaaagaggaaagagaggtttggattctttggctagcttggaaaaggtacgcgttagattacatatataattaacaaggagtaatgatcctaatatatgtatgtgtcaaagacactgatgaggagagatcttccaaattaacacagttgttagtatatgcaaattaatccggcctgttcttaattttctcctgccttagatcgatcatatctatctaatactctagcagtggttaattttgtcctgcagctttaatttgatcacagggagagggatgctagctgtagatatatatatttatcaaaggccgacagcatatgtacagggagattgaaaggaaaagagatgctttctttggtgcgtcatccgtcgttggtcagcaaggtgacttgaggggaagggaaaaaaagagttaaaggtcatatagacttaatagtatatgctccaacaaggaaaagaatgatcgttaaaaaaagaaaaaaaatatgtacacctcaaattgacacaaatatatagtccctccgcttcatattataaatcgttttgacctttttctaagtcaaattttatagaaaaaattagcacaatcttaaacatcaaatagatgtttgttttgtgttaaaagtactactatatttttttaaaagtttgattaggaaaataattaaacgacttataatataaaacaaaaggaagtagcaaactatataaatcagataccatgcatgcatatatagctgggccagctcttttctcttcagggcatccaatgctcctccattgttgaacaagtattgatcatttagaacattcaatgctcgcatgaaagaattgatgtgccattttttttgccagattgaacacatgggccggccgggcgacccctaacaattctgtttacgttagtcatcttcatggcatcttagaccgttcttccctcgatgttcccaacctcactactctcattttttatgtgctctacccaactgctaaaagatacgtttctttaacaagtgtctatacaaaagttttattttttttcaaaaacatgcaaaaagatcgcatgccaatatattaaaacgagagtttagttacacactgtatataaaaggtgctataatttttaaaattttttaaagctaatacttaattattcttgtgataattcatcgatttttttacatgcgaagagaaagggttttcaatgcctccaaaagaacacggtctttaaagaaagagaaaatcccctatatacctatgaaagttcacataatcccttctatacccctgaattttgctcaatcctttatatacccctgaattttagtttggatccctttcatgccctttccgttagttgaccgttaaattcttttgaaaaagtccattttgccctttgctatgaagaaacataataaattaatgaagtatattgttggaatgtaaaaatttattggatgagactattatatttatgagtatgtgatgcaccatattatttgtgacaaatttagttttacatatgatataaaaagttgatacttatttattagttattaaaagttcttttatgtagcatatgtgttttcaaagtaatacaacagatttgtttattacttcagaacacatatgctaaaaaaatcttttaataactaataaataattattaattttttatatcatatctaaaagtatatttatcgcaaataatatggtgcaaaactatctcataaacataatagtctcatataacaaatttctatgctccaacaatatactctattaatttatatgcttctttataccaaaggacaaaatggacttgttcataagaatttaacggtcaactaacggtcaactagcggaaaggacatagattggatccaaactaaaattcaagggtatgtaagggattgagcaaaatttagaaatacagaaggaattaggtgaactttcaaggatacataggggattttctcttagagaaaccgagtgtaatattactctaatattattattttcttctgcttgaattcttccttttgctggcgaaaggaaccgtgtgtcacacgctggcacttcgtgtcggccatatatatttagcctcacatgtgcagcattagtgtgcattaatatgctgatttgtatgcccctgtcatatgtaagagtatatgctaaccgaccaggcatcatatcagaaacagtaaatattcaacctttacgtacgtgcgctgaataatttctctgcttttgcttgctctttttttctaggaacaatactgttatgatgtttcattaattaagcaatattaataatattccttcttttctgaaaaaaaaggttgcacgtatatgaatggaggggccctcgcatcataatttaaagaaaatacctctgaaacttcacccaatccctcccatgctcctgagatttacttatttccttccatacccctaaattttagtttggatctcttctatacccctttcattagttgacctttagttgaccattaagtttctatcacaaagtccaatttgccctttggtatcaagaaaatataaatttatgaagtatattgatgaagtgaataaatttatggtatgcgaatatttgcaatgtacgatcagggatatgaatcaaggaatgaccaatatgctcaattttcatacctgcaccatttgcagtgtggaagttcccttgtatttctccttagtcgtcagcttgtccaactcacttgtgagatggtcagttgccccagtgtgtatataccaattggtatcaacaccgtaggcatacgcagcagccgccacatgcctctcatccggcacataatttgcatcaaacctgtgccagcattcagcagcaacatggcctcttttgtagcatacctgacacacgggacgggtatcaacacactgctgctggttgccacctcgccctcgatttgctcgcatgttgccgcggccacggctaccaccatcaccgcgaccacgtcctgagttgctcccgccagcagcgctggtactgccaccacggggagcaaagttgctgcggcctccactgccacgaagtgctgcatttgccgatccttgttgcctcaagtgcagcatgttctcaaaattaagtagttgtgcatataattctgtcatggagatgggttcaaccctcatcccaagagcagaaacaaaggaatcataatcgccatctaggccatttacaatatatgcaatcatatcttcctcatctagaggtttcccggtagatgcaatctcatcactataagccttcatcttcccaaaatattcagagattgtcattgtacctttacttgtagtttggagcgccagccgcacattcaatgtgcgagcacgggtctgcgatccgaacatatcaccgatcgccttccatgccagcgccgcagaccttgctcctgccacttggttgagtatatcacgtgacagggaggagaggaggaagccaagcacctgctgatcagctgcaaaccactcctcgaaggccggattatccaccattactgtcttctcccccttttcgccttccttccgctcgatctgagctgccggcgccatggttttgccggtgaggtagccctccagtcatgccccgcgaacggccgccaggatctgtgccgtccaaatggcatgattttgtttggtgagcttttcagaaacatggacgccgaagagagggttgccggtggaggtggaggatgaagaggaagccatgacaatctatgccaataggctctgataccatgaaagaaaactaatatggagtaacgttatcggtgcggagaaaattgacatttagccactttcaaggatgggtttcgctgtaatgccattccgccaacttgcttcgctaaaatgccattcccacgctcgcgcaacacgctgcttcgccgtttttccaatttcaccggattaacacacaaaatcaggagtgttgtgaccaatgtgcccttgggtcattctttaggtcagtgagagaaaggggatcgagatgcgttggctcttgctcacggcggcgccctagatcgatctcgtcggcatcgccattccacccgccgccgcagtcacctctcgccctcacccagctgtagctcacggcggcgctgccatcgccattccacccgccgccgccgccgccgtcgccgccgtcgcagtcccaatctcgcgctcaccaatacttcaatcaaatttatcagcttatcaatctttccatcatcaactgaactccacttcatctctatagaaccatcaaccactgcaacatcacttggaccttcatcaacaacatgctcactcattccttcaaccatcttcctataactttcgatccacttgaaaaacttgcaacaatttggcacctatacatacatcagtacaaaattagccccaataaccaaaagcaagcaaatgcaacaaattcaaccactcacatcttgttcgttttcctcgcatttgaaaaaacctttccaccatgcctcatcgatctgcactctactactgcagcgccacacctagggcaacgaatgagaggaaggccgctagatcctacgggtagccgagcaggaaaggagctaccttgcgacatcccgaaatcctcgcttccagctgcataccttcgctgcatagcccccctagggttagggtttcctctcatctccgcaaatcagcgccggcgaaagtggcacagcggcggtggagcaaagcggcacagcggcggcggcagataagagcggcacggcggcggcggcgaagtagagcggcagcgttgtggcggagtagagtggcggcggcggagcaaagcggcacagcgcggcggcggagtagatcggcagagcggcgacggtgtagagcggcagcgtggcggcgcttgctgcttcatttggcacaaaaggacccccaggggcaatttggtcagcagacaactcacttacgggattaatccagtgaaattggaaaaacggcgaagcagcgtgttgcgcgagcgtgggaatggcattttagcgaagcaagttggcggaatggcattacagcgaaacccgtccttgaaagtggctaaatgtcaattttctcgtcggtgcgacggttcgtgttaattgtatcgtagcaaaacggcgaggaggagaagtacatatatgtatgcgtcagagattggttagccgggatcctatttacatgtaatcaaaacaaccttagctaaactaccggccacctaatctccaactcatatggtttacaatggataagcacatactctaacaggcggtagccatgaacgccagccctacacaagaacgctctgagcaaaacacaagaacacaaataaaaaagactacaagaatatggattctaatctcttggtggacgtccacccgttttttcgtgtcaactaaatggttatgaatttttttaaaaaaaattaacaagatagattaatatgtaatatatcactttacaaatatgtaagttcatatttgacttctacaagttgtaacaaaaaacttttttttaagttgtaacaaatatgttacaagaaacgggtggacgttcacccaagtgtttaaaacagtttccccatcttgctataatacttcacaatcggtgataatccttgttcttgttgatgcttctagttttgcaatcaccaacaattttttttttgttctggtccactgtcctcacaagttcagctgctagagaggccggtcagtcattttggtaattttaggcaggaaacaactgcataaccagcattggaatccatcaacacattggtgattttggtaattttaggcaggaaacaactgcataaccagcattggaatccatcaacacattggtgatctagtacactctgttgacacaccatgcatccaatcaaagtgatgagtatatctgtgttccttcctttacaatattgcttgcactggatctttcacagccacaggagccatctgtttctgcagaaccagatcgaaggggacaaaaaactatctgaatttccagctcaatccacagatcctagaaaacagacggccaaataaaactgaacaccatttgtcagcattttggtaaaggctctgaacttttcaggtgtaatgcaattcatggaaaggaaaccagaaaatgtccgtagttttgagtgaagcgaggaggaaggaacagagatgtgaagaacactccaccgacaatctgtgtacattttccattcgggtgccaatatatacagaactcctccattgatcatcttgctggtggcttaattaatatacgcaagcacgatcaatgcctcctgtcaacgcgggcacggcggcgccggactccggcaccggcagcattgccgcgaacgacggcgacggcgacctgcacggcgagcagagcaagctggtcgcgatctccgacgaggcgccaaacgtcgacagggcgctcgccaccagccgcccggcgaccgccgacggcgcaggcggcggggacgacgtctcgccgagactgcggcggcgtcagcggcggcggctgctggagatcaagaaacgtggtctggaggtcgaggagcagacgctggcgctggagcagcggcggctgaggtgggccgccgcggacgccgaggcgcgcagggaggaggacgcggagctggagaagatgcgggtggagaacggcgtggcgagggcggagaacgcgcggctgtggaggcggctgctccggcggcggcgggaacgggagctcggcgtcggcggcgtcaggtcgaacaagtgtcgcgacggcgctgcagcaatggaaggagaagagaaatctgtaccgtagtgtcatatgtttcttttctcaatttttttctttttcttttttctctgaattctagaaaaaaattgttgatgttttttttctcctcgaattcctaaaaaaaacaggtttaaccatcaccattataataaaatttgataactaaaaaaaagtactcctaaatctatgtcagaatttgatatatccatattcatttaccctacttaaaaattggtagtaccgaaattcattaaggccttgttcggtttagaggggatttattccacaccacaggtgtggaattattcccctccaatccctctctcacagagattaaactggacaaggcctattggaaattaaacatgccatgtagctatagagtaactctgggtgaaataattatacaagcttgaatgtgcaatgatgctttataaatgctactacctccttgtacaaatgtatgacgaaccaacgtcaaacgtaaaaaaatggagggagtatttacttatgttgtttatatgtattctcttgtggaatctcttagcatgtaggttcaatgtttccttcttcttagggatattgtttcccactttgtactttgtatgtagtttgtttgtgtgaactactccttaaaccataaccaattttaaattttaagttcaattttataattaattttgttcattgcttcatcaatcaatcttttttttgatccctaagagtaatataagtacaaaagtttgtactgaattatggtcggaggagataactgacctttagggacatacatgaaaatcattggtacagctacacgaaggcctttttaaaaaagttttaagcccatggatcatctgctaccatatggagtatttttcaggacacattccgtgtagtttattcggcccagattccaccaaatctcttattaatggtgcaaagttaaaaataaaacatttgctcacaatcataaaagtaaaaaggaaaaaatagacaacatgattataagccataatcatatgagaataagtataatgtctacgaaacactcttcccaccttcaactagtattacgtgcttggttcctagagcttgctagaagtaacaattgcgccaacgtcaaccgcccacccaaaataagccagaaaagaagcccgcccacccaaaataagccagaaaagaagcactcatattttgtggtcacgacaagaggtgtccacctgtcgacctagctacttctaaatgatcgccatcaaccttatatcgtaacaagttcaataacttgctacgtaaccccaccccctcccatctagatgaaaggggctcaataccgaagacctagaactccggtgaaccaatcaccgtttgttactaatccacaatcattgaggagagggagtggacctatgacgttgaccagatccaatctcactttgacttgccataaggagtaagccatataatagagaatcctccaagaagccttggaccctcggtttggaatagttctccctcacagttctcctcatgcgccattgtccgacagttgaatagagaacacactagctggatatcacaaagttgtcacgattcttcctttttacccctacgagttaatttatattacaataaaacttgtgaaattcagcctcttgttataggtggaattcgtttatacctcgcgtacatcgtgcttctaaaattctcaccaattaattactacattcgtcatccgttatattttgagacggagaaagtaaattttttaatgtaatccttgtatctctgtaacctttgttcttagcacagctaattttgtccgttagctctgtgtacattttttttagaggaagctctgtgtacagttggtttcttgcctacccgtttttttccaggccgtacgtgaaagttgcaactcatctatatatcctccatttgcacgcaaaaagcatacatactcgcacacggttcctctttcgtcctccactagtagcattttctatttatgatcgagtgaattcatccacagataggactttctcttttgtctctagccttagctaaaagtctaaagagcctcatcttttcgtttatgcttatacttatttactaaaatttaaattttcaaccttaaatttaaagatgattttgggcattttctatttatgatcgagtgaattcatccacagataggactttctcttttgtctctagccttagctaaaagtctaagagcctcatcttttcgtttatgcttatacttatttactaaaatttaaattttcaaccttaaatttaaagatgattttgggttctttcatcgaagtttatttttcagcctttatttttagatcgctaagacatatataaaaattttattcacaaattatttttcgtttacaaatatgtcgtttgggggtgtaagatcgatcgagtagttttttttaaaaaaacaaaaaacttgagtaagctagctaggcaggtggatgttgtattgtaccggtgtttggtgcctgacgatttaatgcgaaagctagcaagacgaccaatccttccaccctgcttttgtcgccatggatgatggtactacttagatgacgatcactgatattttgtcccagctcaaattttctacgtgctctattcacggatattgtttatgtcttatgtctatcacgccatggatggagtacgagtaccagatattgtttgtctagtactgattatagtttctagccatgcattgtttatcatcttcaggccccaattgatttttacgaaagacataaaaatttaaaggattttaatcgtttagaaagaaactacaataaagatctttgaaacaaaataactgaatcatatcatttcctttataactcctatgaaatagataatcctacgaatattttgaaacaaagttagcaaaaacttcaatctcttcaaagatacccctccgtttcaaaatgtttgacaccgttgacttttcagtacgtgtttgaccattcgtcttattcaaaaaatttaagtaattatttattcctttcatatcatttgattcattgttaaatatactttcacgtacacatatagttttatatatttcacaatttttttttaataagacgaacggtcaaacatgtgcttaaaaagtcaatggtgtcaaatattttgaaacggagggagtattcattttagtctttttctctcacccgatttttgtttttcttttacctaatcagactataattcttatgtttttctgtgttgtagataatcctacaaatattttgaaagaacgttagcgaaaacttctatcttttaaaaaaatatttattttagtctatttctatcactcgatttctgtttttcttttacctaatgagactataattcttatgtttttctgtgtttgtacatttatattcatgtgtttttttgtttaaaagagcacttagttttgtagctacagtaacatgcattctcccattaaatgttggccggtcaccaaaacggaatcgagcttcatgccataagaaggaagccggccggaagcgtagtaaatgtgtacgtgcatccatggacttcacctgtagtgctagagcgtacggtgagaaaaaccgggtgagatgttttttttttttgcgatgaacagggatatattactcatgctcagcacccaacaggtgagtgataaaattataagccagaaagtggttagagcctcgctacgccctttataagccagggcatggctgacactattttggttacggtgaatcttcatgataacaatatctctattcccagccatgaggtgccaatatccctattcccaaccatgaggtgctttatctccctagctaggaaaactagctctgatcgttcctcctcctttgactggatgagttgaattgcctgtaagcagtcagattctatgatgagatggtaacagcggcgaatctagaaattttaatttgtaagcctgagcaagcctaagaagatataatcatgtatttccccgcaaaaaaaatataatcatgcatataaaatccacacaactacatatagatagggttatatcgattaatatatatagtatgggagacttaggctgtgtttgagaaaggagagatagagaagattgggaagatacgcaaaacgaggtgagctattagtgcatgattaattgagtattaattatttcaaatttcaaaaatggactaatatgatttttttaaagcaactttcctatagaaattttttacaaaaaacacaccgtttaatagtttgggaagcatgcacgcggaaaacgatgtgtaatctatctccagtctcccagaacgaacgctgccttaatatattgttgcgttagcctctaatcactttgctaattgctttattaatcaagcagggtacgtgctagtacagagggcggagcccgggcaagtgcccgtacgtggttccacttccgcccctggatgtacacttgtacgtgcagaaagctggctgcccatgcgtaagattgctcatctccgctagctttggctaatcgcccccacacgcgcgcgcccccgcccgcgccgaagccacaagaaacgtgtttgcatgcaaggccaggccaggccaagcgaggccgcgcgcgcgcatcagctcgcgacgcgagccacctgtgccgctgtgcgcgcgcgccgcctggcgccacgcacgccatgcacgcgcgcgtggggtggaagggtgaactggagaggagagcggcgtcgcactcgtgaaaaccgaaacggagacgagacgggacgtacggcttggctttgcctactactgctgctgctgctctgctctctcctctctctcgtgagcaagcgtagtagcctcgctctctctcgcagccgcgcgcttggtgggagggggggattggggatgatggggagcgagtcggggagggcggtggcggcgatggtgtcgctgcagctgctcttctcggcgctgcaggtcttcatcaagctggcgctcaacgacggcatggacgcccgcgtcctcgtcgcctaccgcttcatgttcgccgccaccttcctctgccccatcgccttcctccgagagaggtcaggtcacatcccatatactactatgcccccactgtcctaacctgctttcttgctcttgttcttctgggggaaaaaagctcgaattaataccggaatgcatgtgcatgctctgtagtgtatctgtgtatacttgatgattgttagtatttgataatctcatgtctcacatgattattagtgctttcgtttacttgatcgatgatcatgggcttattgaagtttagttacagtgcacttgacgtctcagagtagactaagcttggttaacgatcaagggtt

SEQ ID NO: 3053 - DNA, 32523 bp, Oryza sativa
gctgaaaaaccaagcgaactaagattttatctgaagtttggtgaattgatctctccatgtaaatatccaatgatcttttctggcttgcttccttaatttgtactctgctttcttgtttacttgtaccaactatcttacaatttatagtcacctgcaattttcttatctttcttctgtctaattttgcacatcacttatccttagttgcagtgctgattaagtagtatgcaattttttgctgtctttgttgcaattttagtttgtgtctaaagagatccaactaggttttcttaacgttttctgcatcatgtaaggggttcaacaatccatttctaggcctaaatatataattcatgctgatctcatcactaacaaacatattatctgagttgttggctgttaatgtggtagttgaaaatgatgagtggttgaaaattatgactagctatactgaagtagtaaagcaaacatttttctttctttttttatcatcctgcggaataagaatgaaggaaaagaaaccattttagaaattctatatgtaacatataaaccactccaagattaatagaacattgagtaatcatgtatttgacttttacatggcgagttaaaggcacattgcacctaacgacttttatttgtttgttagattctgcaattagtaatgataaatgttctgttgttcaggaagaaacgaccgcctctaaccatgaaggtggtgctgcaactattcttgtgcgggttgtttgggtaagtacttgctattataattcctaagttaaactcttatttcagaagttatctttttgtacaaacaggtcaatatccccccccctctttttttttgcttgtaattgcctctaactgatgtttttcaacacaactacatgttaattcaaagcttctttattagaagctctgtcatgttgaaggtatataaaagaaaagtcatgctgattgatcagaaacagatattgaatatatatgagtgttcacttttccttctttatgtttccatgaaaaaaataaattatgtgttgtgcattggtgaaaggcacttgcttcatgttaatccagttattagccttactgtgtaagtagtagtagaacaatgaatgtttatcatttgacagcagtgtgcccccaattcaccatatactgcatcacaacttatatggtatatcaactcttaaatatttcttggtactccgtaaatatttttccagtgattctgataaccaaagttcaaatgcagagttccataaacatttgtgtaaaatggatatattagtagtcaggaggttcagggtctatgttcatatttccttggtactcgctatatatttgactaggagccaaatgaagatcttacactatgtcaaaaattgagtagccgagttgcctcaacaatttcatccagatgtaaaatcttgaaacaaacgaaagaaatttataaactacaccaagaataataaaacttgaaaattacttccttcaaaataaatgatgcatttaccaatttttttttctgtattagatgtgttgaccacaataacttttgtgtccaactgcatacacaaggatcatgttgatctcgaagccgtcacctgagaataactagatgacatggcacacgttgcagcaggaatttttgtgccacggcaggaatttttttgcattgcataaagtgcgatggttacatgaaattggaactaaagcaaaaaagtataaccttttagaggaatagaataaaggaaatggggatttttgttaggtacaaacaaccaagaggttgtataactgctaaatctggacacaaagtgaaaatcacatatagaaaacaaaaaatgaagttacttaccttcattgatcaagaattatcctaacaaaatatatgcaggcatgtagcaaaatgaataagtccactagcacggactatgaaagaccttgatcagatcggtggtattgggctgtctaaagacgaggcttgaggggattaatccaatggtgaaattcttatggtgacgtggcttcatgtggtgcttgttttataacaataaatgacttgtagtgggtaccaattatataggtagtaaggataggcccgcacaacacatcacaattagtttcccttctaaattccataggaattgccatactctgactacccatgaatcgtgttgaattcacaattcacatggtacgcacaggttgtcatgaagatggtaattgctggacacactcatcaatttaggggcatcatactacaacttgtgctctactaacactagatttcagcaaaggttggtatacgcattcactccctgggaaattttggttgttacatatggccttcgattacatgtttatgtttcaaccaatcaattagtagaccactggcttacattttgaagctatatcgaaacgaaacaagcttaacattgtttctcatgcctaaatggcccaatagaccttcctaaagcctgagcacctagttatgtccttgacaacctggctagattgcctaattgggataggcatagtcaaggcaaactgttatcacagaaaaaaactttggttaattcaaaatatctccgaatgtggaagggtccctttgttgtgcaatatccttcatcttgaatggcattacttacctttcaatgtttgtgatttccaataatttagtgtagtactcattatatttaggaatttaaagcttcctgttgctcaaccgaaaactcatcgaacatctttagtacagtaaaagtgcatgagatcctctgtgcaatcagtgtggaacacaaatattgaggatgatattaaccatggcttggtagtttttctttctttctcttatgtagattactctggataatatgtgctacttacagattttctttctttctcttatgtagatgactgtttttctgattacacacttgcagattttctataaaccagaatctctatgtgcttgctataaagttgacttcagcaacatttattactgctatcagcaacctgacaccagcaaccaccttccttcttgctatattgaccaggttacggatttaccacttatagcttatatgtttaatttcaaggcatacagagatactccagcttatatctctgactatttctgtctaatattatcacctttgaatatatattacttcaagaactggctaaaagtatgttgaatttcaactacaacagttatgtaggagtattctttcagcagccagaacagtttatattttccgtcttatttgtaaaaaaaatatggatataacaaagccataatttttaagggttaacattagtttccatactgaacaaaacaacaggctcgagaccttaaaacttaagaaacctgctggacaagcaaaacttctaggaacacttgtaggcatgggtggtgcaatgttgcttacattctacaagggaccaaagatcatggtactcgaccaacttccccatcccaaatttgcccacctcactgaaaatccccagtcgcacccaatatcgacgggcaatcaaattataggatcgttccttggtataatcagctgtttcacctacgcgacatggctagtcatccaggtcataatcttacacttagtttcttctttcaacagtgcgcccactcaactgttgcagttctaatgtttggtattgatgcattttttttgccatttacaggcgaaagtgagcaaggtttacccgtgccactactcgatcgctgcaatggtgtgcctcttcggcgcacttcagtccacggtaatggcactttgtgttcacagggacatggagcattggaggttaggacttaacatcaggctctactcatcggcttacgcggtacgcggttcatccggcatttcatatttttcatggtaacagcatgatcgatccttacatttgttccgagtctaatgaggttagcacccttgttgattcaaccagggactcatagcatcaggctccgcgttccctctgctgtcgtggtgcctgcggaagaaaggccccctgttcatctccgtgttcagcccgctgatgctcatcttcgtcgcgctgatgagctcgatcattctcaatgaggcgttgcacctcggaaggtgatggccaccatttcctttctggattcatgcattgcagttcaatgtgtaatgtggacaccaattttctcatggcgagttcttgtgttgttctgctgtaatgcagtgtgcttggttctgtcctgattgtgggtggcttgtacatggtgctgtggggcaaagcgaaagaggcggctgatctgtctgaagatgaaaatcagggcaaggaatccatccctgtgaccactggcggtgagaatgaaatgaagtgaagagagcattgggcctacaggttgctatttgacagaaatgacagaaagatatgattctgaaattctgatagaaatatagaatgttcggtttggatcaggcattgatgtttctacatcgattcatctcgtgtattgtggacgctatcatttgtctgaatagtctgatactgttaatctgttattgccgtggatttgctgctattcccagatttgccttttataccctgtaatcttattagagctgtgattttcatgctactctcttgatcaggggcggtaccacccattaggcggggttgggcggccggcccagctacggcccgcgccgctctaaccctccatatccttcttgggccgcctaccacaacatccaattcacaactggcccataaataagcagcctaagtgtctaaattaatcctgcgtatatgatgctttcctgagtcaattcctcgacgctgctcacccccgccccctactatagttaggtgcctaatgtttttttctctctctcccttctaagcaaaataataatcattttattctaggtatgcgatatcttctcatatatttatgtggcggtatgtcatgagatccttcaaccagacctgccgaaaccatgcaaccagtaagggttcaagcccaagacgtcaagttcatcgggggcgaagccccccatggcgaagactgtgaagcaaagacggcgaagggtgaagaattgcgctggtatcccacaaggctgaaggcatcttgggcgaagactatacggcgaagagtgtatgacgaaggaaggtgacttcgccataacgagtccagcttcaagaagacccaagaggccatcccagccgctcaagcccggtggccattgggccaacgttcgccagtcggccctttagaggcccatatacctcaattacactgtatacccatgtaagtgtccctttcataagggcaaccatgtaaattcccctgtaaaacccaagccctaatagggaacatgtaataagattataaatagacccctaggacatgtaagagggggatccccaagaaaaattcaaaagataatacacttcaccgtttccaacaactgttgagtaaccacgtccttcgacgtacgcagttgtcacttcgacaacaactggcgccgatcgtgaggaggcgaactggcgcctgggtggatatattcatatatttattttttaaaagatatctatcaaccatgctttatgaattgactcatatttgcaaattgatatgtttactagtatctttttatgtatgatgaattatgtatggcgcaaaaattattactttattttaatatcatttttgttttttgtttgttttaatttattgattatactatatgtttatatgattacaaacataaatatggtatttgttgtgtttagttgctctttatcaagcatttttttcaggaatctcagaaagggattcagtgaacagagagcactagtctctgacagaatgcatggggattactgtttttacaaacgcatggttaggacttcgagcaatctacagaggagaaagcagtaaacactagtgattacaatagtaaaaaagaactattactactagttgtacttctactctactaccagagagccgaaaagaacagcatcatgacgagaggaacggcgagctgcacctgcaccgtcctggctcgaggcagggtgcccatccccacggcctgcaaaaggcgtcaccaccaaccaatggagcaaattgcaaaagttcgtcgtcagtcagagagcgagctactaggctagaaaaaggtatgatggatgcaaagggaaaaggaaaagtaatatgagctcgcaaagatgcagcaagaaagctctgagaaaaaggtttttggggagttacaagaaactaaaagaaatgaaatgaatcagatgtttgctgggttgctttggagtttatcagaggaggagatggcattggcatccaaagaggtgatgaacagttgtttgattggttggttggttggttacctgctgctgttcctggccgggggtgggcatgggcaggacggtggcggagtcggtgacgccggcggggagcggcaccgccgggctgctgctgatgaaggccgtgctcgtgcttgccgccgcggcggcaggcgacggcgcgccggcgttggcttcagcacccgcattgcctccgggaagcgcgccgcgcgggctccgccgctcagacggcagcgtcggcatgtcgccgccgccgccgtcgtccgagccaggcaacggcggtatcgccggcgcgggcgcggcgccccgaacggagccggccgcggcgagtagtccggcaccacgaccgtcatcggtaccttctcctcgccgtagccaccgccgccgcgaagctaacggcaaacgcgacacggcgcggtcagtaatgtgacctgcaagtgatcagaacacccaaaccaacacaacactacacgcacgcgcgccaacgcgcacttacctgttcgacgtacgcgcccgcgccgcgcaggtggaagagcgcgcgcgccggctgcacggcggcgagcgagcagcacagcagcagcagcagcagcagaggcagagccgaaccgcctcgcatatctttcctcattcctcgatgctcctccggtgtccggtggtggcgctcgtccgaaaccgcacggagggaaggacgcccgtgactttgtagcgcgcgcgggtggtggtgcgtgtgccgtcggccggtctgcccgtgtgcagtggacacagcgtcacagtgcgtgcaccgggtcgctgcaggctacagtacagtgcagcgcgaaacagcaaaagaaagcgacagtggattttaaactctccagagaaacggtattaccttctttgcgtatcaaaagtttggaagtttgcttgaaattggaactatgtgacagaaaagttgtttgggtatgaaaggtttgatgtgatggaaagttagaagtttggaaaaaaaaactttcaaactaaacaggacctaaatagttatgaaaaaataataaaaacatgtagatatactttacaaatagtatacaagtttaaattcagcttctacatgtaataaaaatagtattaaacgcctgcatagagtattaaatataggctctatgcggctaactctaatggtacatattgcgactaatttgcgagacaaatcttttaaacctaattgctccatgatttaataatgtggtgctatagtaaacatttgctaatgacgaattaattaggcttgataaattagtttcgcaggtttattgacgtattctataattagtttttttattagtgcccaaacacccctgcgacaacctatataatatccgatgtgacgcactaaaactttacatccctgatctaaacaccccttaggctcccagtatgtaaaacgaagcagcgtttaacgcgtgattaattaagttttaggaaattttttttcaaaaatagatcaatgtgatttttttaaacaactttcgtatataaacattttgcaaaaaacaaaccgtttaacagtttgaaaagcgtgcgcgtgaaaaaacgaggagaagaggttggtaacctagacaaacgagctgaggtttaatctttcttgttaaattttttcaatcttttagagcaagtttaatagtatagccaactaatagctctaatttatctataaccaatctaatagctcatttatacaatagttacatactacactattaatacatagtcccacctatcatacacacattgtgtcttaaagtctgtgctacaactggctataaatgttacccgttgtttttctctcttctcatttatcttcttaaaatatgtttgtagctgtcttatagcctgctattgtacctgctcttagggcacccacaatggttatctataagctatctacaagagaaccatgtcagcatattttcctacttggaagatattaaatggagagagggagcaaagctatctactaacttagagatagtctatagagaaaaacgagacaatgcataagagagctatagatacccatgtagacatgctattgaggtgatttattattaatctagtctattgctgagatgtatatgttttatagagagcaacttactttattattgcgggtgctcttattataatagaatagttaccatagaaagcggaaaatgcgaagcaaaaagggcaggaaaggacgggctacgggggctaggcggccggccgggcggtgtgtgttggctgggcgaaacaaaaggctgcgacagataaagcggctaccttttctcgggcgtggtggcggcagcagcaaaggaggaatccaccgataattgaagcatcgatgggtggggggtggtggcgcggccaccggagcacgtggcctccaacacgacctccaaatggtcaaaaccctctctctgtgcgttgccgttgttgccaggttccccctcgattcgatcgattgattgaccctcccctcttcctcctctctcctcctgtgcacaactgcacaccgcacagtgagccccctgtacagcttggggctctatgaaaaagatgaatcgatggcgtcgcgacgtgcttgcctccctcaactttggggctcttaagaataagtctactttgcctccctttacaaatgggtccggttaaaacacacccactaaccataaaaccgggtataacccatcctctaacttacaaaaccgttgcaaatcaactccctcagcgatttcggaggcagtttcgttctacgtggcacttacgtgacggtttgacttagtatttatcccatgtggcatcgacatatcgctcaagtggtactaaaataaaaacaaacctaaataaaaaaataaattttgggcacatttgtcagttcttcagctcctctctcttccctctttatactcgacgtcgattgagatggagagagcaggagcagcgagaactcggcggagcgacgggagcagcaggacagcgggttgatggcagcatcgacggtgttggtgtcagcaaccgggagctcggcagagtggcttggcgggaacagggagagagcagaggtgaggaagcctcgccgccgcctcctctcctctctccttgcctcccccccggtgtcaccggcaacgaaatgcgcgtcatcgttgtggcagggattgaggtggaggcggagaacaaggtcggtgttgggaaggagagcggaggagaggaggcaacgacagcgatatagggagctggtgaacatgagagggtgctgagccagcatggggagtcgttccctttgccgagatcgacgccgccgtgtttgcacgccatttgcagtggatagctcatccgctgacctagccgtcgaactcggcggcttccaccgttgtcctcgccctctaccatgctctgtctcgccgccgctgccatccactgtcgtctgccggttgatgccattcaccatccaccttagaaagagaaaggttaaagaggagaaaaggtagctgacacatggaccctaaatttatttttattattttattcattgacatgtgggtcccatttaaggtttgttttaattttagtgccatgtaagcatcacgttgatgccacgtggtataaataccaagtcaacccgccgcataagtgtcacgtaggacgaaaccgtctctaaaaccacttggggagttgatttgctatggttttgagttggaggatgagctatggttttgaaagttggaggatgagttatacccggtttttcggttgagggatactattcaaccaggggtatgagatgagggaagcaaaacagacttatttcgatactcttatggcggatcaatactatatcattagggagtttgggactttgggttcgggcgcagcacggcagtaatcatcttcctgatcatacagcccaagggaagaggagcccatgtgtaatcccctagcccaactaaccggccgggcctttgttgggcttggcatagtgtgatgggccagaccagttacgaccaaatccaaccagggccctcacatcctgttttgaacttaggcaggtttagcataattttctcgtaccctcgtagtatggtagtttgttcggataagatcacaagactgcatggttcgtggtgaatttgcatacaaggccaacaaaagaggaaaataaaatcatgcgagtagtctctcatgctaatgagccgtttgtgattaaaaaaaagaaaaaacaaatatcgatccatatggttcacgattacaaatgggaggttaattttctctaaaaaaaacgctatcatatactccctctgtaccaaattataaagcctatattttttatacagtcttcaatgacatattttgaccattaacttatgacatgttatatttttaacaaaaatagaatataaatctagtgatataacatgtataatatttatcatatatatggttagtataattattacacaaaattatcaagtttaatttttcttaaaaagagcgcgccatataatttgggacggaggtagtataatttcccaatttgatcatctctcaaaatcgatctacccggtacacccatgctgctccgcctcgtccgccctctactccgccgccatgcacgcggcggcggcgccggcgccgccgcgagctctccgacatcgcgtacgtacgcctcggccaccggaagcactagtggccatctctacttggtgctggatgactggaaggaggggtacagcctgcacaagctcgatctcaatgccaactccggcgacggcggcgacgacccttccccgccgcggcgcctccccgcgcctctcctccggctaggtttccggacgctcggctcgtggccgcacatcagcgccctaggcagcaagatcatcttcatgggtcagcgccgcccagatcagttccgtgtcgacggcggcggcggcgacggcggcgcctcatcctcgtctacgacacggcgacggcggcggtggacgtctcgcaccatctcccggacgacatgcacctggtgaccagctacgacgccgtggcggacgccgggaagaacaggctctacctgctgctgcctcagttcgagcggtcgccgtcgccgtcgccgtcgccggagccgccgcgccggcggccgccatggccaggggcgccagaacgcggcgtggacatggcgccctacccctacgttgagaaagtggagagggtgaaggccgggaccaggctctacttgctgctgcctgatccgtttgatcagcggtcgccggagccgggccgcgccgccgtgggcatgccctaccttgagaaagtggagaaggtgtaccccaaggaggaggaggagaaaccggcggcgcgcggcggccgtggaaggtcgtacggcggcgccggcgacgacaacgacgacgacgagaaggacaagtactaccgcaacagattgaccgagcggtggtcgtggcggaccagcacttcgccgccgccattctccggcgggaggcgcatcacggggcacgcgctgcaccccgacggccgcaccatcttcgtctccgtcgagaagacccacgcccgccgccatcccggcgacgaggacgacgaggaggacggcaccttctcctacgacaccgagcgcggcggcgagtggacgcgccgcggcggctggcgcctgccgttcaagggccaggcgcactacgaccgccacctggacgcgtgggtcgggatcggcgcatcctcctccggcgccggcggccacccccgcctcgtcgcctgcgacgtcgtccatctgtctgacgccgccgacgaccccgcgccgccgccgaagtggacggcgtgcgaggagacgctgacgttcctgcagggcggcgcgccgcgggagcggagggtcggcggcgatcccaagctggtgcccatgggtgggggcggaggcaagttctgcgtcgtcgagagcgcgccgcgcgccgggctcgagctgatcggcctcggctcgctcctcggcgacggcgacaagttcgagctccgcgtcaccgtgttccatgccaagtacggcgagaacggcgagctgctcatgacgacgacggcttcggcggcggcggcggcgtcccacacctacgcgctgtcccgctatctctcgaatttccatgcgcccgcgttctggatgtgagccacgcgagttagaaattaaaatgcgtaattgcttcaaaactgataggtttcatcatttttggtacgacagcggcgacgacggcgacgacgaggtcgaaacagcgtacgagagcggcggcggcgacgacgatgacgaggtggaaacagagtacgacagcgacgacgaggtggaagcatggtacgacagcgggacggaaacatcgtacgacaacagcagcgacgacgaggaggtggaaccatcgtacaacagcgacggcgaggtggaaacattgtacgacagcgacgattactacaatagtttaaaagagaaagccttaggccttgttcttttaggctgggtttgggggggggggggggggggaatgggccaaaatccccgtgtgctatcccggccgggtcgaattttcttccgtggcccatgtatgcgttcgcctgggccggggtgggagtaattctccaccgaatccacaccaatcccacggggagagaaaaatcgcctcggagacgattttttttccaagccagccgcagcgctcggcctcctcgactcctcgctgcgctagggtttggaggcggcgcgaggtccgggaggcggctctagggtggagatccaggagcagcatatctccagccgctgccgctctccatcccgccctcggtcgccgacgatctccatccagcttcagccgccaccggtctccatcccgtcctcagccgccgccggtctccatcccgctttagccgccgccaccgctctccttcccgctctccatcccagccagtcgccggcgctcgccatctctccttcctcgcttcggattcaccggttgcgggagagggcaaggtcgagggcaacagcccggacaccaagaagcaagtctgattcttgatctcctcttttcccactcagaaaagattttgtgacttatctagtggatgaatttgttgctagttgatgtattgagtggctgtatggattgaagtatcagtcatgttctgcttagaaggaggggtgatgtggtttgtagtagtagaacctgaaaccacagaaaattccatgcacatctctatgtgtgtgcgcaaatcttgcctatcagttgctctgtaatcaaggaaatatatatttgaattggcagatcctatatttctgaacatgggctctcttctttcttttcttttttttttgtgagggagaaacctggtttgttgattctccaggaattattgtagatgcagtgggagcacacctaaaaaataaaaactagtgcactctgttgttgctgtctagaatgcatcactttgcttttggccaaggtcatttgagcttcagattgaacgaccaatactatatgccaattgaatgagcaagaagatacaaaattttttaaagtcatgctatgaggtggtcaggtggacactgtagtatacattctagttttggtaattttttccatggctttttgtttagcaaaatgcccttgttaaaacttgagaaatgtagctgtccatcttttgttcgaatacctattttactcttagcaatcaatttagcatatttatctattctgaactgctactatgttcacaactagttttaggaaactgggtgttcagatatattactagaggtcataccatacaaagctatataaattgctattgaatgacaaaaatataatctgttgtgctgaattaaatttcaggagaggcacaggcgtgtggggttggcaaaagtaaagctgaaggagttgatattactcaaggtatttgagaaaaaactaaatacagttgtacttacatttgcctgatatgaagcatttaatcttgcccttgcatatttactagagtaacagaagtaatttgaagttggagagagagagagagagattgtaggtacaatgttatgtgatcttgctcaggtggcagatggtctcagtttttttttgctagtgaacaggaggttgttattttcaagtaaacatcctaccctagaaggatatcctcactttattaaagttgctatctctgaggtttaaacaaaactaagtacacaaagtacttctggaactagtcaaaatctgaacacattattgatccccctcctcccattgcaatctgtttatttgctgaaagtattaaaagtatttatgcatgtagccaccttgaatgcctctaatttcatgtttaataatattgtaatacatatgcatattattatgttctcacacatagtttaaagtatagtaattctatatctcttttagtgataaaatcagttcgagaatggcggatgaaattaaaaggaggagagaagaggacgatgatatgatgctttttgtttttcctgcgatgtatatgctgtgcggtacgacaaatagtgagaaaatacctagacatatctcaagactatccggtaaagagcggcttcaagaaatccttgaaggacatgtaatggattgtaaagttgcattccgcatggagcctcatgttttcaagacaatagcgaattatcttagagaggaaaagttgttaaaggatagtagaggcttgaggattgaggagaaacttgggatatttatgttcatgctcgcccacaatgcaagctttcaagatctacagtatgaattcaagcatagtgggtctacacttcattggcatattaagtctattttcaagataatcccagctctcacctatagatttctcaagcttcctcatgccgaccaaacgcattggaagattagaacaaatcctcgcttctttccttacttcaaggtgaatctggcactcaaactagaaatgaatatctattccttttccaattaaataactcatgcatattctgtccttttcttccctttttgctgcaaaattgcataggggctattgatggcactcacatttctataactatagatggagagaaggcaactccttataggaacagaaaagggactttgagccaaaatgtgatggttgcttgtgatttcgacctaaatttcacttttatctcatgtggttgggaggggtctgcaaccgatgctgggtccttagatcagcaatgaatagtggctttcaagtcccaaatggtaaattttttctagtagatggtggttatgccaacacaccacatttcatactccttatcgtggtgttcggtaccatctaaaggagtttggacgtggtcatcgtcgacctagagactacaaggagttattcaatcatcgccatgccattctgagaaaccatgtagagagagctctaggggttctaaagaagcgatttcccatcctgaaagtaggcactttccatcggataaagaaccaagtgcggattccagcaactgctgcggtgttccacaacatgatccggttgcctaatggtgatgagggctggttggacaaccaacctgataatatagaacctactaattttgtcgatctaccagaaggtgacagtgaataccaaaatgatgtgccatctcttagcaataaaatgatcagtgggaataatattagagatatgattgctaagaagatgtgggaagattatgttcgtaactagcaagaatagtatagataatattttggttttgcatgatttgtatttatttatgcaatcaacatttatgatatggacaaattaatagtaagcaacgtagtttgtattttctcattcaataaaatattgcaatatagttatgatgtttggaagactatctccgaaagcaagcctattgcagcagcaacaaaggcatctacaaaagaaggcatcaccaaagagctgtagcatacagaagaagaaggtttctccaaaaggtagtatctaacttgtttttttgtgaagtattttcctttcatattaatgattacaaattttacttactataatctaattttgtctaatagcttaacaatcaagagcttcatggaacccgggactagaaaaggctttagttgatttacttcatgagcacaataacccacattaccggtgccaaaacgggtggacaagtgaagcatggaacaaggtcgtcaaagaatttcgtgacagacatccctatgtcaccatgaataagcaacagatccaagataaggagaaggagttaaaacgagattataggttgcttaaggaggcaaggaaacagagtggagcttcttgggataatcaacggtgcatgattgttgccgatgatgctgtttgggcaaacataattacggtatgatattttgagcataattgttttgtcctcatcaaatcactattatttgtattcatgccataattatctgtttttgtatcttgtgcagtcaaatgagaaagtaaggaagttcagcaaaaacaaatcttttcctctctttgaatccttgggtgaactttatgatggtaaatttacttgatgccataattctttgattccttgtgcttacgttcagtgcagccaaccttgttatttgttttcttctctcgttgtttggcactgctaccttctttctttggcttcttcacatatcctgcacctgtactatgttccttttgtatgatgtagtcctcttaggaaacaacagtaacatagctgattagttatgcatagtgacatttctcatatccgcatattggaaatcaatgccaaattatttggttgctcatgatgtttactaagattgaggctttaaatggctgattctgtttgctagtgaacacattcttttttggtgcagtatgatcaatgttccattagttatgcatctcccttctcggatctagtattttccctaataggtatatactgaaacttttgtatgggtagtgaattgcaaccttttttataggccaaactgcgagggcaacatgaatttcacttctattgagccattccaacatgctactctcatacaagtgaatgaatatcttgagagaagtgactcttttcctgatgtaaattgggttgctgatgatgatgagaccactgaagttcaagatgaagataatgcagtggagcatgaaaatcagggaagccacattactatcacctcaagagctaatggagaaaagaatgtcaagaagaccaaatctactgagagagagagagagagagagagtagaaaagacaccgaagaggaataagaggaatgatgttgttgatatgatggaaagttacttggagatgagaaaaagacaatctgaggaggaggaagcaaagaagagggaggaggaagcaaagaagagggatgaggcaagcaaggttgaagattgctcaataaggaactgcatcactgttgtggaatcgatggaggagctctcaaatgaagaaaaggtcaaatcttttggagtattcaaggacgtgcagaatagggagatcttcatgagtgcagggcctatgactcgtcttatatggttaagaacgatgctggtaagtttgaattactattgttactagcataatcttaatttgtgcaattctgaaattcaattcttctacacttaaataggtgcatttttttagccacgttgcactttgtttatgatgcgattgtgtaacaatgcagaccatgtaagaatgacctttggaccaaaaggatattgtctttccaggtacccgttcatacttttataattttgacatgattttcatgttatatttatgtcaggtttaggctgaagttagcataattttgacataattcttgttagtatgcctctgaacttttataattttgattcttgtcagcatgccccctctcttctgtcatgcagccatgctagtgtgtgtgcgcgcgcaccactactactagtacatatctacatcgatctacatacattccttgcctaccaccttcttcctaaaatcaatctatctatctatttatctatcgatctatcatgcgtgcttgctgtaactgattaactggcagtgtgatcatctctctctactgctgctacatatatgcagtgctatgctgcaggtataatgtgctatgtctgcctaccacaaatctaagctaattgtgacatggtaataaagcaggtgctagagtgattctctctgtgtgtgtatgtgagtgtgtttgatgtgtaattgtatcattgcttgtgctcaacaaaaacttgagtacaagtaaccatcttttgcatatttatctgatttgattcaagttcattttacctgttgtttagtttacatattagcaatcaccattgtctagtgtctaagacttgtttctttttggttgtatagttccatggcccatttgctagttgtgcccattggaaggaatcttttgcaagatagttcatagagaccgcttgaattgtgaaatgcgatggatgaaggacaatttttcctaactgcttcttaattcatgtagctgtgatggttgcaggaaccatttttttctataggattaacacttgcttgatcagacatagatatattatttagtttgatcggatagagatatattacgttcaaagaacctattttgtagcttgctttgcacaatggcaattggatgtttactgcctgtagaatttaatctatccaaaattataatttttaatattctcgactatttttagaatccatctgtggtaaatccatgattttctatctttacgctttttagaattattttgcacgttgaatttctgttccattttcatgatcgttttttatcttgtcatttctgaattattttgactttcgtgaccttccagctttttaaattttatccgaattttgcatgatagtttctcacgctgaatttgaatggtagtaatcccttctaatctcacctctaatcccaccttctactccaaattgctagccaacagggaaatcccagctagcgaacaggggaatagaggccaggagattgggggaacaaggggattggggggaagggattgggtgtggggagcggggacaacccaaaccccacgtgggttggttttcctttggattatttcccacagctagcgaacaaggccttagggggtgttcaatagtagagatgagtatggtctaaacaataaaagattatttagaaaccgtgtctttacaatacttgagacgataaatactctaattattaactcaaaaaatattccttttgttaatattctttccatttttttaccctcatgcaaccatatttcaatattacggtgattaagagttgttgttaagccattgttctgcataataacgatgttttgtctctcctatttctctttcttccatgtcaacaagtattcctaattaacaacgctaaaagaccactattgataaccattgtacatgtcttattttttataatttctgataatttatagttgtagaatctccatcttaaaaaatagttatagaatccaatgaatagaccacaagcataagctaatttccttaacttttctatattttcgttaagctacgttcttatcagccgcttcttagaattaaagcttcccaaaagacgcttttcgtggccacatgttatgaagtaactggttggctgtagttgggctagcataaacatcagtcacgagcaatgttttaaatagcgggctaagacatttcgtgattaatttagcgggctaggttatttagtggttagcttctcaaacagctacagcgtacaatttagccgcaactaaattgtacatgagagcaaataactagaacccttcttaaaccctggtcacgagaaaatccagaggagcttcacattttgtttaggcaggacgttcaccgtaatttcctcgtgtgattgcggtttgttgggataagattgcaatttgtatttttttttgttgcgaatctccaacaaaggaggagataatggataatgtttcaccgtcatcggagattaatttccctccttaaaaataaaaaacacacactaatttttcggtaattgcacgggttaattagtttcacaaaatcgatctaagcttccatgctgcgatccattctccgccgtcatgcaggcggcggcgtgagccggaccatgtgttcgccgccgtcgcgttcgcgtgcgtacgccgcctccggcggcacaggtggtggccactaccgctcccgctgcctccgtagctgcagctgcgacgagcacagccggcggcgacgccatctctacctggtgctggatgactggaaggaggggtacagcctgcacaagctcgacctcagccatgtctccggcgacggcggcgagcacgagcacaaccccatcaacccgcggcggctccccgcgccgctcctccgcctaggtttccggacgctcggctcgtcgccgcgcgtcggtgccctgggcagcaagatcgtcttcattggtcagcgccacccagatcagttcaccagcgccggagacgacgacgacgacggcgacgacgaacaggaacgcggtctcaccctcgtcgtctacgacacggcgacggcggcggtggacgtctcgcaccatgtccccgacgatgtgcgcctggcatgcacctgcgacgccgtggcggccgggaacaggctctacctgctgctgctgtctgatcagtctcactttgagcgctgcgagacgaccgcgccgttggcatgccctacgttgagaaagtggaagaggtggccaccgggaacagggtctacttgatgctgcctgatcagtccgagcgctcgccgccgccgccgccgccggagtccggcagcccagacctcgccgtggccatgcgctacctcgagaaggtagagcaagtgtacgacgacgaggtggaaacagcggacgacgacggcgacgacgatgagtacatggacgcagagaagaagaagcacgtcgtcgtagcgtacagcgagaggttgacggagcggtggtcatgggggagcacctcttcgccgccgccgccgcccttcggcggcggcaggcggcgcatcacggggtacgcgttgcatccagacggccgcaccatcttcgtctccgtggcgaagagaacacccgaccacgacgacgtcggcgaccgtcccgacgaggaggtcaccttctcctacgacaccgagcgcgccgagtgggcgcgccgcggcggctggctcctgccgttcgacggccaggcccactacgacgccgagctggacgcgtgggtcggggcgatcggctccagggccggccctcggctcgtcgcctgcgacgtcgtcccggcggccgcagccggagatcgccgcccggcgccgccgccaccaaggtggacgttctgcgagcagccgctgacgttcctcggtgcggagagccatcagagcctgggcgatcccaagctcctccccatggggggcggcgcgttctgcgtcgtcgtcgagagcgcgccgcgcggcgccgactcggtcggcgacggcgacaagctcctgctccgcgtcgccgtgttccgcgacaagtacggcaagaacggcgagctgttcatgacgacggcggcgggcgggcgcggatcgtgccagacgcacacctacgtgcggtctcgctatctcgtggatttccatgcgccagcgttctggatgtgagcaagcgaatgagtgagcgattccttggcagaggctgtatcttgcaaatttgcatgcgtttcatgaatttttttagaaataatattttttaatagaaaattgtaaaaactagctgggtggcccgctcaattgcgcggctagcacccatacaaaattatatatttttaatatgattttacttaaaatttattaaatagttatctcgttgtcttgagactttaaagaccaaaccttatcatccccgtgtttctaattttatgatttttaaaaatcacatcaattgctatcccttacttatgtcatatccttctttattatctggctcgatctacatggtttttattcattctctttggaaacctttaaaaattggatgttatactttttagagtttattgtcctgatgggtttcgtttttataatttatagaagtcccaacaaacgctgtcattatactcctctgtggcctctccattgcctcttttctttattgtcattgatattttcaaaatagaacataattatcgttagggttcatttttttactttctagaagttccgacaaaatgtcagcggttttgttagtgtactcctctacagcttgcccgctgcctcccttctttattgtcattgagattttaaaatcaaacatgattatcattggagtttatttattttttactttttagaagcgcgaaccttttaaaattggaccttatagtttttataatttattgtctcgttggatttcgtttttttatagtttttagaaatctcgtcaaacactgtcactatactcctctacgacccttccaccgcctactctttattatcattgggattctaaaaatcgaacatacacatctttggaatttattttttactttctagaagtcccaccaacaattggcggcgctggcattgtactcctgtacgacccgcccgctgcctctcctttttattgtcattaagattttaaaaatcaaatatgattattattagggtttatttttttactttctataactcccgccaactgccttgaccggttgcttcacgacctgtccgtcatccttccttttaatagtcattaggattctatctggtgttttattaatagtttttagatgttccatcaaccgccgccactctactcctttataggccttttacttaattaatctcctcgtgtgtttgagatggtcttttcttgcaatagtttttattttttatcaccaatttagttatttataaaaatatttataaattgtatttctagttgaaatcttttttttctttttctaatttcagattttattttattttttatttcgaatttcaactaatatcgtattgtgttcttttaatttattttttattttcaatttcagtcgtttcaaaattgtatttctacttgaactctctttttagtttatccaattttggattttattttatttttcattctgaattttaattaatctcgtattaggtttttatatggattctatttcaaaattgtattcctgttcgaactattttttttatttttctaaaaatttttgaatttactttattttttatttcaaattttaattaatcttgaatgggttcttatatggactcttcttctaaaatttcttatttttaattccgaatttcagttcttttaaaattatattcctacttggactctcatttttttctctgattaatgtgggaatttctaacctccacggcgaaggtaatgcctcctttcaaagctgatttaataatatgtttttctaatttcttgttttattttattttatttttattttaaattttaattaagaaacggggtgatagaatcatacacgtctaatcatattcaatggtgttattctgatttgatttccacagtcaagttgtgtcactttgcaattggaattatcatgttgctgttaaatccatacacacgtcgattcgtatctgactcggtctgccattgcaaccaatgtgtccgtctctaattcactttacgtaaacatactataatttttttaagttttctatggactcttattatatctcagccactaaaatctaaagggaccacaatctaacggtcggtattttttctttttcttcgattaatgtgggaatttctagcctccacagcgaacgtggtgtctttttttcgagctatcttaataatataataatagatagaagctgataagccaaaatcacaagtttaatatcctgttgaacaaccgagcctgtcgaactatggttgttcaacagggtagttggtccactaaaaaaataaaaaagtacttgaacagtgttgcgcagtgttgggcaggggccaatcgaacttccaatgttcaatatgtcccgcatgaacagtgttgtatagtgattgttctcttttttaaaatttttttatcctatcgaattgtggttgtttgatatgtacccctatcgaactataggtgctaaatttatgattttagctgattaacttctattttttataattttttattagaataatattatttctctaaagtttcagtttcatgttcttaagggttacttctttcgtctcaaaataaaatagcatatttcattcagtactaagttgctttattttaaaacggacaaagtaaggaagataatcaattagtggatgttcattcccgacgtcaagtagatcgatcggcggtttcttcgacggactctgaagcggagcaaggcatcgtcattcatacgtacatatgtattattcttgtccataacacaaaagatacaaacacagagcaagtcatatactatatctactctctccgtttcacaatgtaagtcattctaacatttttcatattaatattgatattaatgaatctagacatatatatctatctagattcattaccatcaatataaatgtgtgaaatgctaaaatgacttacattatgaaacggatgaagtacacaataaacaaatacacgctgactattttttggtgaaaaatatggcaatatagctactctctaaacaaattaaacggcgaccaccgcacaagaccttgttggacccacccacccagcactatactaccaacggccatctccatcgcatgaaaacaacatagcatcagcaaagaatcaatgattgattgatcgatcgatggcactctctatagactatagactatagagggaaaaaatcttctcgatttctacttactcgtcatgccatatagagaaagaaaggaacaaagaaagatatttctccctctatttcatattataatttatttgatttttttataatcaaacatttttaaatttaatcaagtttatagaaaatataatattattttcaacacaaaacaacatattaccaaaatatatttaatgttagatttttttagggaatatttaatgttagatttaactaaactaatttgatattttaaatgttgctacattttttttataaacttaaccaaatttaataaagtttgattagaaaaaatatcaagttgacttataatagtaatcagaggagtaccatacacgggcaccgctagagtgaggctcaccgctcacacaacatcacgaaagaaagaatcgtgttagcctggtcgttctttcgatttgtttacgtccacatgtgcacaagttggaacctcgcttttgttgtcctagatctggcacacaccaaccgatgtgtagtgtagctcaacattcgcagcatcagtgtgcgtgacaaattttcaggagctaggtgacatgggcgacttgggcggcggcggcgagacgaaggacgtcatcgacgtggaggcggtggtcgtgggcgccgggatcgccgggctcgccacggcgctggcgctgcggcgggcgggctttgcggcgcgggacggcggcggtggcggtggcgtcgtggtgctggagcggcacgccgagctgcgcgccacgggcgccgcgctcaccgtcttccccaacggctggttcgcgctccgcgcgctcggcatcgcgcacaagctcacccctcgctaccaaccctacgaaacgtacgtatacccaagcgcgcgcacttgaatcgatcgatcgccacgatggaaaacaaaagaaaaaagaaaaagaatcgaatcgaattgctgctgctgctgatgctgatgaacgcgcgcagatccgtggtgaccaacctcgagtccggagcgacgcaggtgtttcggtttggtgggcacaagagcaggtttgaattgatgcaaattaaaacttttttgaattcgtgatttgatcatttgaaccggtcgcgatttggctcgactcgactgaaatttttgaaggagcggcgaggtgagggtgaggccggtgcaccggagggagctgctggaggcgatggcggaggagctgccgccgggcaccatccggttctcgtccaggctcgcctccatcggcaccgagcccgccggcggcggcggcggcggcgaggagctcgctgtcgtggggctcgacgacggcacggtgatccggtccagggtgctggtcgggtgcgacggcgtgcactcggcggtggcgcggtggctgggcatggcggagccggcgagctccggccgctcctgcgtccgcggcctcgccgtgtaccccggcggccacggcgtgaggaaggagctcaggcagttcctctcccatggcctcagggccggcatggtgcccatcagcgacaccgacatctactggttcgtcgtcaacaacaccgtccccgcaggcaagccagcccaaatgcctcgaataaaaatttgttcaaatttgatgataagtttgttgcaaatgtgcttaattatgaattgggaatttaagttgttgcaatttttttaagtggagaacttttaaatctaactatgcttacaatatcatttcattgtaactatactataaatataatataacttttatataagtatttaaaaaattggatgtgttcggctatgacaattcaaactgattgtgacgtgtaaccaatttcatttgtcacaaacggttaaaaccagcacgtccgaacataaccaatatatacaactttatacgtaagttatataaagattataatatatataaatgtatgtcattacattatagatgcactgttaccatactataattatattttaaattacatttaacgttttctacagaaaaaacttgaaactgttttgttagtaatttctaatttattttttttttgcagagagagaagctgccggcgatccggagaagatcctacgcgaggtgactgacaacctgggccgccacctgccggaggagttcctggacgtggcccgccactcggacccggacaacctcacgtgggcccctctgctctaccgggccccgtgggccatcctcacgggccgggccgcgcgcgggcccgtcacggtggccggcgacgcgttccacccgatgacccccgacatggcgcagggcgggtgcgccgcgctggaggacgccatcgtgctcgcccgcgcgctgtcgtctcggtcgccgtcgccgtcgccggccgacggcgtggcggcgtacgtcgcggagcgccgcggccgcgccgcgtggatcgtcgccggcgcgtacctgtcgggctacgtccagcaggggagcaccagcgcccccggcgtgcgcgccgccgccgtcaagctgttccgcgactggatcttctaccgcttcgtcttccccttgctcgccgacaccatgtggttcgactgcggcgacctcgtcgcgccgccgccgcgcgacggcggcggcgaggaggaagcagctgactgcaagaagagccatgtacactgagaaagaaaccaatgtactatcagttgtacagtcactgcaggtgggaccggaccacctgtatcatcgtgacaccatcagcagggtgatcgatcgatcgatgacatgtgtttaatggtttgctaatcgcaatagttaccatttcgtttcattttcagatgtacaacgtgctcaataagcttcttgtgtgttttttggaagtgaggtagatgagatgtagatgtgatgtcatcatttgcagtgatctacatctgcaagctttttaaaaatctgttggggatagcttgtttgtttttgagatcagccacaaagatagatgctcgtcctcctgtgcaagcaagaacaggcgcaatgcatttccaatgtggcaaccacttgaaataccagaaaacaaatatatatattaaaatttcagcatggaatccactagctaaaggttgtttgcaaaaccagggtattactagtagcccatagatttcgcacatatatttactgcagactgcagacttccccctgggtttcacaacaaaatttgtctcttattaacgcaatgtctgttgccttcagtagtaagaatatattcagggttttaatcctgaaaaatgatctgaacatctgatacatcttgatctacctgttcttctcacgtgccaattaaacctagtacctgatgaaaagcgatcatctgtcccatacaatacattgtccaattctttggtcattaggccagcctgttcctgaacaaacacgttctgaacacgagacaattgaattgtaccacaaagtacctgagcacgtacagaaaatcaaaactggaaggccgtgtgttggtacagtgctacaaaccaaagagaaacccaatccgtttcaggccaacttgcacacctgacgaagcacctatgttccttgtcagctttctctctgggatcacaccagaaaccaccaagaaatgcttgcacacaatctaaagaacggacacaggagaagatagtcagatacacgtcgttggatcgacatgtagacatgaccggcgagccgttgattgattgattgatgtggagtgcaaggattgaattgtccatgatggagaaacaaaaaaagagagagaaaaaaacacggcctaaggctggggatcaggaatggagatattggctccctgatatccaggggtgtcatccggggaggcagctaagattgttcagttttagttagcttagctagctaagttagcagtacaagacaaagcttgagatttttatctgtcagggtctaggggttcttgcgtataaaggcttcaggtgaggtccattttaagccaagccaaagccgcatctggataagagaggcgattcaacagtgcttgtcccaaaaagatcaaggaactccaagaaaagcaaacagtgcttgtcccaaaagatcaagaaactcgaagaaattcatgtgcccatcacaccaaggtaagatcagtagagagaagaagaaaaaaaagacagaattacattgagcttttcgtcatctgtttatctgttcttgtatttgtgctcataatgctgaggattttggttgatttgtattggagcagccatggaatccatgagcattgaggaggagtacatcagcacgctgcacacgcgatccaacgcgcggttcttctcgaggagcaagcagcagctgtccggggtggagatggaggcggcggcggcggcggagcagcaggacgccgtcgtcgtccccgcggagttgcagcggatgatgcaccggaggacgtcgtcggagatcgagctagcgatggcgggctacttcgacgccagcgacgaggcgtcggagatctgcaggcagctgctggcgaacatcaagaacgcgcagagcaactacctgtccatggacagcttcctcgccaccatcgtctccgacagcgtcgccgccgcggcgacgacggcgccgctcgcagccgtgcggagcaacccgttcagcgacgcggcgacgcggagcagcttccggcggatccacgacaggtactcgtccatcctccgcgccatcaagcgcagccacgggaaggtggcgaggaagctgaaggtggcgagggccgtccggaaggcctcccgggcgtgcctcgtcgtggcgtgcggcgccgcggcggccgcctccgtcgccgtggccgcgcacctcctgctcttcggcctcctcgtcggcccgccgccatggcgctctgccccatggcgctgaagcggaaggtgacgaacacgaacgcggcggcggtagcaaggccggcgaggcggtggtccacgacggggtcgctgctgcggctgcaggagcagctcgacacggcggccaaggggacgtacgtgctggggcgcgacctcgacacggtgagccacctggtggcgcggctctccgacggcatcgagcgggagaacgccatggcgaggcggtgcgcggagagggtggccgccgacaacgtcggcgccgccgccgccgccggcgggaggttcttcccggtgcaggagatggcgaacgagctgaggagaagctgctcgagctcgaggaagctcgcggaggagctggaggagcacgtgtgcctatgcctcgccaccatccatagggctcgacttctcgtcatcaaagagatctccaagcaagcatgaactgaaaattaattacttgatacatgattaattacatctaggattaatatagtttaatcatagtgtacaaaatttcatgtataattaggagtagttgatagagatgattaattacagcttgtacataaattgttttttcttccttatatttagtactaacaggattcagggtaagtgacatggttagaaataattttgagaagatttcttaagattgagggtctatacaaagatcacagagttttggtctcattggccatgcccatgactcactaattaacattctttcgaaatattagcagatcatacatcattttttctttatgaaacgaattgagacatatgaccacacactcaagctgcttaatcacaaatatcagacacctcctgtgttcgctccttcgggttgggaacccaagcttctccacaacaaaacagagcggtacattaacatgtaacatgtgattaattaagtatttactatttttttaaaaaatggatcaatatgatttttaagcaactttcgtataggatttctttttacaaaaaaggcatcgtttagcagtttgaaaagcgtgcgcgtggaaaaggagagtagggagttaagaatcagctcttccaaacagagcatattgcagtggcataattctgattggcacatcaaatttaatgagaaattagccatatattattctatcaatccttgacccagaaacttgggcttgtgggttgcacttgggtccttctacagattttgttgcttgccggaaatttttgtttttcttttacgcgattagatttccgctctattaaatagatcagatatgtatcaactaaaagtgtacacgcgaatacatcactctggcacgcgcttaaaggggcggagtcaaatgacaaatatctagtctcatcgtaatcctatttataagcacatccaagtgtaaaatgagcgtaactcaattggttcattttcttgtggtggaaccaacctatttggttcagtttctcgtggtggaaccaatccatctgtattaatggatagagagtatttaaagtcgtgtgtctgcatgtatattggcgagatatagttatgactatgtgggcctacatattagcgatcatatctctttgactgtaagttagaggatttcaatatctcaattagcacttctctttgttacaatgcaaagttatagatcggagaagtactcttttttttatgccttattgtttcttacatgtcattatatatatatatatatatatatatatatatatatatatatatatatatatatatagaaggggtcatatgcacacaggccctcgcgtgtacacaccgtgtacaccaactaaaaattatcacaaaaaattttaggaaaattcatacatgtactttcaatagtattacatctacgtgcaaagtagcatcttcaaattcattctacatagagaataacaaaaaagataaaattctgacaaaattacaaccttaaagctgtcagattttttgttttttttgttacggctaaaatataatgaatttgacgttaaaattttaaccctaggtgtaatacaattgaaagtatgggtatgattttttctagattttttggtgacattttttagttggtgtacacgtgtgtacacgtgagggcctgtgtgcataggatatgttgccatatatatatatatatatatatatatatatatatatatatatatatatatatatatattaaaattgttagtgctccatggtgcccatgctccaaaatcatcccccgttccatccgtgcaaataaaaactgagtattaatcaaattagcgggtttaacccgataagaaatatttgtatcaggttatctcgtacctttccattttttcatttgcatgcatgcatttccaaatgaattacggattttgaatgtgattgtatataattagttggattgattgctttccatgtatatgaatttaa

SEQ ID NO: 3054 - DNA, 1190 bp, Oryza sativa
atgtgcccccccccccccgaatttttttatttttgttttatttgtttgatatttttttcacgcttagggacatacaagaaccaaccatagaaaaattgaactcaaatggacgtaatatgtgacatgtagaatttttcctctcctctcctctctccgaactagtgcagaggagagagatgtgcaacttttttatttttattttacttttttgatatttttttcacacttaggaactcacaggaaccaaccacgtaaaaaataaactcaaacggacgaaatatgtggcatatggaattttccaaagctccaccgaaaaacttctctcctcaaaaacacaatcttgcaagcggaatttggaggttttaatatcgccgaacccggcaaagcgggggagaattggatgtaactttttctgtagatgtccgtgcatatattatttgcctgattccgagtccgtatgagaaagttacgcctattttaatagatggcatattttgttcgtttcggtagagttttggaaaattctacatgtcacatattttgtccgtttgagtttattttttatacggttggttcctatgttctcctaagtatgaaaaaaaatatcaaaaaatgaaataaaaataaaaaaattgcatctctatgtactgtttaacttatatatgtcatttcatatggttatattttgaatatggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttatggttggttgtatcgtgatcctgagtgtgaaaaaacatccgaaaaaataaaataaaaatgacaccgttgcaactccatacagagaaacaggaatggaggcggcggcactaggctggggcggcgccagcatggctggcgccctcctcctgccacatcggttcgcgtgcgccacggtggcaggaggacggcgccagccatgctggcgccgccccagcctagtgccgccgcctccattcctgtttctctgtatggagttgcctcggtgtcatttttattttattttttcggatgttttcgcacactcaggatc

SEQ ID NO: 3055 - DNA, 30803 bp, Oryza sativa
taattgtcggtgtcagctgactcggacggatacactgtacatcatccacgaggatcacggccaaagccggtagtcattccgttctagattataaattgttttgactttgtcaaaattaaattgctttaagtttgattaagtttgtaaaaaaatagtaacattttcaatataagataaatatattaaaaatattttttcggggaaattataaaaatattgactttaatcattgactatattttcctataaacttagttaaatttaaagtaatttaactttgatcaaagttaaaataacttatactacgaaatgagggagtatgtactcagcacaattggcaacatcattccccgcacgatctcctacccccaatgcaaacgactgatcgaactgaacaacattttctcccctcctgaaactgtggatggcgatggccatattcagcagtaccccagttttattcatcgctatagaaaccgtgtgtgtgcatctcattctccaattagacacatgggcaaagagctcaactttgaccattcacttctcattgtgccggcctgtttctagagtgccggtgagccgtgcacgggactccgaaagaggcagattccatatccatcgatctaggggtgaacagaaatctcgaagctcatcgctcgaatcggtttgtaacgagcttgattcagatcgactcaaactcatagttttaataagtcaagccaagctagaattttaactcgtgaatttaatgagctactcgtttagctggttagtacagaagatcacctatctttatatgcttagcccttcttagctaatgatgtttagttccttaactacatccaaccaacctacttgagtttagtgaattttttattagtcagtgtttattattatttatatggaataaaatgataaatttagaattatagaggtgaaataaatatgttaacgagtttatttcaattttataattctaaattttattagctcgttatccacccctcatcgcggccgttttgtcgttcgtgaccacttgaatcatatacggctttagacagatcagtagtgctctgcgagagcttcctgtcgatcgtgtgtttctttttctaatttttattagtgcagagttaggcgaactttgcaaatgcgtagatagctaccataacacacgccgatgactcgtcggagatgaccgggcatgcagtgttttacttttcgtgttcaaaatgctaatgctaccatgcattgttctgccaaaccgtgtgattagcttaattaccgcatgctcctttgttttacattataaattgttttaatttttcctaaatatttttttaagtttgattaaatctatgaaaaaaatacagtaacatcattagcacaaaacaaacatattatcaaactataataaatgttagtttttaacggaactaattttgtgttatatatgttattaaatttttttataaatatagacaaaataaaaaaatatttgactagaagaaagaaattcaaagcgacgaacggagggagcaggaggttatgacgagtttgacaatcactagctcgagtcgtgccgttttgctcaccagtcacacatcgcacaatcgtcgactcctcgtcatccgagaaaggaggcgtgtgcagctgcgaccgcgggccgtcaacatatatccgttcacagtcgaaagtcggagcacgagaaaaaaaattaaacgcacaagcccggcggccagtcgaccggggctcatcctgggcgactaggggtgaaatgatgacgaaaaattcccaatcgaccgaacgttttcaacctttaccctttttagctatatataaaaattattctttctaatttttcaacatcgtattgatgttgatattgagtagtttaaataataaatatggttaattatcggctgtctggggtgggtttaaccctctctagaaaaactagagtcgagaccagttgctatctattcttttatgtcgtgaaagcattgttttagaagaatgctcccaattctaatcgttactgactgttttcacccatactcgcaatgacgtcgacaagaatttactgtttgccatccttataggttcaaatgtcactctttgaaattttcatttccatttgtcatccagtctaactctctcgtgtgtcactattcctacttttctagttcacttggtgttacatttgtattttttttcctttctatccgatgtgtcgaatgatgccaaaagactgaaatgcccttgggtccatatgtaagaggcttctcccgccctacccaagctgaaccaaaagagaggagggggagacagagccgctattgggaagatggagcccagcgccgatgctgatacatcctccccgaccgcgaacaccacaaaccatgccccctccccaacgtgtagaaccacccagcctcaacgtggtcctagcaggggcggatctatagttataggaccggtgtcaggcgacaacgacgacttttggcaaaacctatagctaaactgtttattcatatgctataacaccatgatctaagtataattagcatattatgacatcgatagacgcgttctgacaccaacaaatcgattttctggatccgccactgggtcctagcacactcctcctatctatcctcacctcctgcgatgccggcgaagaggagaatagggggagacgaggcagagaatcagcccacgacttgcctcaatttttaaattttgaaaactatcaacttaaagtttaaagtttgaaagctttcaactcattatttcaacttttaactcggattagaaaacttttaagtcaaaattttagaaccttcaactcaatatttatttaagttttaaattttgagttaaaagttttttaaaatttgatttgagagtttcaaattttgagatgtaagttttgtagtttaagttcaaattttaaattgaaagttttaaatagaatgttttgaaatttaagataaaagatctaaattataaaatacattaaaaataaaaaaagtacgctaaagattaaaaaatcgtgaaaaaaaggaaaacgtgtcaggaagtgggggaaagcgtaaaaaatggaaaaaaaaatcgtgcgggagcgtcagctgacatatacgcgtcagatagcaatccccgagatggggccatgggatgggaagaaattccaaagtccaaacctgtgtgtacgtgtggggtagtcatcatggtcctctgtgtttcctgggaatttagaaaccacggacgtgttggatgtatgtgagtcaagtggtctctttgaacatacatttgcgtgttcgctgccaggactttctgctcctatatcctcgttccattatcagaaactgattacgtgacagtgtagaatcatggatataaaggtgttcaactgtgggttaaattagaaaccacaatgcttacaaattccctatatcgtctcaccataagtagcagctcgtctagagttaaaaatgacccatttgttacctttttttttttcaggagacactctcaatcataaaatatggcaatctaatattggattgcatataaacatatactacgaatatagataatgccatatcttgggatggagtgagtagaacttgactgactgctatgaatgtttgatctacagtacaataatgaattaagcaatccaaataatttataaatacaagttttatatgtgtgttttttacggtttaaattatcttggaagataaaatataatgtaaaagtaaaatttgctataggacatctaaagtttataattcttggtgttgaacacctaaaaatgtgacatggttgtagaaaaaaaactggtaattcactaagagacactatagtcattattttatcattttcaggaaaatgaggaaagaaacttttagagaagatgagtttgccccctaggccaattgcttgtaatggcctctgtcatgggccctgtctttcaccgcctccaatcttaaggtcttggagaggggattggtagaggaaatgtggcttggatctggttccagatatgttaaatgataaaataataacagcagtctcccctaataaatcatcggttttttatgtcctaaaattgagtttatgttttttagtgtccaagagtaaaaaatcataaattttgaatatcccatagcatacttttaccaatgaaagaaaaaccttagtgttaacttaaaagtaagttttgaaatttaaattttgattgcagcatataataaaaaaaggagaatgatggttcatggatagacctatgatatgctaatctcactcgacgattatctttgacacaagaagtttagtaatatatttggcttgttggtatcagccgcaatcaaaattcaaattaattttagagcacatatgtgacataaccggtaacgccatccgatccacgagaaaggagatcgtgtggtttcatcgtccccgcacaatctcctccctcaggatctccactccaataaaaacgacctccatttggccattctctatctccacaagcaccaccatttttctccccacctgtggaaaccatggacggtgatggccatattcagcaattccctcccagcttcttctttgtgaaaaccgtgtctgtgcatctcctcctccgattacacattgacaaagaaatcaactttgacccttcactcctcttttccactaaagaaggatccaatatatacccatgaggacatgatagtgtcacacactcacacactactcttcgtacgggcgcacatccagcttctagattgcccggtgagccacacgtgactccgaagaaattaaaatggattccatccatcgatcatgtgtccgcttcgttcgtcgtacgtgacggcgtcatcacctgattacgtacgcctttagacacagattagtgctatgagtatcgtgtgcctgttgtatattgcatgagttaggcgaggatgcatattgttggcaatttttttttatatatattgtagagacagattcgggattggactctgctggtcataccagccacacaacgctggtatgaccggtctactggcggtggtctaaccggtcgacacacgacgatcagatcgaccctctcagagaaaaatcggtagaacgtccaaactttggtaatttttctattttaatcttagatgttaaatttgggtataaacacatatgctcctagatctctctctatagctttacaaatggtgtagatagcatgcataacacaatatgaaatgagtataggtatgatccacgttcgattcaaccaatgcataaacacatctattatttttctaagcccacataaacagcggcagaggcagtgactaaaacctgtggggttaaagctgtaaaattatttttagttttctattattgtgacacaaatatcaatagtttttttttggctgtttcgcgaaaacaagtggggtcagctgatcccatagattactgtagctccaccactgcacatggagagaaatagagcacaagaatcagtgaatgagacgtagtcggatgctaaccatataatatggtatgtaaagcaagattctaacacaattaacgatgaccagtagatctgccactgaccgagtgaccggccccggcccgtgcatgtgttttaagcttgatccagttcaggtgcagtgggtagtgtgaaacagtcacacgagcaccatcggatctaaaacgggcgtgatctagatgtatctaaacacagtagcaaaacactgcagcgatttattgtggcacagtaaagtttcgatttaccgtggcaattaggggtgggtgttcggtctgaccaaaaaattcggtctcggtcttcggtctttcggttatttcggtctttgaaaagtgaggaccgaatttcttcccaaaaaactcaagaccgacaaattcagtttcggtttttttggtttcggtctcggtctgaccgaactttcacagagggctagctggagacggaggcggtgtgatggcggcattgaggcagaggtggagggcggaccggcggagggcggaggcgggcgacgaaggcggcgccggcgcgatggaggtcgaggacgaccggcggagggcggaggcagcgcctgcgcggtcgaggtcgacgacgaccggcggaggtggaggcggagggcagaggcggtgccggcacggtggaggtcaacgacgaccggcagaggcggcgcgcggagggcggagagcggaggcggcgccggcgcgatgaggcggaaggcggagacggcgccggcgtgatggagatggagggtggaggcggaggcagcgtgaccgcacggcgcgagcgccgagcgcgaggggattggtggcggcgctgcgtgaggctggtgggagaggagggagtgtcagtggttccctttagggtttagtagtttattgggcttatcgtgcctcctagatctattaggccacaattcggttttctcggttaattcggttaaccgagaccaataaccgaattgcccaaataaatttcggtctttcaacggccaagaccgaattactaaccgaatttctcggtcttggtcgtttcggtctcggtcttttcagtctcggtatcggtcttttcagttcggttcttcggcccggtcttattttgctcacccctagtggcaattgatttggaccattggatcaaaaaattgagaactcagattatgtgcaatctatctattatattattaaaggaatagaaaaaggagcctccacgttcgctctcatggcctagacattctcacattaatcggagaaaaagaaaaagcagagtccatatagaaatacaatttagaaatagctgaaattcggaattaaaaaataaggaatattataataggagactagagtccatatagaaatacaatttagaaataattgaaattcggaattaaaaaataaggaatattcgaagaggagactagagtccatatagaaatacaattagaaaataactgaaattcggaattaaaaataaggaatattagaagtagagtatagagtccatatagaaatacaattagaaaataatagaaacttggaattaaaaataaggaatattagaagtagagtatatattctatatagaaatacaattaagaaaacaatagaaattcggaattaaaaaaataaggaatattagaagtagagtgtagagtccatataggaatttaaaactaactaaaatttggaataagcataataaaattaaaagtaaagtttagagtccgtataaaaatataatttacaaataactaaaatttaaaattaagaaaaacatgggaagaaaagtttaaagtcaatatagggatacaatttagaagtaactaaaattcattaataattaaagaatattgaaagatgagtttagagtctatatagaaatacaattagaaataataaaaattcagaaataaaaataaataatagtggaagaagagcatagagtttatatagaaatacaatttacaaaaaattcagaataaaaaaatatattaaaagacgagtctagagtccatataaaaatatatataatttataaataactaaaatttgatattacggccttatgaccagtcacatggcgcaatcgagccaatcgtcgaaaggaggcagctgcgaccacgcgcggagccgtcggctactcttggttcacagccggaagtcggaacacgagaagagaaagaaacgcagaatgccgacggccaatcgatcaaccggccgggctctggtcaggcgaacataaaagaaaaattatagggattcaatacatagcactccctctatcctaaaatataagtatttttagactctgatatggttttcgtgatgctattttgatcaataatatttataaaagtgagatgttttaaataaaattacgataaattgtttaatgataaatatattaatatcaattttacatgattgatattttttatttttttgctattaataattaaagttaaaaatgtttgatttatcactatgctaaaaatacttatattttagatggatggagtaataattatctaattattagttggtgtattaattaaaatgagacattttagctaggattggataactaacccaaggtcctctgatcctggattattgaacgtgggagtgcaactgtcgggctcaccgtcgcgccctgcagtggtgggaaaatttttcacgcatattgctaatctaatgaaaacattaattttttttttgaaattagatagcagcatttattatcccatgtctgtttccgctcacgccgaacattctttatcaccatgaattatctgcttcacgtcttttaaaatatgtgtgtttatttaatgttttaaactaattattaagcttatttatcaagacatttgacttgtatgtatagtcatataaataattgttagaataggtgtcgaatatactattcctatttggttatttggttacagttggacttagagttgtaataggtgttagggggtggagttagagtcggactctgtaacccggcaactctcttaaatagagagggggacaccacaatataaccatggcgactacaatgtagcatacacacgcagggagaggatggcggcgtggccatggactcgtagcggctaggaactatattggttggggagaagcgcccataattagagccccggggatgtaggcttcggctgaacctcgttaacaaatatcgtgtgttcctgtgtcgtcatctggcatgtcttgagtaatcaatgactgaagcgatcgggagggttagtcgtctttccgctatattgactaacttttataacaagtggtatcagagcagaaggtttcagcattggatcaagaagacatgtggagaaggaaacacgaggtgggatcgcgcatcgataggagatcgtcagtcgtggcgatgagatcgatggcgacaacgaggacgttgcggaggcgacgacctcactcgcgatcagactgacgatggcggagcgtgaccggaagacgaggccgggcgtggccgaaggcgttcggagagatcggaggggtagcgccatggacggcgcgcccgacgcacgtggcgaacgcggatccgcggcggcagggaggccactgacggaagggcgaagctggcgagcatggcgcggcgcggcggacgtgcagggccgatgacgacggggtcgtggacggtgaatacgagggctgcgactgcggtgcgtgcaggggcatggacgtcgtgtatggaggcatgacttgtgcacatctacacatgcataggtgtggtttccaagagcagaaccaagacggatacggtgcggagacgtcgacttaagcagggagaggtggcagtgggctccatcgtggaggagtagctatggactctagcgaagaagtttctctaatccgagcggtggaagtttcggcttcggtgtctgatgcaggcggcggcgacgactcagaggaggcataggctgcggcttgtagcaggaggaagcggataccgagattgagtcggggtttggtttttggctcgtaggaaggcaggcacactacaaggaatctgttaatgcatgatgaaaaatttccgtcacggatcatcaaaaaaccgtcactatgcagcacctgtgatggtttcagagatggtcacggattgagcgtcatggattaacctctgtgacggtttaccaaaaaccatcacggattaatggaatcgctgacggttttaaaccatcacgatagagcccgaggcctagttagcccagcccaagttcatttcctatgacgaaaaataaccgtcacggattgaatgccacatcatcatggatgcttacatggttgcttacgtggatgatgacgtagacactacctcaacctatttattaacaggccaaaatcaaagatgggccaatttttagcccaattccatccattttcgcagctccttttcagccattttggcagcccattttcaatagctttacaacccatttcagcagctttgcagcccaattttgtcaccattttttggtgcccttttcagcccactactacatcgcttacagcccatatatacagcttaatttcataactaaagcccatatacacagcccatgcaactaatagttgcagcagcaaatcaaatagaaatatcatttttccattcaatatcatatcacatgatttttcatccaacatcagattacaacattcagggctcctttgattcaaaggattggcataggacttttgtaggatttacaatcctatggattttttccatagtatgtctttgattcataggaaatgaaaggaaacgttccttaggattgcattcctttagttcattttcacaggaaaataagaaagaggtctgacctctttggaaactttcctggcgcgaaagaagggcgcgcccacgcgtgcgcacgtcgtcgttggcgccacttttgtgtgtttggcggtaaaccgtggcccttcgcgcttcttccagaaaaaaagagagagagagagaaagatgggaacgagaacaccgaggaccacatattagcagccaagaaagccaactgtgatagagatagacagcagcttgagccggccgctgggggtgcaaggcggaggcgaggctcgccggctcagtcgtgtatgcggcttccgctggggacgccggcccaacaactagcagcacgcagcaaccaagcacagcatccatctggcgcgcaggttgggctccgctaggcggaggcgtgcggcaggtccgccatcgagggcagcagccagggccatcgatttggtatttgtctgcacttttgagctttcatacttgacttattattgacttattagtgcttctgtactttggatctatggattagtgaatttttaagctgactacttggaactagtttgtttcattggcactgtaggtgtaaatccctctctgataaggattgtgtatttcttttttctttcttttttttggggggttaggaaagcaatgccatcgaaaggctcttctcagatgaccatgacaaatcaacgcaatttgtccgatcgacgagcccagcaacctctatcacaggtttatgttgatgttgacagtgagcatgggactgcagagcgtcaagaaataggtaatatttgcaaattcagtttcacttgttgtttgcatcaaaccttttttgtttcatattgctgctgaaactgaaattgttaaatgtttgtcaaatttagggacggcaaagagagccagatggagtcaccagatgaagatgttccttattgagctcctaacagatcatgacgtgccaggttttcgaacacaaaatgcttggagtaaggaagcatggacaaatattgtttgccgcctgaatacaaaattcggtacatcatttacgaccaaccaagtcaagcaaaaggagcaggatttgaagaaagattatcgcagtgttaaagatttgttggatcaaagtggttttgggtgggatagtgacagaatgatggtgagtgcaccacaaagtgtttgggacacttttgctgatcgcaagaacaaagatgcaattcattggcgagataagtcgttcccatattttgatgatttagctccactttatgatggtgagctttatattttttttatcagtggtttgtttgttttgttgaaatgttttaggcaagttatgctgatcgtgaggagaatataattgtgcaggtcgttatgctgaagggagaactcgccatggtatggaccattatgcaaggaagacaaagaatgcaccagctcattcaacacaagaagcaaatgcggttgatacatatcagtcaccatcccctaattcaaatgctccaggtgaatcaggtttgcaatttccttttggtgaagaggttgagacagccaatttggacttttcacagcattcacctacccctgtccatctcacaaaagtcccacctagctcggcacaaacaccttcagaggttcctgaatctcgacctgggaagaaacaaaagatcaaatctgttagtcctgatgatggatttcatgagagatacctaaaacttaaaaaagaagacatagatcgatttgctgcaattgaggagaagaaattggaggatccttacagcatcaacaagtgtatcacagtgcttgaaggtttacatggtctacaaataggagatatattggtggcagctgatatcttcaaaggtaaggataatagggaagttttcttgtccttttcaagtgatgcattacgcctggcttggattagaaaggaaatcgcagcattagagtgagtacttttgtgaaacatatggcatgcaagtagtaggatagtacttttgtgaaatagatggcatgcaaatagaaggatagtacttttgtgaaacaaagggggtacttttgtgaagcagatagtagtaggatatacttttgcttagagggagtgcatgcaagtagttacttcattaagtagaatgtgacaaacttggagtacaagactagtaattgaccttgaatgccatggtggtcaaatgcaatatattatttccttcgtgctacgtaatggttccacatccgttgtgccatgtcatctcgttttctattcccagcttctctagagttgttaaattcttgtacatcaccattatagttctcgtctccatttggcacatcaacaatatgatctggatcaatctccaaacgacaattacttggccacaccatatctccattatgcaggcgtatgaagttgtgtagaacacaacaggcaaccgaaatatcaacttgtttacgagctgggtggtgtgagccggtctttagtataggaaatctcatttttaatacaccaattgctctctctatatggtttttgagttgtgcatgccgaagattgaataactccttataattttgtggcttttgattagctctgccctgttcctttaaatgatatcttgtcccacgatacggtgctagaaactgtgttgtatttgcataaccagcatctacaagaaaaaatttaccaggaggtacttcaaaaccatggtttagtgcatcttgaagaactcttgcgtctgaagctgatccctcccagccggcatgtacatgtacaaatttcagatcgaagtcgcaagctaccataacattctgagaaattgtttgctttctattccggtatggttcttgctggtctagtggaagtatcattggtacatgtgtcccgtcaatagagccaacacaattctatacaaatacaaatataaccttgattaagtctttttatgtacaatgattggtttaactcaaagtaaaaaaaaaatcaaaacatgaatctgttcatacctcaaaaaaggggtgaaattttggtcttctcaagatatgatgggggtgtaggaaaggtggccgtatatatacacatgtaagttgtgtaactgcatcaagcacaaccccaaaatacttgcttattgtttgcccgctgtgttgaaactgatcttgcaaggtctcattacttgcattttttgctagtgcatacaagaatatagcaacttgttcttctactgagacatctcttgcatcagcaagtagttgtttctcacgcaacttatcgactaaagctcgaaaaacattaacttccatgcgaaaattccttttgcttaggctctgatgacctgttaagatttcattaacacgacaagcccctgaaagttttgatgtgtgcatcggtttcctactagatgatggttgtgacgaatctccttcgatggtagggagaacaaaaagcatgaactcatcttcattctgtgaccgtcgtcgataacttggatccatgacaatcacaggggaaatcaacaacaaataataaatctgatggtttggtctaccaatatatataggagagcagaagcaagcaaataagttgctaatccttacatacataccaaaaagaaaaaaaattcatttatgacttaccaaatgaattgccacgtttgagctcttgtcatgcttggccgatacaatcgaaggtgaggtgagctagttttgttgatgtccagttgcagctacagcaatatatataaggacatgcaacggctagtacttgctttgaacgccaacggctatctgttcaaattcaaaccggaagagaaatcctgtatttttcctatagcactatcaaagggcacctttcattttttcctatgtttttgattcctgcgggattgaagaatcatactacttcaattcctgtgtttttcctattcctgtgtttttcctatcctgcgaatcaaaggggccctcaaagtgcatacaaccttgcagtttaccatggctcaagccaacaacaaatagagattccaagcaatgcatacaagtctaggagcttaatgaatgctgcggcagcaaaatgcaagcatgtatagcttagcttagtcaaaaattgacttgacacaagttagcaatagcagcaaaatgcatgtagtagcaaaagatatagcatcatgcatgaattaacttgatcgaacttgactgagcaaaagattaagtttccgcttccatctcagattgagtcctcttcatcgaacttgtagacagcttgttttccatttgagtctagcaagcaaggagcaaacattgttgttgatgagagaattaaaaataagcattacaaagagcaaagtttgaaacttatcttacaatagcctattgtacagcagtggtgtagcatttttttttcttgctgtagtggaactccttgaacaaatcaaatgcattaggttcttcttcattgtatttgtcacgctgaaaacaacatatatgcattatgtccagcaaatgtgtacagtgttgaacttaaaaaaaaaggatgaatctagatagcatcaaatcaccgttgagctgatcaaatcaagcatgatccatggtatcccccaagtaagctgttttctgcacctctttttctttttgttggcaaatggattaaaacattattcagttttgaagatatctgaaaatatagcaactgtggatttctgaaaataaacacattctttttttatctaaaacactttcttttttttatctagtttctatgaaactttcacgaatattctttcttatttatgactgcacttgcatttgcagaaacaaggaattcagttttttgtcagagatcatattgttacagcatgaattgacttgcttaactaaattagaggtttctgcattcatcagattcaggaactttgataagcaactagcatcagcggatagagagagattggttacagttgggatgcggtcgctcgcagtcgaagttggggcgcttcaccaatcaccagtccctctcacagtagcagatcccgcctccgccctcctgcacatgggtgaggcacatgcgtcaaaactcgccaagaaaactaatgcaagaaacaaagatagaaagactggcgcctctcctcttctttttcatccgtgtcaaaccgtcctcgcccaccatgatcgcctgccgtgctccctatgctcacgcgtgcagcagtgcgtcgtcctcctcgagcagcctctcgatggacggagctcgcgagatgtaggaagcaggcgcgctactgggaggggatctgcgccctgacctgctgccggagaaggaggaggaggaggactcgtcggagctctccctcgccggtgcttcttccacctcgattcacgtcaccggtggctgccccggatgctgcgctgcacgccccctccgggcccgagaggcgccggcggcagcggatccaccgctcccgcgcctggcagcggtggagacggatgccggcacggcaagcggcgaagggggaggaagccggcgcggtgagcggcgcccggcggcggcggagacggaggccggcgcccagcagcggcggagacagaggccggcggtctcatctgcagtagcgcctcgcgtgtggtggcggcttatctgatttggatcggctagggttgaggaaccaatgcgattttactaaaatacccatggtgcatccgaagttaccactaaaatatctggacaaaatggtcatttcacgttgaaattttgatcaacatcccgccacactgaaagtttggcgcccgctgctccttcgggccgccggcccagcgtctgtttttcctccctcctctcaattaatttcaaaatattaaaacttcaaatcgaattttatcatactaaataaatttatgtgaaaaagatgtcaaaaacaaagttatataacttaatgagatctacaacttttgttttggtcattttgctatatgactttgtatcaaaaatttgaatttgaatttcaaattatgacaacttcaaacaatattttcaaataataaatgatttcaactgaaaaagtcatcaacaataaagttgtacaactcatcaatatttacaacttttgttttggtcatttttctatatgacttggtttgaacaatatgaatttgaatttcaaattatgacaatttcaaacaacattttcaaatactaaatgatttcaactaaaaaagtcatcaataacaaagtggtataactcatcaagatctataacttttatttgggtcatttcttcatccgttaaagcgaattgtaacattattcacaaaatgtacatatctcttatacagtttataaactatgagagagatatgtaaattttataaataatgttattattactttgtcggatgaagaaatgaccaaaataaaagttatagatattgatgatttatacaactttgttattgattactttttcagttgaaatcatttagtatttgaaactgctgtttgaagttgtcataatttgaaattcaaattcaaattattgaaatgaagtcgtatagcaaaatgaccaaaacaaaagttgtagatcttgataagtcatacaactttgttgttgacatttttttttcatttcaaattatttactaccagaaaaattatttgatttttcttatatttaaaattcaaattttatataggtcaatcaaagtcagatggagaaataaccaaaataaaattgatagatctaattaagttatacaactttgtttttgataactttttcacataagtttatttagtatgataaaatttgactcggattttttatattttgaaattaattgagaagagggaggcaaaatggacttctcggcgaggggggagcaaatgggctaggctggcagcccgaagaagaaggaggggaatgggaagccggcccaggacggagagaaaggctgcgggctgagggagggagagagtaacacttgggccaaaaaaggcccaaggacagagagatattttaatttattttccatttattttaataggttaaatgaactttgtggtattaaaactatttattgagctccgaaaattcacggaaaattttagagaataatttagaccacttagaattttacaaaaatatttccggccatgatttttaaaggaaaaatttagtttcctcattaattcacttgattaaattgctttaacttttaatatatttcctgtagtgaaaagtataagtgagtgcatacataatcaactaaaagaagtagctatgaatgttgctggataactataggtgttaggttaaattcctacaagctccaaatattttttgttcgcacactatatatatgcaaatattttcagttttaccatatgcaacatatacaagtaacaaattagtaacaaaataatttagttcaaaaaaaatttgtcttttgggtttgatttgttttgcaatcatttactgcttcaaaatgttgtttgaagttgccactttttgaaatttaaatcttcaattgataaaacaaagtcacatgaaagtatgacaaaaataatagttgtaatagcacaataaatggatagatcatgagtttagaaaattttataaaaaagaataattaaagttgaagttagtatgagggagataaactaatttaaatttttatacacgcattaaaagtaaaaatctgcagctattctcgtgaattttatgatgaacaccacgagcaggtggcaggtccattacctgctacagtttgatatataaaatacagtgcacgtcgtttggcaaaacgcttcagtggctcagtggggtttcctcatgaatactgtgcgtgttgtcgtaggttcgagtcccctagagggctacatttttttgtttcttgtttttttacaaggcgcagggtggcctgcggctagcctgtcttggctgcccatgtggaaaatgggccgctggcccagctgaaggggcagagcgcgagagggaggctggcccgagcccaagaggagagagtgagccagaaatggtccaagagagagtgtagcttttcatttttttaaattcatttgaacctcaaattcaaatccttttcaagcaaaacaagttttgaaatgccttttgattatcgtcacaccgtgatgattttaaaatcacacactgtgacgatctggataaaaccgtcacgagttaacgggccaagaatatccactagtgcacgtccatgacggaaaacaaattatcgtcacggattgcctctgtcagtgacggtttatgaatccgtcaccaagaatccgttatggattaacaagtttcttgtagtggcatgtgtaaaaagtgcatggaccggtgttaacctccacaaagtcaggcggtggaccaagaaaaaaggagagagtagtagtcttttgctggtcacgttaattatgatagggttacatgtgtatgcaagcatatgttggctgccatagtacgtgcatgcattatactactgtgcaacattggtttacgtatggcagggagccaggaagaccaataagctagctgtgtggtggtgctaattaaacgtggagatcaaagcgtgcaaggctaccaggagtctaggacgcattggttggcataattaaggtggtggtgattcagtagagagatgcacaggcgcaggggcaattggtgtggtgctgccatgataactaagacggaacttgtatggtctacggtgacttaggagatggtacatcatgtggcattcggtccagagaggatcgaggctggttaaactgggccggcagggtggttagaccgacggactggttagactgcggagcttggacggttagaccgggttcaacggaccggtggttcgttgcagaaacttgtgagcggattcagaagaagggcaaaaaggttctacggtctggatagtttgcaagtgacaatggcgaatagactggcggcgacaggtcggtcaggtcgcatatggaattatctggcagacatgatatatatgggactcgacgaggagttgagatatatggagttagaccagaactgaagggaaaaaaaagatcccgggcaacagcgggtcaaatatcgttgatggggtcaacgaaactgtttggcaatacaggatatatccaggatatgcaggtcggcatgatgggggatatatggaaatctgcgtcactgaagaggaaaagcaagcgctatggtgttaatttcttcaagggattcaaggcaacagtgaattttctcaaagtatcataggttcagtctacggatgcgggaaagcgaggatgttggatttattagctcggttcataagacaacaaggaagaaatggttctcttcaagtctggtgagtttgatttatctatttggtgatgacataggttatctggccatggattagatcaattcaaatttaagatggaagatggaggtgaacatggtcttcggggagtctatgatgtgacagctaggaagaaatccaatttcgcttggcaagacgactgagatgataggtaagaaggtggagcactgttgcaggtggattcaagaggaagaaattgcagggatagcggagtctcttcaaggcggcgggtctggcgcaggctcgtcaggcggctcgtggtgaagctgcaaaaggaaacaacccaagtctggaggacagatggattggcatggtgattctactacttctgggtggcgtatattcgccaaggtagagtttgttagaataggtgtcgaatatactagtcctatttggttacagttggacttggagttgtaataggtgttaggggtggagttagagtcggactctataacccggcaactctcttaaatagagagggggacaccacaatgtaaccatggcgactacagtgtagcatagacacgcagggagaggatggcggcttggccatggactcgtagcggctaagagatatattggttggggaggagcgcccataatcagagccctgggaatgtaggcttcggctgaacctcgttaacaaatatcgtgtgttcctgtgtcgtcatctggcatgtcttgggtgatcaatgactgaaacgatcgggagggttagtcgtcattccgctatatcgactaactttgataacaatactctctttttttagagctagggcatcactgcccccatttctattaccagaaacgggaataagtgtcttacagagcaagagaggagagggagaatagcagaaaaagaaaaaaactagaagcagaaacctcaaagggaggattacagttttcctttgccccagaggagcgaacacagagaacatagcagtaacaatgatactgctatgttctctgattaatactacgtactccacaatgatactgtcagtcaagtgtcaataatccgttttgaactcaggtactggggcttccgctagttgaccgatcagcttgcattatgcggcgcactagttgtttgtttacgcgttggaattcttgagcgaaagcgactgcatgtagccttacgccctcgttaatccgtttagtgcttaaaaacaggcaagaaatcgatgccaattttccttttttggtccttattagtcagcaaacccagtctgttttgccgtcttagaccaaactatttgctggttgctagtactagttattaaccatggacgtttcttcgacagtaaccgtggagtttgttttcagaaattgattatcaatccacagctcttatcttcaaactgaaaaaggtcgcaagataggatcacatgagctcaccatcagcataacgagatggcagacagcgacagggctagcgtatgcatcaactccggacaaaataatatactataaatatgtaaaaaaatagaaagaaaccatagattctttgatcctactcctcgatcctcggttcctgtagcagaagatcatgcatcaaaataaaatatttcctctattctcgaataattcacactcgtaatattcacgcttatttttgaaaaaaatatagatactcgaaaatatgttgtattatcgaaattataacattataaatataaccctataagttatcattcatcattagtaatttatggtcaaagtacaacacccatggtcaaaagtgacacattagagaacagaggaacaaacaagaaatggagtcgcttgagccagtcacactcggaagtcagaacagagaggatctcaaattcaaagtcaaagggacatggcactttcattagccacctgatacagctagcttcatgaactgctgtacagtaatacaatctttgaatcacactcacatggaaccagaaggtatttcaatcagtatatagcgcggaagaagggggcaaggcacatggaatggggataggagagcgcgctcaagtcaaaatgggtttagttctatgcaactaaaactacaattctatgtttgtatattgaaaatatttattttggaatcgagagagtagtactatggattggctgctctctacagtaaggtgccatcaatttcccaataatcgtacaatctaacccgtgttggttaaacattctcggattctcaagttataagttgataaaaatgggtttcagtagctgggcttgacatcgtcattggctctgtcactaagctcaaccgcgacaacattttagtaattggtatatatgttgcattcagtatgcaacatttcaaggaaaagggcatataacttagcggttgcagtgatctaagtagcactcgaaggttttgatttcaaatctccataggagtgaattttagattgagctattttgagaggttaagttcccaatttaaaaggctgcatatatccaattagatatggaggccggaaaaaaattactcttctaaaaaaaagtactcaagaaagcactattaatccatatttgaagcttcaaatagaatgaagaagaaaatatgcaacatttctttttctaaattgcttcaagagaatataattaatattggtagggaaacatgaagagaaatacaaacagaggcttgattgaaatctgatatcggtattcgccagccaagtctggtctgaaacggggaagtttgcaagagttgggttcaatcccacgaaattcctccaaaatctcccgttcgaaaggaggtctaaaagttaaattcctttcgtggaagaaaaattcttgcgcttcaaattaaaaaagaaaaactggtccatgtgactatgtctcacgaaaattgccgattgtgtactttacacacagtactgccgtactgggcttgtaattgtagatgaacaatttggttcaggtgatcaggtccgggctttcttaaaattgggcaaatcaacgaaaatgacagaaacaggccagatgtcaagaacgccatggcccgtctgtgaacttggcagaacagcccatgtgtaaactcaaagctttgaggtttcaagttttttttttctctttcaaattatatactgtacacgtactattgtcttcttctatccagtatccatggcgcaagcccagtacggataatattttacaattgggacttgggagagtatattttaccacttcaaataatattttcacagtcctgaaaagtatttacaatcatgagataatgcatctggtaggaacgggcacttaccgtagaaaaataatcttacaggtgtcagccaaggaggcacttacccagaattttgtaaaatttactcattaattaactatttcttccgttccataatataagtatttttaatgtttaaattttttccctcgatatagcaactaatcaacctattttcaagtcaaattactttcttgtcttaaccaatcacaatctatcagttaatttgtttatatattttttttctgcttgaaccaatcataaccattctgctctacaatttgcttatattttgcaatgacacaagtatattatatggcacgacaacagtacactagccctgattacccaaattctgccacgatcagatagaaaattgtgtcttccagagaagaggaagagagattctacacttacccatcaaactccctggttatcaccattccatgggctaaaagaaacactagctagtaaccacatgcgcacaccctaatagtgactttgcgtaagttggtttcacaagtcatctttttctgatcttttttaagggtgatcgcgtgcacaaatcctagtaccatcaaaaggttggcacatagaaatttcagtgacaatatgtaaacatgttaggtcacagtcacattggaatgttatgtgcgtgtgtgataatctgattcctttctgaagaataataaacagtgtaattcctctttgcttatgtacattaatcagtgtcagtcttttcatcatcagaattaccggataggagtagggtattacttcttgaataagaaggcctgaacctgtataaaattccttgtcttcaaacccatccattttcctagcttgatagccacccccttttattattgccaaaatcttgtttcgatagttactgtggagattatggttaccccatatctacatggcggttatattccagctggatatacagtaccaaatatagatagaatatttttatgaggactcgggttagattctaaacttgtatgtcaagaaaatacctggtatcctagtcggttacgattgtgttttatctgtaatcccatattccgttaggatatgggttgtactttgtattacggatcccttcccctatataaggagggtccgtgtgcctcttggggcacgattcttttttcccaattatacaatcaataacacactcggcggaatcatctccggacaggagtagggtattacttcttgaataagaaggcctgaacctgtataaaattccttgtcttcaaacccatccactttcctaacttgatagccacccccttttattattgccgaaatcttgtttcgacagttggcgcgccaggtaggggtagcgtcaagttctcgcctactaagtgcgatgggtttcgtttctggcatcgacgacttcgccttccctcccgggcaggcgttccggttcggcagcctcgacttcatcaccaacaacttcggcaagatttctctccttgactcggattcagaccagtcggggagagaccaggtccccgtgccattcggtattctgaactcggccaaggcctactccaagataatctctctcgagtcggcttcaaaccactcggacgagatccaatctactcttccgcgaccagatcaagacgacgggtcctacccctcaatcttgatgaaacttcctgatgacttggccgccgttttcacagccaaaacatctcccactcggagatctaggcgagctccggcatcggccccgatccagtctagatccaggaaggtcggcgttatactccaacctcttgggacagtctcgacggaagaattggatggctccctctgctcccccggcgtcagttctcgaccaaccgagatcctcgactacgacgacttcggctaccactacgaccacggcgacctcgacaacttcgacgacagctatgaggataactacatgcccctcttcttcggcgtattcatggctgacaacgaaacggaagaacagcgccgagcccgagaagcggaccaagatcgcgcacggcaaggagctgaacgtcgctgactggaggaagtgcgacagcgacaggagcgagaacgactacagcgtgagcaacaagatcgcgaacggattgcaaaggaggctgaagatcgacggcaacgcgccttggaatctgggcgccgagcgagagagctcattgggcaacaagacgtcgacgggacatcggtcttccgcaccgcccagcagaacgcggttgcagcaatcactctcctcgacaccctcctcaaggaagacgcactcaaccaagccgatcatgttgtcaacatcttgaaccagacgaagaccatgatcgctgcctcggttccagccaactccgtaagcatccgcaccccgactggtagccgagcccctcacctctgatctcatgatcatcatcagccaagcctcagcatcaccggcacaggatccagtcgcaggagcaggggtcacgacgaacgatctgttcactcgcctcctgaacgtcacagggagcgccgagtcgaacggcctcgctctccacctcatcagcgccccgtcgatcttcgcgacatgatcaaccagcaccgtgcagcacgaggtcaccgccattcaccaaatcgctacgacgacgacgtggatagagtggctaccttcactaatgacctacgtcgagtggattggccagtcggctttaagccgactggaatcgagaagtataacggcaccactaatccggagtcttggctcaccgtctacggaatcgcgatccgtgcagcaggaggagacagcaaggccatggcaaactatctacctgtggccctagcggactccgcccgatcctggctccacggactaccccgtcgcacgatcggatcatgggcggaacttcgcgatcacttcatcgccaacttccagggcacctttgagcgccccggcacacaatttgacctctacaacatcgttcagaagtctggagaatcccttcgagattacatccgacgcttctctgaacaacgcaacaagatctccgacatcaccgacgacgtcatcatcgccgccttcactaaaggcattcgccacgaggacctagtcggcaagttcggacgtaaacctcccaggacggttaagcagatgttcgaaaaagccaacgagtatgccaaagccgaagatgcaatcaccgcgtccaaacagtcgggcaccacttggaagccaaagaaggacgcaccgactgcaggggggagtggaagtaacaaccacaaagatcgcaagcataagcccgaagaacttgtggcgaccacctctccatcttaccgacaacgtccccgcgtcaacaccttcgacaagataatgaactcccaatgtccgcatcatcccaactccaaccacgtggccaaagattgcttcgtctacaaatagttcacagaacaatacgtcaagaacgcacgtaaaccttcagacggagatcaaggcacatcaaagaagagatgatgaagacgatgccccgactggttttcaagatcatcgcaaagaacttaatcacatcttcggcggacccctggcttatgagtccaagagaaaacagaagctaatggaacgggagatcaatgcggttcagcctaacacgccccaatatcttcagtggtcagaaacagcaattaagttcgaccgctcggatcatcccgaccgagtggtccacccggggtggtaccccctggtactagacccagtggttcgcaatgtcaagctccgacggactctcatcgatggcggcagcgcactcaacatccttttcgctaaaaccctggacgatatgcagattcctcgcacggaattaaagccgagtaatgcacccttccatggcgttatcccaggattgtcagctacaccactcggccagatcactcttccagttaccttcggcactcgggagaattttcgcacagaaaatgtttgtttcgaagtcgctgatttcgagatagcatatcatgctatactcagacgaccggctctagccaagttcatggctgtcccgcactacacctacatgatgatgaagatgtctggtcctcgaggggtcatatcactacggagcgacatcaagcaagccgtcacatgtgacaaagaaagttgcgagatggctcaaacccacgagaccactctcgcccgcgaagagatccgactggctgcgaccacggcaagcgagggagaagtgcctgcaaccaagctgacgaagaccgaagaaagtgatgccaagacgaaaaagattcccttagatccctccgatcctgacaagactgctgtaataggcgctgagttagattgtaaataggaaagcgcgctcatcacctttcttcagaataataaagatatttttgcgtggaaaccatccgatatgcctggtatccccagagaagtgattgagcactctttacatgttaaggaagacgccaaacccatcaagcaacgactccgccgttttgcacaggacaggaaggatgcgatcaaggaggaattaaccaagctgttagcagcaggcttcattaaggaagtccttcatcccgactggctggctaacccagtcctggttcggaaaaagacggggcaatggcgcatgtgtgtcgactatatcgacctcaataaatcttgtcccaaagacccttttgggttacctcgcattgaccaggtggttgattcaacggccggctgcgagttactcagcttcttggactgttactcgggatatcatcagatccgactaaaagaatccgactgcttgaagacctcgtttattacgccctttggggcctactgctacatcaccatgccctttggattgaagaacgcaggagcaacctatcaacgcatgattcaaaagtgtttttcaactcagatcggtcgcaatgttgaagcctatgttgatgatgtagtcgtcaagaccaagcagaaggatgacctgattgcggatttagaagaaacttttacaagcattcgtgctttcaagatgaaactaaacccggaaaagtgcatcttcggagtaccgtcagggaagttgctcggatttatggtatctcaaagaggcatacaggccaacccagagaaaatcaatgccatcctcaacatgaaaccgccaagctcccaaaaagacgtccaaaagctgactggttgcatggcggcgctcagccggttcgtctcacgactcggtgagcgggggatgccttttttcaagctgctgaagaagactgacgatttctagtggggacccgaagcacagaaagcctttgaagacttcaagaaactcctcactactccaccagttttggcctcgccacatccgcaagagccgctactgttatatgtgtcagcgacctcccaggttgtgagtacggtcctggttgtcgagcgtgaagaggaaggccatattcaaaaagtccaacaaccgatctattttgtcagcgaggttttagccgactccaagacaaggtatcctcaggttcaaaagttattatatggtgtcttaattaccgttaggaaattatctcactactttcaaagtcactcgatcacggtggtcacatcgtttccactcggggatatacttcataatcgcgaagcaaatggacggattgcgaagtgggccttagaattgatgtctttggacatatctttcaaaccacgaacttcgatcaagtcacaagctttagctgatttccttgctgagtggaccgagtgccaagaagacatgccagaggaaaagatggaatattggactatgcatttttgatgggtcgaagaggcttacaggcactggagctggggtcgtcttaatttccccgactggagaaagattgagcgacgtattgtggatacatttttctgcgtcccataacgtggcggaatacgaggcgctactccatggattaaggattgcaatctctttaggcatccgccgattaatcgtccgtggagactctcagttggttgtcaatcaagtcatgaaagagtggtcttgtctagatgataatatgaccgcttatcgacaagaggtacgcaagttggaagacaaattcgatggacttgagctcacccatgtcctccgacataacaatgaggcagccgacagactggccaattttggttcaaaacgggaagcagctccttcagatgtgttcgtcgaacatctttacgaaccgaccgtgcccagaaaagagacaactgaagccatggatactcaaggcgtaagcatgattgaagccgactggagagaacctctcataaaatttttgaccaaacaagaactccctcaagacaaaaatgaagccgagcggatttccaggcgcagcaggctttacattattcacgaagctgaactgtacaagaaaagtccatcaggaatactgcagcgttgtgtatctttggaggaagggagacaattgctgaaggatatacattctggtatttgtggtaatcatgctgttgcacggaccatcgtcggcaaagcttaccggcaaggttttttctggcctacagctgtgtccgatgcggacaagattgtgcggacatgcgaaggttgtcaattttttgccagacaaactcatttgccagcccaagagttgcaaaccatcccgttgtcctggccatttgcggtctaggggcttgacatggtcggcccatttaaaagggcagtcggtggttacacgcatctctttgtggctatcgacaaattctccaagtggattgaggctaaaccggtcatcacgatcacagcagataaagttagagattttttcatcaacattgtgcatcggtttggggtacctaatcggatcatcactgataatggcactcaattcactggcggagcatttaaagatttttgtgaagacttcggcattaaaatttgttatgcctccgtggcacaccctatgagtaacggacaagttgagcgcgctaacggcatgatactgcaagggatcaaagcacgagttttcgaccgattacgcccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgattttggaacttcaacgaggagggctatgaagaaggccgagtagacgacatcaaccgactagaagaagcccgagaagcagctttaattcagtcgactcgatatttgcaagggttgcgccgttatcataatcggaatgttcgatcgcgagcctttttagtcggtgacctggttctaaggaaaattcaaaaaacacaggatcggcataaattatctcccttatgggaaggaccgttcataattgctgaagtcactcggccgggttcttatcgactcaagcgcgaagatggtactatcatcaataattcttggaacattgaacaccttcgtcaattttatgcttaggcatttcgtttgtatctttcctctttgactgctaacttcaagttttttcttgaagttttcagttagggggctactataataataatggagtgtgatttttatcaattcaatttgcctacttgatgtatcattgccctgtttgatttcttggcttagtcaatgaggactgaaagttttttaacaacttttgcgggttttaggctcaacaaggtttgacaaaaacttttaagaaatcaggagcaaagttaagatatcaagcacagcataaattcatcagtattgtacaaattgtgcctccatcatcattaatcatcaaaa

SEQ ID NO: 3056 - DNA, 3925 bp, Oryza sativa
cattaatcagtctcagtcttttcatcatcagaattaccaggaccagtcggtcgaagatcggtgtcctgaaatctctcaactacatcagcagcaattttgtcagccgctttctgcgcatcactgatgaggtcaagagcagcttcttcgctcgtcccgtctgcaaagccatcaatgacgtcaatatcaactctcggataaagggatttagtcatcgccaacgccatacttactcccatacttccagcttctttgatgttcttgaaatatatatccggagcaactctcagcttgtcgaaaatttcggaagcatcaagtgcactcgggccgttgttatttaagaacatcgcttgaacaattggggcagcagcgttatcaacctcatcccgggctccttcaagttttttgatcttgctaaccaggacgtcgaattgagcttgagatttaatcttgcggtctgcatcaacagattcacattaataagtcagcatatggaggataatggcttttgagatattgattgttgataccttcaacttcctttaaagccaggtctctttgtcttgccagctctgccttgtcgttttccagaatttgaatctgcttctccaactgagatatcttggcagtttgcactacattgactacggttaatcaagattgcaaagataacaatatgagtcagttaagtagggtttgtacgtaccttttgatgagccactcagttcaaaatttgattcctggagctcagcaattcgattcctcagatcatgctcattcttcctggcaagctcttttgtctcgtgcagcagactcctggtggcttcgagggtcccgagatgagggactagcctctctaaggtttccgttttagcttcgttcctaagatgaatcctctgcaagacagtttaattagcgcctgaattaaatggcaaacaagatggttgagatcaggtaccagagggcttacatttacaatgtgggttgcctgaccaagtgccttcttcagtaggcataactcttcgtcctctttttgcttatttatcacggtcccttgaggctgcatgttgtcatcccaccacttgaccagaatcggagggcgtgaatcctcagctgcttgtatgcggggaatttcttcttcatcactgatcattggccctaatgtatctactaacagaggttagacaattggtcagagttatttgggttgacatggtttcagacaaagtgttttacccataatgatttctggatgaggatgagtggattcggatgcctttaaaggagatctagatctctggttattgctggcgtcttgactgcgaaggctatctgcttgagctccaacctctggaatctcttggcttggccttgcgtccgactggtttctagtcgggggctcctgattaaccccggcttcggcttcggccgactggtttccaatcgggggttgatcaccggattctacattatcggttgccggctgattgtcacttggacggtcctcggcagttgtcccgatttctttggaagaatttgcgtccacgctagtcgggtcagagtctttccctgacggatctatatcagatggtttcctgcaaatttgattattagtattattgctgcaatggatgtgcatcaatgcaagagagatcgttatatgagttgtacctagaagacttcctgatctttggcgcagggcgactggatgttttcttctttggagtagcctgttttgatagtttcttggttgtctctcggtctccaggcctcctggtggtatcatcggcttcgtcgtcactcagaaccagcttcctctttcgagagtctgactggccgactgaatcagaagcacttggttgagtttcagaccgaattcttggtcctccgctcccttgcccagtttggtggcggggagatcggcgttgagcgattgggggatccgatttcatcaaagcaaattcctgggtgtaatatctttcattattaattgattcaacaggaagacaagatcatattttgaggaaggttgaaatgtttgagtgcataccggtggaggagggttgaatgcgttgaatggcacaacgggcagcagatgtgaatagctgacgacaatagcgtttgagaagatcttgtacattctttctttcatgaccttaaagtcaagagaatctggatcttcccgatttggatcatgcttgccgtcgaactcaaaagctgtgcgggatctttctttgattggagctaaccgacacttgatgaagtgctgggtgatctgctctccttgaagaccctgttctttcagctttatcatcctctccatcagttctactgcctgagcagcttcatctcccataggcaatgagttccatgtgtcctggtaaaccggaggaagacagtttgcgtgctcaggagtgcgggctcaggattctgaacatagaaccagtttgcgtgccagcctttatttgaggtcttgaagggcatggagaagtatttttggcttagtgttcccctgagttggaaaccagcacccccaactacgcatggtttgctcttatttggctggggcttgaggaagaagatgcggcggaacaaggcaaaatgaggcctaatgcccagaaaagcttcgcaggcgtggataaaattggcaatatgcactatggagtttggattcagatgatgcaagctaatcccgtagaagttcagaatgccccggaaaaatcttgaggttggaagagaaaatccgccatagaagaagtgagcaaataccacgatttcatgcgtatcgggagtcgggaatgcttcgccaaatgccggtcgccacccgatgatctccttcgctggaagaacgccgtgcgccaccatctccttcagattatcttctgtcacatcggagggcgcccactgactctcgaagctttctctttcttccaccatgaatgtgaactggatggtttgatttggttcgagatacggatggaaagggatgggggaatcggtgcggtggacgcgtggagaagattcgtgggatttttgagaatggattggggcggattgatgaaccctagctccgtcggcgtagtcttgtactgtagcgaggaatggggaaatggcgagagtcttggcggggaagacgaagcgtcgcttggacttcggtgttttttagggtatcgtgagtactaatgggcctgggcctgtacagtacttcagcccaattttatttccagcgtggcccgttgtgattcttagggacttaggcactttttgctttggcaatttgtactcacaatgttgtggcccaatgctgattaaatcctttttaatgcggtttgctaattctttagaattaacacgatgcaaacaaaaggtgcctgacagaaaggtgttatgccgtttttgtaagctttattaggctacaaaagctgtttgggttgatttgagatgactggtttattcatagttattctcttagcatgttatatgcttattttgattatggtaaaggttatagcctaggctaatgaacttcttaattaccatgatctttatcatatttggtggatcattttaagagtttcttgctcggattcctaccaaatatatatatttttagaccttttgagtgtttatcactcggcccttcttgtattttttgtccttgatatattcaagattgagaagcagtcggttgggtatcttactaagtaccatgcgtgcttcactataaaaccactcggttcttgactatatgtttagtttttcaactaatcacatagtcaggggctacacctaattaggtgcatctactcgatgcaccatgttttattttcgccctttacagtcttttagcactcggcaagccggagcaagttgaattaaagcactcggattattgtttttgtttcgagaagactattttggtcaactg

SEQ ID NO: 3057 - DNA, 4493 bp, Oryza sativa
ctcgggggctactgtggagattatggttaccccatatctacatggcggttatattccagctggatatacggtaccaaatatagataaaatatttttacgaggactcgggttagattctaaacttgtatgtcaagaaaatacccgggatcctagtcggttacgattgtgttttatctgtaatcccatattccgttaggatatgggttgtactttgtattacggatcccttcccctgtataaggagggtccgtgtgcctcttggggcacgattcttttttcccaattatacaatcaataacacactcggcggaatcatccccggacaggagtagggtattacttcttgaataagaaggcctgaacctgtataaaattccttgtcttcaaacccatccactttcctagcttgatagccacccccttttattattgccgaaatcttgtttcgacacagtgtaattcctctttgcttatgtactttttcttcacttaggcagcgttcgtttggaggacattgagggagaaagcacctcgttttccgcacgcacgcttcccaaactattaaacggtgtgttttttgtaaaaattttctataagaaagttgctttaaaaaatcatattaatccatttttgaaatttaaaatagttaatactcaattaatcatgagctaatggctcacctcgttttgcgtatcttcccaatctcctcaaacacacccttattgtttatcggacatttaactgagcatatatacagtgccaaacagcgggaattggcatcccctgtttctcctttcttcagctttgtcagcacactgaactgtacaaaatcagttcatcttttcccacctaattctgaaaatgacatcaatagcaaaatgatcaaacaatcaaaattttcatagaaataaaatattttccttatcgcaattggcaccttacatttagatttattctaagttactcggcaaaaagaagaaggattaaattagtccatcgcttgcactgtttcatctgctagtgccagctccaacattttgaagagtttactattatagcttctcaacatctcaagcttgatgtaccaacctgtcgtagaaagcgtcctaccagtaagagcaatgatgcaagatcaactgcatataaacaaacaagcaaattaaacaaacacggtttgcaagtataaaaaacttatgtcaccttaattacatgcagtgcaatccagccagcagcaacaacaattaattgcacttggttgacctctataacattaaaaaatccctaagaaaattgctgacataatgttctagtcaattggtgttgcaactacccgtacatggtcagcagctgaagcaaggacgagagctcaactaaggaggtcattatctaaaaaaactagggatatgagggaaataattagaggattaaacagttcaattttgtactggtccacgcaatggaagagctaatagaatgttgtaattgcgtgtcaaatagattatacattgttgtgtagcttttggaactttcttttttcgctgaaatgtggcttttggaactcaagcatatcggatagataggcttgcacaagttgtccactagatcactactactgttgtatatgcactgggatgactatgaaagtacacaatggttggtaaccgtacactcaaaggaatacccagttttttaaaagaatttagggtatcaacttcaaacgagaaaaataattcatgaggggattctctattctccagccaaggtttacagaaccgattgccttaagacaaccgtgataatcaagcggttattatcgaaaaccagcaaaacttgttgaaaaaattgtatgctttttaaagttatctactttatcgagcgattcgtaaatacggctacggctagatagataagattgataaccacgataaccaaatggttattgccacatttgaaacggttatctaaagttttttttttttttgcaaatataagattgcttcaagatttgtgctctgacccacttcactcacttagtctctagctctatgcagaatgtttgtgtcctttcacccatctctttgccaccaatgcttaacggtaccttggaacacaggaaaaataataagatttcaaaggatttaaatcttatagtaaaattttctattaggtcttttggaacgaatcaggtcccagcccatataattcttttgaaatttgtgtggaatggcatgtttcatgggaattttgaaggattcctggcatgagctctctaatctctttggaatttccatttatgcctacctctctctgccatatcctgtgcttttcttgtattccatcccacgtagttttcctgtattttttgttccttacaattcaaggtgttactgacattctatttttatgttttttatattcctaagttccaaagagagtattggacccatgatcttgtatctttaagtgcctaccaagccagcatcgtgtcatagccggagcatcaatctccatatgaatccaatcgtgacctcatggtttgaatttttcaaattttcataatttttggacgccaaaagtctagcaatcctattttttgatagagatatatttactcatcacatatagagaaatcatatctcgaacaaacagtgcgcttgatggcgcccgcccaaccaccgccggctcagtcgctctaacacctctcgatcacctccttgcaagcaatgctagccatggccgccgccgcgctctcgccggagcgcgtccagtcgtcgtagcccctactcgccggcgccgctccaatcaccgtggttcagccacccgcggcggagtatgaagcgccacgacgcgggaacgccgccgcggcgcgcgcgcgaccatgcacgcggcgtgcttgtgctccacctgctgctcgtgtcggcctcgctgcgcggcgcgacggccgcgccgggcgaggcggaggcgctgctcgcgtggaaggacaccctgccgcgctcggcggcggcggcggccggcgtcctcgggtcgtgggcgacgccgtcgccgcagcagccgaacgcgaaccccgccgtcgcggcgtgcgcgtggcgcggcgtggcgtgcgacgcgtcgggcgtcgtggtgggcgtcgacgtggccggcgcgggggtcgccgggacgcttgacgccctcgacctctcgtcgctgccgggcctcgccgcgctcaacctcagcctcaactcgctcacgggctccttcccgtcgaacgtgtcgtcgccgctgctcagcctccggtccatcgatctgtcgagcaacaacctctccggcccgatcccggcggcgctgccggcgctcatgcccaacctcgagcacctcaacctctcgtccaaccagttctccggcgagataccggcgtccctcgcgaagctgacgaagctccagagcgtcgttcttggctccaacctcctccacggcggcgtgccgccggtgatcggcaacatctccggcctgcgaacgctcgagctctccggtaacccgttgggcggcgcgatccctaccactctcggcaagctccggtcgctggaacacatcaacgtcagcctcgccgggctggagtccaccattcccgacgagctcagcctctgcgccaacctcaccgtcattggcctcgccgggaacaagctcaccggcaagctgccggtagcgctggcgaggctgacgagagtgcgggagttcaacgtctccaagaacatgctctccggcgaggtcttgcccgactacttcaccgcctggaccaacctcgaggtgttccaggcggacggcaaccggttcaccggcgagatccccacggcgatcaccatggcgtcgaggctggagttcctctccttggcgaccaacaacctctccggcgcgatcccgccggtgatcggaacgctcgccaacctcaagctcctcgacctcgccgagaacaagctcgccggtgcgatcccccgcacgatcggcaacctcacgagcctcgagacgctgcggctgtacaccaacaagctcaccggccggctccccgacgagctcggcgacatggcggcgctgcagaggctgtccgtaagcagcaacatgctggagggcgagctcccggcggggctcgcgcggctgccgaggctcgtcggcctcgtcgccttcgacaacctcctctccggggccatcccgccggagttcggccggaacggccagctctccatcgtcagcatggcgaacaaccgcttctccggcgagctgcctcgtggcgtgtgcgcgagcgcgccgcggctccggtggctcggcctcgacgacaaccaattctccggcaccgtgccggcgtgctaccgcaacctgaccaaccttgtgcgcctccggatggcacggaacaagctcgccggcgacgtgtcggagatcctcgcgtcgcaccccgacctttactaccttgacctgtccggcaactcgttcgacggcgagctccccgagcactgggcgcagtt

SEQ ID NO: 3058 - DNA, 14534 bp, Oryza sativa
  unsure (1)..(14534): unsure at all n locations
caagatcgcaggagcgattccggcgagctacggcgccatgtccctgcaagatttggacctctcgtcgaaccgtctcgccggcgagatcccgccggagctcgggagcttgccgttgaccaagctgaacctgcgccgcaacgccttgtcgggacgtgtccctgcgacgctcgggaacgccgcgagaatggagatgctcgacctgtccgggaacgcgctcgacggcggcgtgccggtggagctgacgaagctggccgagatgtggtacctcaacctgagcagcaacaacctctccggcgaggtgccgcccctgctcggcaagatgaggtcgctgacgacgctggatctcagcggcaaccccggcctgtgcggccacgacattgccgggctgaactcttgcagctcgaacaccaccaccggcgacggccactccggtaagacgaggctggtgctcgccgtcacgctctccgtcgccgccgcgctgctggtgtccatggtggccgtggtttgcgcggtgtcacgcaaggcgaggcgagccgccgtcgtcgtagagaaggcggagacgtcggcgagcggaggcggcgggagctcgacggcggcggcggtgcaggcctcgatatggagcaaggacacgacgttctccttcggcgacatcctggcggcgacggagcacttcaacgacgcgtactgcatcggcaaggggagcttcgggaccgtgtaccgcgccgacctcggcggcgggcgcgccgtcgccgtgaagcggctcgacgcgtcggagaccggcgacgcgtgctggggcgtcagcgagaggagcttcgagaacgaggtgagggcgctgacgcgggtccgccaccgcaacatcgtcaagctccacggcttctgcgccatgggcgggtacatgtacctcgtgtacgagctcgccgagcggggcagcctcggcgcggtgctgtacggcggcggcggcggcggcggctgcaggttcgactggccggcgaggatgagggcgatcaggggcgtcgcgcacgcgctcgcctacctccaccacgactgctcgccgccgatgatccaccgcgacgtctccgtcaacaacgtcctcctcgacccggactacgagccgcgggtgtcggacttcggcacggcgaggttcctcgtccccggccgctccacctgcgacagcatcgccggctcctacggctacatggcaccaggtacaaactgtccgtacatccatagccacacagggtgaaaacggtcggaatctaacgacgctgctagttgattatatttatcatttaaactactcagtacgatattaatgtgatgcataaagaaattagaaaaaacaaattttatatctatgatatttaaaatcttaatagtggtggtgtccattcgcacgcaatctctaccattgacatatgggtctcataatctatactattacctttcagcaaatcttcaatttcaccattagctctcccaaatttcaaaatcacctacttgttgaaataagaaaaactatagtattacttagactaaatagggtcttattattaactagctgggtgacccgcgcaattacgcggctagcacccaaacaaaatcatatattattttagtatgattcatttaaaatttattaaataactagctcattgtcttaagactttgaaagaccaaaccttatcatcctcgtgtttctaattatatagtttttaaaagtcacaccagttgctaccccttatgtcatctccttctttatttgcttgctcgatctatcactatttctattcatttttcttggaacatttaaaaattggattttatagtttttagagtttattgttatgttgggtttcatttttataatatctagatgtcccgtcaaacgttgccattatactcctctatggcccgtccactgtctcttctctttattgtcattgagatttttaaaatcgaacataattatcatttgtgttcattttttactttctagaagtcccgccaaaccatcagcggctttgccattgtactcctctacggttcgcccgctgcctcccttctttattgtcattgagattttaaaatcaaacatgattattattgttttttttttactttttagaagttccaaacctttaaaaattaaacttgtagttttattttttataatttttagaagtcccttcaaacgatgccactatgcccctctacagcccgtccgccgcctactctttatcgtcattgtgattctaaaaatcgaacataactatcgttagaatttattttttattttctagaagtcccgtcaaccgtcggcggctctgcaactatactcttatacaccctgcccactgtttttcctttttattgtcattgagattttaaaaatcgaatatgattatcaatggtgttttttttttactttctagaagtctcggcaaccgccttacttgtttgcttcacggcctacttgacgtccctccttttaatcgtcattaggattctatttggtgttttattaacaatttttatatgtcgtatcaaccgccactactctactcctttatatgcatggtacttaatttatctcgtcatgtgttttagatggttttctttcaatagtctttatttttatcacaaattttatacattgtattcctaattgaaatcttatttttctttttctattttcagaatttaattttttttagaaaaattagttaataccgtattgtgtttttttaatgtttttattttctattttcaattttagttgtttcaaaattgtattcctacttgaactctcttttaatttttctaattttggatattattttattttttattcaaaatttttattaatctcgtattaggttcttatatggattcttcgttcaatattgcctatttttaatttcgaatttcatctaattttaaattgtattcatacttgaactcttcttttattttcttttgctaatttcggatttatttttattccgaattttaattaatctcatattgggttcttgtatgtactctttttttaatattccttatttttaattccgactttcagttatttttaaattgtattcctacttggactctcctttccttttctaattttggattttattttatttttatttcgaattttgattaatctcgtattgggttcttatatggaaacttctttcaatattgcttatttttaattccgaatttcagctatttttaaactgtatttctacttggactctcctttccttttctaattttggatattattttatttttattttgaattttgattaatctcgtattgggttcttatatggaaacttatttcaatattgcttatttttaattctgaattttagatatttttaaattgtacttctacttggactcttcttttctttttttttttctttttctctgattaatgtgggaatttctagcccccacagcgaacatggtgcctcctttcaatgctgttttaataatataatagattgattgattgattcaataagctagaaatttaatttgttttctgttgcaatgcacggactctaagctagtatagccaaaaaaaaaaaggaaaaccgttgaaaacagtgccccttaaacataaacggcgcccaattgattgagaattttcgtgaccattttcaccccttatacacaccgaatccgccattgacgctgataccatgtttatcttgcggtcttgccgcagagctggcgtacatgagggtgacgaccaagtgcgacgtgtacagcttcggcgtcgtggcgatggagatgctcatgggcaagtaccccggcgggctcatcagctcgctgcaacactcgccgcagtcactgtcagccgaggggcacgacggcagcggcggcggcggcggcgaggaggcgtcggcgtcggcgtcgcgccggctgctgctcaaggacgtggtggatcagaggctggacgccccggcggggaagctggccgggcaggtcgtgttcgccttcgtcgtggcgctgtcttgcgtccggacgagccccgacgcccggccgacgatgcgcgccgtcgcgcaggagctcgccgctcgccggcgaccgatcctggacaggccgttcgagatgatcaagataggcgacctgacaaattctcacagatgagagagaaaatttgtgacaaattatcgattgctttgtgcttatgtgattccgttagtagattctcattagcatctgtatagtttttgtacagtgatatttagtcccgtttgagaacagatgatgaagagtgttgattgactttttttaaaaaagaaattaaaaattggatttatctatctatgttttaaaacaagttttatggagaaagttatttcatgaaacacgtcgtttagaagtttgaaagtactaacgaaaggcgaggtaaaatctacatgtaaattaccgaacgtttgggctgaattgatgccttcctacgggctgaatttatgcacagttatcggctgaatttgcactcacataagggccgaattcacgccagcttttgggctcaatcgacgtaaacttgtcggccagattgaccagcatttctgggtcagatttacctgcatatatgggctaaatatgcgcaaaccaacggaccattgagcagaaagcattgggctgaaattacgtcaaataatggccgaatttatcctcattgggtccaactaacgctcactgttgggccaaatttacgggcctaatgggctaaatttgcgctcattttcggtccgcactaacgctcaaataaggggccaattttacgaccttttcggccgaactatggactgaatttactcccaaaaatcttaaaagaaaattcaaaaacaattgttcttaaattcgagtataatctccacctcagttcttacaaattttacccccaaaacacttttatcccactcacaaaaacttgtacatgaacaagtcaaaatactccatacaacaagaatcatccatccggtcatccctcttgcaaaatgcagagacacagagaagtagcagcagcagctcagcacgagaccccgcatggcttgaggacggggcccttgggcttggggatgaaggggtcgatcctgacccagacgagggagaagatggaggcgaggaggatggaccagagcacgacaatggtgggcgtccggttctgcctccccatgagccccttgaggaaggggtagaggtggaggatgacccagaaggagaagaagagcttcccgaacagcgggccccacgacccgtacccgttgttcacggcgtccgacacgccggcgacgatccccaccatgttgatgatgatcagcgtcgtcggcggcaccagcagcgtcgtccacttgaacaggtagagctcgccgaacgcgtcggtctcgtcggcggcggccttggacgtcaccgtgaannnnnnnnnnnnnnnnnnnnnnaccttgaggaggccctggaacacggcgaacaggtgcgccgacacgccgccgatcacccagaactgctcgttcctccaccagtcctcgatgctcaccccgctccaccgcagctccagcacccccgtcgcgatgatcgacaggaaaagcgctatgaaccatatgctcgccaaattgttaagctacacgtacaccaagatcgcgatcgatcggtcagtgcaagatcatttggagcttgaaattttagcggaaattttgatgttcttggttggttctttaccgtggggatgatgaacttgccggtgaggaggcagacggcggggatggtgcagtaggcgaggaggggaatggaggtgaaggggtagacgatggtgttggtgtaggcgaagcgctcgagccacttgaggcggccgccataggcgtaccagagcgggcaatggcggctcatgaagatctcgacggagccgagcgcccaccggagcacctggtgcagacgatccgacaggttgatgggcgccgaccccttgaatgccgccctcgccggcgtgcagtacaccgacttccacccacggcaatgcatcttgaaccccgttaagatgtcctccgtcaccgacccgtagatccacccaatctgcaagaattttgatttttggttagcttcgatcatcttcctcgagcttgaaaatggtggagattttttgatggattacctccttgccccactcggtcttctcctcgtagccgcagctgatgacgtggatggcctccttgatgagggcggcggggtcggcggcggcgccctgggggaggccgccgtcctcgacgagggtggaggcgatgaacaccggcgactggccgaaccgcttctcgaagctcttctgcgacatgagcgacgagcgctccagctcgtcgtacccctcgaggccctcctcgatctcctccagctcgaacccgcgctggtgcttccggtaccctttcttccctccggcgagcgacgccgcgccgccgccgagcttgtccttcttgctcctcttcttgtagaacccgagcagcccgcggcgcggctcgtcgaggccgccgccctcgccgccgccgccgcccttcttgttcttgtgcgacttgccgcgcttccccccgccgaagcagcagcagcagcagcaccacgacggccagcagtcgcacgtcatcttcggcctcttctccggccgcggcgggtcgtatccgtacagcgcctgcctgttgaacaccgtccccgtccccacgtacaccggcccctgtatcccgtccagccccttcatgttgatctgcacatcaaacgacaccatcgttagctcacgtcacggcgcgacgcacgcacgccggagaagaaggcagtgctcacgtcgaagaagacggtgttgcggttggcgtagcgatcgtggcggtcgatgccgtcgaagcgctgggggaactggacgtagcacagcttcttgccgagctgcttgtccatgaggaagcacatggcctcgcggacggccttgctgttgttgacgtagtggtcgcagtcgaggttgaggatgaagggggcgttggtaagcacggcggagacgcgaacgagggagttcatggcgccggccttcttgtggtggttgtagccgggccgcttctcgcgggacacgtacaccagccgcggcagctcgctgccctcgacgtcgagcgcgccctggctgcccaggtacacctggatcatccccgggtggtccctcgtgttgttccccggccatggcgtcccgtcctgcatcacccacccttcctccggcttcttctgcgccttcgccaccagcgcgtttatcctcaccttgaactcctcatactctctctgtcacatcaagagtaggtgttaaaaaacttatagacgatctaaactggatgacaacatcgagaagggatatatcggtaacgaagtttagccatagcctacatctccaaaaacagactgatcacgagatgctccaattgaatgagggttcaaaattacataacataatttttgacatttcagttctattggacaacctgatatgatattatttcggacgaaacttttaaatgtttttcaaatttttgtgaatttgataatatttattcaaattttaatcattttttttcaaaataaaataaaataattttggatcgaaataaccggctatatcggtccccccaacacaaatgcctaaaacaatatattaaacccttgaatccggtatatccacgacactcaacccgcagatggagtggagaaggtttaccttcatggcgcggcgttctttgacgaaggtgggctggaccttgtccttgaggtagtcgatcttctgggagaagtagaactcgggggcgcggggctcgatggtgaacttcttgcagaaggggacccaccggcgggcgaactcggcggtctcggagagcgtgtcgaagagcagcatggacgcgccgtcgtcggagacgtagcaggagacgcggtcgacggggtagtcgacggcgaggatggacagcacggtgttggcggtgatgatgggcggctccttgagcgggtccaccgtgctgacgaagaaatcgatcggggccaggcggcacggctcgccgtcgcgctcgtaccggagggccagccggtccaggtacgtctccctcgtcaccggcgaccacttgggcagctggtcgaggatccacgacagcgcgaaccacagctcgcagatcaccgaggccagccacagcggcaccgcgtccatcgccggcgtcgtgatccggaacttgaggaagaagcagagcaccaccagccggagcacgatcacgatccggtacgggttgatcttgctcgacgggatcggcaccttcctccacagcggctgcctcgcctccgcgagcctgcatgcagaaattcgatcatcacgatcatgccaaagttcacaagatttgaaaaatctgaggtcgatcgatagatagatctttggagagctaagcttacagcatgtactcgtcgtcgttcttgtcgtcgtcgtcgtcgctgtcgtcgcggttgagcttgccccgcttctcctgcttcgtcttccacttgtcgatcctgtccttccactccatgccaccctccatctccctctcctgctccagatccttcccagccactgcaatttcacagcaatccacacacacatcttcagatgaattgttacaccaagaaacgcaatttcttgcgggatttgagtaccgaccgcttccggtgaaggaagagagcgccgggcctccagggcgccacttctgtgccggctgctcgccgttctcctgcaagacaaaggttgtatacaggtttcgcatcagtttacaagcacttgattgcagagcaattgcagtgagaaatcaatggcgatggatcgatcgagtcgagttgagctctcaccgagtagacgtcgaagttgacgggctcgtgggggggtttctgcttggtggggctcttgatctggaactcctcctcgaagtcgtccatgtcgccgccgtcgtcctcgtcgccttccacccgtgggcaccctgcgaccgatcgatcgagacagacagacagacattcttgtcaagctcgatcttgtgaactaaattgcgattgatcacatggacacaacacatgatgttacctttgtggcgcttgtagcgggtgttgcactgggggcagcactgggtgccctcgctgcgctcgtactcgtagcagggcttgcacaccgggaagccgcactcggcgcacgccacgaacggcttcccgtcctccctcgccgccacctcctcgccgcacacccggcacgtcttctccttccccttgtgctcgccaccggtgacggaggcggtgtccatggtgaggtgccggggaagcgacgttggtgggcgaggaggaggcggcggctagctaggtgatatagcagctggttgatgatcagatgcagggaggcgggggcggtaaggtggcggggtggcgtcccgcaccaaccgtgagttggggcgtcccggtttgattagagcgcaagccaaggcacgcacgcacgcggccgcgcgcgccatgcattgctcgcttcggaagcaagccgccgctgccgatgctgctgctgctggaacgagatcgtcgtaaggtgagatcgcaacgagacgcgagggaaatgtgttggaggggtcgtagtgcagctgaagcaaaatcgaaggccaacggtgaagggacgtggatgtgtttggtgggtgggttgcggtgacgcctcaccgtttttctggtgagatggtgcaggggggagatccgggccatccggctcgtgtaagcgttaagtcactgcgtgtataaatggcagacggtaggaggaaggccatctgaacctgtcaagtgagatgaaatcctgcgatgctggcgttaacacgcattgcgattcagggaggctctggtgtagcagcacgccgacacacacacacacacactctttctcggttcaaacgtgagcgtgaccaacacatatcaggttagccatctaggacaaactagactcgaggccccgagagccaacatcagctagatttttgtttttttttatgtttcacgttttcagtacgaatcaggtgtgcagtgagaaaagcaatggattgatgcttgcattaaaaagggtaagtagtgtacaccatccagtaagaatatgccgtgtaagcagatcgcaatgccatggctcctcttgattgtcaatgtatgttacgagcaaaattaagtggcgtacaaactcctcaacatctttgtatcttttaccataagctatcagagaggaaagcaacacaataggtcggaaaaattgcctcggacaacaacactagctgaggctgtaaagaacaggcgccggtatcggcacaccactcgatggccactatccaagctgcaacgttttgcggtgacttacacgttgtaccgtccacctctgcttggtttctccctcttggcgtcatcctgcattgaagttgaagcaccatccaaatagaatgagctatggacgtatttgatctattctacaggtgactaaaaaataatatgttattgagacaacaaaaatagtctaaacacatacatggaagctgtagaccatcttatcattgtagtcaacaatctccttccatttcttgccaatgtttacctgcaaagcaaaggcatgttagttttctctagttatcattggtctatggttgaagccatgtttcaaaaggtaatgctcaaatctcaaaaaaaaacacatatagagatgtcctttgaatgcacagacctgtggtaacaatgaaaaatttatgaagtgcagaaaaaagagacaggatggttgaagagttagggaattacaaagcgattgcttcattgcaaaatgtgaaacgttttagtactattatggtgctcatcaatgcaaaccagcattgatgttgtgtttatgtttttgttatcataccaatgcaatatatcactatatcagaaacaaaatagatggcaatcataatggatgcatcaaccatcaatagtattgcatgatgtgggcaccagatgactttaagagtcttgagtctctttgacacggcatcaaattacctaatagggatttagctcacacaataggctttatcaagcatagcttaaattgactgaaagtcaaatcaaacaaaatagttctctactcaagacagaaataaattgttccaataaaacaagcagataaatggtatcaaataagatatggaactcagaaaagcaaacaaaatgtaaagtctagcctaccatcaaatacttgtcaactgtatcccaaataaattgagcaaaattagtgaagtggacaaatttgatgaacagaatactaaagagaacatggcagctttgaacaacatgtttaatgttgactatagaggtggtgggaaaacaatgtactacagattaaattgcttgctacatcaaatatatgagcaaatacactcatattgttatactacagtatttttcaaaaaaccaacctgaacggcttcattgctggcagtcctagtccacaatgcaagcttgtctcctctctggcggacactagcaacaactccacaaatttcctcactttcatcaaactgctctccaatcagagccatcagctgcatgttcgaaaagtttgtcagcagaaatgatagaaactttagaagataggtcaagcaacagatgttatatccaaagcacttcagagcctccgaccaaactaagcaatgattttagaggaaatgtaccgtttcaagccacatgttctcaagggtggtcttcctgctacatggcacagtccatttgcccccatttgcacactctgggtcttcccactttggttctacaccagccttgaataaatgaaaatcagcatttactgtcaccttgcttggacggaaaatctgatcatacaagctgcagcaagaaataaggggatttaaatgaaaggaagatcatgcctgcacatataggataaaaggacaatcaaattcaaaagtatccgataataggcaggaatacctacagtaagaacttgccaaaacatagaaaaaatacaacagagtaattaatacctacgcctccatgtgcccacaatattgaatgtcattctagttgtaagtctcaaaaggtataactatttttcttatctttagacacaaaaaaaaaagtcgcatgcaagcttgaataataaataaacaacaaagatagttgtgttcatatgttgtataattgctacccttgtacatttaaccacattaaaagtcccggaacatccataaaagaagctagaaaatatactccatgcagcatgtatggaaataagacaactctatcaacagctggttcagcaatacgaggccttcgagaaatcttaaacattctagtctatcaacagctggttcagcaatacaaagccgtagagaaatctgaacattcaaaatcagttgttacgactatgcgggaggggacaattgttgtttataagacacaacaaacgaccagggttgcacttcgggaaacaagcatccagacaatccctaaacatcagtaatccacgatgcagcctacacttaaaatcagctccaaagtaatcagcatcgatgcattgtagtaattagatctgacgaaaactgcagccaacgatagcatcaacaaacatatcagcgaaaaaaaaaactaaccgaagtaccctctaatcattctagattgtgctcgcatgggaataatcagaacccccgatctacaccaccagaaatacccacggcatagccactaaatcaagcatatgagctaccagacaggatcaaaacacagaaagtagatcagatccgaagaccgggaaacggatcgggcaagggcttagggcgcttcatcggcacgtacccccagaactcctcgacggtgtcgaaggtgtaggccttgcggagcgaggtcccccacgcggcgccgggcttgggcttggactggatgtcgtaccagaacgcccactgcctatgcagcttgtgcggcgccttcgccgccgccgctccctccgccgccgccacctccggggtctccgccgccgcaatcggcgctgcctccacctcagccatgtccgctccgccgccgccgccgccgcctctgctcctcctcgagggaaaacgaacgagtaggcgatgcgagagagagaagagaagggagaagccgccgccgccgccgaggggaaagagaaggagaaggggaagaaggtttcggcttctggatatggccgcgttggcgagggagatgtgctgcgttttcacctgggctacgaccccacgatgccactagaggcccggtccggcccgtttataacgggacgcaagtacatcgcagtctccttgtggcccatatagatgggcctcacgtgaaacgaaacccattcccgacacaaataaaatgggcctcatgtgcaccgaaggtccctcaacttgtcatcgagttacaaaatcgtctcccaaccgcaaaaccagatatcgggtatcccttaactaacaaaaccattcgttttaggtccttcggtggttttgacctcggttttatccgacgtggcggctgagtcagcgtgggacccacatgtcagcgtggccatgtcagcctcctctctcttttcccctcttctctgccttcctcatctctctctcttctcagcgagatcaacagtgcaaggcggcaacgctgggggagcggcgcgcaggcgacagggggaggagttgcgggcggtaggggaaggagcggcgcgtgggcggtggggaaaggagcggcacgcgggcggcgggaggaggatgtgatatcccagctcaaggcttaataggattaatagaatactcatatcttgcaacttcttttccggaagccggtctcgaaaaaactctgagattaagcgtgcttggcctagagcaattttgggatgggtgaccgaccgagaaattcttcttaacctagagcaattttgggatgggtgaccgaccgggaaattcttcccgagtgtgcatgagtgagaacaaagtgtgcagaaaagactagtgttggtttgtgagggcagtctatatcctaggaaagctgccagatgtagaaagggcccggcctcggagagtgtgggggcgtcacatatggtatcagagccgactcttgtagctatacgtatatatgaatatgcacgcgggcatacagtgtatacgggatgatccacgatgtggtcgtatggtatgacgtatgtgcgccgaaaaatgtctgcatatacgtggtgctaataggagacattcctggcctgggttgaccgacgaggacgtcggtatcttaagggggtgagaatgtgatatcccggctcagggcttaataggattaatagaatactcatcaacaagttgcaacttcttttccggaagccgatctcgaaaaaactctaaggttaagtgtgcatggcctagagcaattttgggatgggtgactgaccgggaaattcttcccggtgcgcctcaggttcttcctccccccgcgccgcg

SEQ ID NO: 3059 - DNA, 1044 bp, Oryza sativa
cgccgccccttcctaagctagttcgggttcttcctccccccgcgccgcgctcgcctgccgctgccgccgctttcacttgttctgcccgcccttttggtgcagtgagcagtcctgcttcgccccgccctttcccgggtccgccccttcctaagctagttcgggttcttcctccccccgcgccgcgctcgcccgccgacgccgccgcttcgcttgttctgcccgcccttttggtgcagtgagcagtcccgcctcgccccgccccgccgccaccctcgtctcccgcgtcgctccgtcaaccagcctacgcccctgcacagagaagtgagagaaagaagggagagaagaggggaaagagataaggtgttgatgtggacaccctgaccatgtgaggccagcgtgggtcccacactgactcagccgccacgtcagataaaaccagggtcaaaaccaccgaaggacctaaagtgaacagttttgtaagttgagggatgtcatatatctggttttgcggttgggggacgattttgtaactcgatgacaagttgagggaccttcggtgtactttttccacaccgttatgccgttccagcccaacacgtctgtcataggttcatccaaaattccacaaatcatgctcacagcatcatactttttccacaccgttatgccgttccagcccaacacgtctgtcataggttcatccaaaattccacaaatcatgctcacagcatcataaacacatgacatccaaaattccacaaatcatgctcacagcatcatgatagattcagaaacacaagaagttttccttgagagagatgagagtgaaatatctatggctgcgttcggtagaagtagttcccaacccatctctctcgttttccgtgcgcacgcttttcaaactgctaaacggtgtgttttttaaaaaaagtttctatacgaaagttgctttaaaaattcatattaatccatttttcaaaaaaaattagcaaatactcaattaatcatgcaataatagatacttcgttttgcgtgccggggagg

SEQ ID NO: 3060 - DNA, 11483 bp, Oryza sativa
attcttcttaatacgtgccatatttgatacttctccagttgtagcctcgacttgtgcttgagaagtctccccttgatctgaaacaaggtcagcttcatcgaatctaacatcaccctgaccccaaaggcttgcctgcaacctggcctccctttctttgttatatatggactgcagctttgacttgaaatatggcaaaacaacctacaaacatattaagaacaccataaaaaaaatattccaaacctgagaaatttcatcataacataaataaaatgtgacacccattttttatgagcattttgatagtgatatccatatgtttgtcgttttacttgagtcactgaggtagcacatgaaattgtatcataaatgccaaaaataacaacttcatcaagagcatcgctaatacatttaacaactacactaagttttggtgctgaatacgcattaaaggataatagaccaaagcaagattgaagactcgaaacttttttttctaatctgcaccaactttcaataagaaaataactgaacacagagatccagtaagagcatcgtagcttgtaactaaagcaaaaggacattctgtattcatactggagtagtacatagtaaaaatagactaggcattggtgtcagttgtaaaacgttgataaacaaggccagctttaataaaagagcagctcagggcacataatagaaccatgcaaaatcacacaaggttaacatatgggttagatttgtttctaggtgttcaactcttgaagtcatgataaaccaatttaatcaaattggtagagagaggtactgttttcgtagattttgatagtagctgcatatgcagagtagcaagacagaacagctcaaaagtatttaccacgaaaacaacaaagccaataccaaaaaaaaaaagcagtaatatttgacactaaagctgcttgctgctaaacgacatcataccaaaaaaacaacagaaaggactttctggcgcttccttagaacagaatcataggctttatcattggattctgcaccagaactacttctctttactgaaaccttaacaggtctccgcctgagaccatacaatgactccgaaaaagaaccatctgaaaaaaaaaacctggacagttataatcacagaggcgttgagatgtctcaaagaaaagttagtacaaaggtcatgaacacagcaaatcctttacagcaaaagaaccttatgtttctgtgatgacaaacctgtcgttcgcaaactatgggactcaaggacagccattaacaaggcaaagaattcatcctcgtaatctaaaactttatgtaacaacggccgtcttagtgcaaaaacctgtgagtaatagtatgagttagttagaactctatttaagaggcatgatgtactaaaattaaacacacacacaaagtgatatgttcaagaatttagagaaagcatcagctgaaaaaatgactcctctagtcacaagtttttccccttattaaaaatggtgcatatactacattaaactctgctttatcgctctccattgttgagacacttttttcaaacaggtagtagtaaaagcgcaattacatacttaactgcctgtgcaagaatcacaaagcgcaattacatacttaactgcatgtgcaagaatctttgtgaaccagatagagcagaatttgtatcatgcttttgacagtatgttgtgctaggtaaaggtccaaccttgtgtagggcaatccaaaaacttccattccgcatgtaatcctcttggctatttcgtgcccagtgcacactgttttttagtactttttaacagtattattggagtttcttcgtaatatacttctacatacgttccacagatgctctacaaaacacttcaccttcagtttgttgggatgctattctaattgcatcatttggtcacattcaatttgttcttaaacatgtgatatacaacaaccaatttaatattatttgtatagaaaaatgaacagcatcatgtgagctcaatgtcctttaaaagaagtttgctcaaaactacatatagcaatgatcccaatgaatcaacccaattcagtgcagctagccaaacaacctaaagagctgtaatatccatcagcagaagaaccaacttctgtgactgcgaattgcatatacaaaactagcactgatcaactatactccgagcttgcaccagtaaccaacagaatctggcacagaaacaaataaaacaacaacccagagcccgcaccattcaatcatctccaactcctcaagctagaccactacaatgcgcaggaagccagcatcgtcgagtgacactataattttctatcaccccctagaaaccccagacatctaaacaaattacagccacgaagtcaaaacacccttatcccgagcgatttggatcgaatttggaggagatgaggagaggggcgggggcgaggcgagttcatccactttaccccgagcgagtaggagagcgcggcgcggaggctggccggcagctgctgcgcggccgacatctcgaagaaggtgggccgcgccccctgccctcccacctggaacagcatcctgcctcctcctcctcccccgggctaggctcggccggctagggttcccgctgcctcttccccggcagcgcgactcggcctagctgcgggtggatccgccggagttgccgccgcagccgccggttagtgtagtcctcggcgtccacggcggtgtgtgtgcgtgtgggagagaaaggagaggcgaggcgcaaaagagaagccttgagggagacgggacgggggtggtgacgtcacgaggcgacgatgggccgggcttagagaggatgatgggctcttctgtcgatgggccttctcaggaaaacgatgggctcttcagcaacatccagttcatgcaaatacaaaggggctcattaattatttgagggcaactacaaaacgggatcccgttgcaacgggacaggcatattaactattctcttgcacgagtatcacaggtatcaggttttaggtatcacaggtaccgggtaacaggtatcaggtaccatgcagctagtaccacaacagatatcaggtatccgatactgtcttatagaaggtatcgcgttccaacgggataccattgtcttggttttctgtaattatttcgcttatatttatacttataaagctaagattaaaaaaacttaattttaaatttgatttttattagttcattattgtttattttacagcatttgtttttaattcactaagaatatatacataaaaattttacttacaaataactttttattcactaataagcatttcggataaacatattaataagcgaaacaatggagaatatggtgcttgaaagctgcagctaaagatttttttaaaaaagtaaaaatctccattagttttgtgaccagctagataagtactcagacattgcactgtctaatccatggcaatagcgacctgtatatatatgaacaatagtacaatgtgtacaaaatcacaaatgtgctagcagaacttgtattggacttggatccccctgactctagcaatggcaagaggcagaagaagtttctctagctaactataagatataggagccagagaagcgaggccgtcatcgaagttgcgggagtagctctccaggctgtacccgaacctcgccgcgccgccggctttcttccccggctgcgtcgacgccgagctcctccactttgacctcagcttccggtacagttgcctcaccggccgcgccatcgccaccgctgccaaccgccgcctctccacgccacccgtcgacgacgcggccgtcctcctccggctgccacagccgccgtaaagccccaacagaaacaccatctcttatatctagctccacagtatacagactacagtgcgggatcttttttttttaaaccccacggggtatatttgtattaaagaaggggaaacactgtacaatagccaaaaaggctaggagattacaagaaaaaagaaagtgagaaaaacgagggtgggtggggtgtagctactagaagagacgtatgattttgattagtcgattacgtggcgtcgtctgcacttccatggttgctcggtagtaggcattggaggctttttgccctgcctgcgtgccaaagccagatctcgttagtcgctcggtcaatgattccctgcagcggagtctctatgcttctgaataccctactatttctttctttccaaatttcccaggatagtagggtaaggattgatttgacgcccttccttttctcctttgtcattgcgcgaacggtctgagtccaccagtcctcaagggatgtcgtcttggtccaatttactggccgtagttgggggacaaccagccttgtcgctatagcatctcatattgctcttgtgatcgggcattcatagaagaggtggtgtgccgtctctaggttcctaaagcatagttggcagaagtagttgtttggccactccctctgctgcagcctatcagccgtccatattctattttgaaggagcagccaggcaaaaaaattgcatttggacggtgcccaacacttccaaactgcagttgccgataatgataggatgctgcccaggaactgcatttgataggttgacttttgctgtataggatccggttggtgtccatttccattgtatgctgtcttggacaccttgggatagggtagtgtttgattcccaaagtatctcgaaaaccttgaagaactccgtgacgagcattgatgtcaagttgtgtctgatgtcattgatccacttattgtcctgtagggcatttgcaacagtccttttcttccttctagcatgacggtagaggtttggtgccattgtctttagtggggagctggatacccaaggggattcccagaagagcgccttcctgctgtccccgatggtcaccgttgtggatgctgcaaagagctcggcgtcctgttcgtcacatggggttggcataccaatccacggtttgtctgggaaggtccattcgtaccacagccatcgtaaatggagggcccgtcccatcttggtgaggttcgagacccccaggccaccatacttgatcggtctgcaaactcgctgccaattcaccttgcacttgccaccgtggaactcatcgccaccgtcccaaagaaattttcttcttgctttatcaatttcttggattatttgctttggaatcttgagcgctgtcatgacgtagattggcatggagcttagtactgagagtactagctctcttctgcccccggctgagaggagtttctttttccaactggcaagtcgtgccttgattcggtcaattaagtattgtaggtggaccttgcgcagtctgcttacagtgaggggcattcctaggtactgcattggaaagactccacgtgggcggtgaaattgtgtagaacctcgtcgaggtcaaccgcgtcgcagcttattggaagcactgagcttttttgtaggttgacttggaggctggttgctcccccgaaaccgtttaggatcaagattaggctatccacatcttggcgagatggcttgatgaagattgccgcgtcatcagcatctagggagcacctgaagcgcgcgctgcgatccgctagctcgcttaggtggccttcgtcagttgctatcttgaggagtctgtgcagagggtccattgcaaggatgaacaggtacggagatagggggtccccctgtcttaacccccttcgatggtcgatcctttccccctcaataccatttagagagactctggaggaggaggctgagaggatcaacgccacccagtcgcgccatttggcgctgaagcccattctctctaggagtattagcaggtattcctatgagaccgagtcgaaggccttggcaatgtccaacttgaaaaagagggtgggtttcttggatctgtgcattttccttgccaaattggagacgtaaaggaagttgttttggatgcaacgcgttttgataaaacgcactctgggcttacgagattagaccgttgatctgtctggacagacggattgccaggatctttcccaacaactttgccagggatcttaattaatttcttcctcacggctcactcagaacagaggtatttcctccgtttcaaaatgtaagacattttagcattttccacattcatattgatgttaatgaatctagatagatatatatgtctagattcattaacatcaatataaatatgagaaatactagaatgacttacattgtgaaacggagggagtagctaactgcaagtctgcaactcgatggcctcgtttcttcgcctccttccacctgcggcttatataaagctcgcacttggctacgacgacgacgatgaccggattgttcggagaatgtcaccggccgccggcctggcccgccgtggtcggccactgatgacaataatggcacgggcaagagtggatttctgcaggtagcttcttctttctccctgggggccagatgctgaatgtgttgcgacgtactgttaacgcgcgtgaaacacgtgatggtacggagatgtataccgtgtgcgtagtacatgtgttagcgtcgaagagacgaagactgtactagcagctacagatcaggtgtgaaatgtgacatgatcatcaacatgcgtatgcatgatccaatagctagctacgaggtgtggagctgccacatgaaaaatgagcttcatgagtatactcattttccgagttccgaccagctaatcgatcagatagatctcacagattaatgaacgacgatggctgacagctcggggattatggcgaccagcttcttcgcgcatcatctaccatgcatgatgacaacacaagacacatgcatgtatatatattcttaaagttcatcagcgcaaaagctcgcaagaaacaaaaaaaaaaaagcttcacatgatctctctctctctgttcagatttcatatctcccatgcaggaatcaactaataacattgctagtcaactgggcctttaattaatcgatctaccaatgtgttcatatggatcatgcaggattattatacaacctatgttctgaacaagcagttaaagggaaactatttttatccctcgaggagacatcccctcattatttgcatgtcattcaaatggttataaaaaaatgtaaaaaaatttgaaaagatgtattatcatgtgatatatcactccacaaacatgcaagttcaaattcaacttccatatctcacaacaaaaaaaacaaatttgactgtgaatatacgttaactagttgtagtttaatttttttttcgttgcgagatgtagaagttgaatttcaacttgcatgtttgtggagtgatatatcacatgttaatacatcttcttaatttttttcatattttttcataaccatttgagtgacatgcatacaacgataggatatcccctcgagagataaaaatccactcccgcagttaaatcttgttaactcgtttatcatgttttcgcatggggttgacccgatgtacgatagatttattcagttcacttaattaaagagctcattattctcgcttcgttgaacacgtactaacactgatggatcatttagatcctgtttgatataacttcgaattcaagatgttttgaaaccgggcattcctaatactataaatttatagctctgcaatcacgctgataacatttagatgaatcattttatttttatttaaaatagaatatacatttttaatcactataatttaacatataaactttaaatctaatgtgaatctgggatttgatgccagagaaattccccgtggcgaagaaaccgccgaactgaacgttgacgagggcgaagtggagacagcagagcatggtggcgagttttgattttgttgcatgtgcttccaaaattcaaaacgattttgttgcatacagcatatctctactacttaaaaaatttaaaacgttccgacgtccgtgacaagaaaaaaaaagggcgaaaaataatagattcgattgcgatgcgaaaaaaacagtccgtaatacaaaagtcatctgttaaacaaacgaaaatgccttaaaaaacggttcgtaccacaccacgcaaaaaaaagttcgactccgtaatagaaaaggctgaaaaaaaaaccgagaaaaaaaggcatccaccacgcggaaaaaaacacgtttctgcaaaaaaaaatattattatgtttttttattttctttctcgatttccgatttttccggcgcaccgtttccttcccgatttctaatttttccatgcaccgtccatgaaaagcagagttgtttctggttgtgtttatatacagatttgatgggccataaactacttcatgagctcggctaggttacgagctagcccaaacacaagattcggcccgattaaatttgagtcagataaatttcaatatatagagaagtccttgccattttaggatattatgaaacacaccataatctcaacatatgattcttcatgaagatttaaacgagagtataaaaaggcttatataatttctacgatctatagagtagaagtattcaaacggtaacatgctataaatgttgatgcgtcatcaagcaccatgtaaatttggaaatcatgcttacttcaaaactattcttttaaattagtttatcatgagctatcatattttccttcgtaatttgagatttattttagcgagcaaaagcactgggtgaaaatagcttcgattaaaaaaaataatttaagttttactttaattattctaattttattatatccgtagcggagcacggacattttgctagtatatatatacgtaaccaagttttagttcctccattaatttagttatctatggcaatataaaaaaaagcaaatctgaccaaattgtatgaagacagaacaacactacaattacaagtagatctaacactaataccacttgcataattattgcaggtagaccagaatatattgcactctccggtctccagcaatggcagggcactcttctctagctacctagctacatgagcctagaagcggtagctggccggagacgatcgatcgaggccgccgtcgtcgaagttccgggaatagctctgaaggtcgtacccgaacctcgccgccgcgccgccgccgccgtgccgcttcgacgacgacgaccgcaacctcgacctcagcttccagtacagctgcctcaccggccgcggcgccgccaccgccgccgacgaccgccgcctccctgcgccggcgcccttcgctgtcgtcgccatcctcctccggccgccgccgccgccgtacagtccgtccagaaacgccatctcgatccgcctttctccggctgcaggccggtcacaactcacaacaacaaagatcactccgagatcagtactcaaagcttgtccagagatcgagttaatctgcaaactcttcttgctctgcggtgcgagagcgtctccctcacctgcggcttatataaagctcgcaggatggctgtgggtatcaccgccggcggcggggccagcgagccactcaccggccggcaggaatggtccgggctaaagtggatttcaggtatcttttattctctctctaccccattgccgctgtggtcaaggaaagagacgatggagatagccacgacgaaagaggagggggagagcatcgtccttttgctttagaggcggtagcgtgagcagtgaggtggcaatggcgaacgcggccgtcaccctcgcccaaagctaggaacaaaataaatgaaaggattggaagagatagagttggtcgatcggcctggcctcgaatcctcgatcgactatggattctctgtcataatatcacgatcattatattaattgatctatgctattttttattattttatatgttaatgtttataataatagtattactataatagagaatgtgaaacccgtatgagtctctgatgctccaagctcgctcggtgtatgtctttctgctcgatcggagtggacggcgaaagcggcgcgaccagatgccgatcgatgcgtgcgtgtgcgcgaaactcatgcagagctaattaagagctagatcgatcgatcgatcaatgtggtcatttctatgggcatgtgtgccatactgagatgttcgtatacgtcacatgaacaatgagcttaatttgtgtaggtaacgtacaaccacaattaacgtactacttaaaaaaagtgatttttctgtatgaggccccctcatttttccatgcggaccataactagtggcgtctgtaaaaatcgagagtcatttttccatacggttgcttaagtggcccgtatgaaaaaatcgattttcccatacggacctattaagagggccgcatgtaaaaatgagctcatttttgcatacggctcacataagcgccccgcatggaaaaatcgatttttccatacggaccacttaagaagccgtatgcgaaaataaaatttgaaactagtgtatctcactcatatgaactccaaattgaataatttttttctaaatgtttctaaaatcatgatagaatatcgtgttcttactggtattattttggctgttttttcttatgactttgttttatcaattaaaattttgaatttcaaaagttcaaataatattttgaagcagtaaatgatttcatcggaaaaagtcatcaataacaaagttatataactcatcaagatctataacttctatttttgtcatttcttcatccgacaaagtgattttctttttcagatgaaatcattttcccaccactttaaatttttttctacctcatctcctctctccccttttaattaatttattacactcccctctctctctctctcctctctctccctctccctctctcagagcagccgggcggcggatggcgacagcgtcgatggcgtcggcgggtggcggatctggcggcgctgccctcaggagggccggatccaccgccatagggagcggctacagcggcggcgggcggcgcgtctacggcgatggctcggcatagcagctacagcccctgctccgtacgtcgatggcatcggcgggcggcgtggctacggcggcgactcggcggcccgccaccccctcctcaccgccgccgacaacgacgacgatgaggcgaccctccccccctcctcaatgccgcggcggcgggggcggcttggccgcctcgggtggcgccgccgcaccgcgcggatccggcgggggcgacgacggcgggcggcgggggagacggatccgccgccagcgacaacgctgggcggctggggcgacggatccggtgccaccgccgacggatccggcgggggagacggatccatcgccggcgacgacgccgggcggctggggcaacggatccggtgcagccgacgacggatccagtggggacgacgacggcgggtggcaggggcgacggatcc

SEQ ID NO: 3061 - DNA, 18783 bp, Oryza sativa
gaaagagcctttgtgtagtagtgacgagctccactctaagcgcgtgttatgatctaattaacaacatgtggtcgagttagggcgtgtttaagtggaagtgaaaagagaagagatgtaagctattagcgtatatatttaattatgtattaattattttaaaatttaaaaaaggattaatatgattttaagtaaatttttgttgacgaaaaaatcgaatacaccggtctaggagatctgcttagctcctgtgcaggtccaaagattaatgagatgcaggtgtgccagtcagtttgatcctgcaactgacaagatttgcaaataatagatcaaacactcaatcggctgacaagccgatggagtagttccagccgatagccgataatagccgatgccgataccagccgatagcggtagggtttaagcaatcggctatatgtccaatgtagataatgatataaaggcaatcggctgatgataatataatatagcaatataatccagtagaaaccaatcggctaacaatatgaaacagtaaaacaaatattgatccgatggttaaagcacatatcggctggaggtccgatgtcacaagatccacaagattagattaaacagtgaaacctttgttgtcatcggctaaatcgaacttatatgtattgcaatccttatgagccgatgcaacgtccacataactcaccggctgaaaccccgatgaaacccttattggcaatcaagaagcaggctagagattatggttctaagcacgacttagtagatcaaactcaactgatgcataactaagtatgaaaagaaacataatatttagacaatcaaaccgttgactgagttttcagggtggtagatgtctaagctaatctaatctagcaacgcgatttagccgataccggcagaaaccctaaaacaagaagcagccgatagagctaaattgatatgctaggactatattaacagagacatatgataaataggtagacaaatatatcatccaaaccagagcaatccaagtggtcgaatgtactgatgcagccttgaacgacgccgacgtagacgatacaattgcctggaccgacggaacattagacttaccccttcgccggagatcgaacaccgatgcagccccgcgtcaggtgccaagtcccgccagatgataaaataaagtagaaaaggtaaaaggtggcgatgcgccgaattgtattgatcgtagcgattgatagattacaatgaccccgggtgtacatatttatacccatagggagatactagttcttgtcggacaagaaagaaactaaaaaggaaaagataaagtccttaccggacactaaacacactttcctcaagataaaaggaaactaacaaactatacctaattaatagataactgtcatgtcgcatccttcttgaactcgaactcttctagataagcttcctttgattgatccgactccaccaagaacacgacatcgtggcgacttgactcccatcgactgattctagaactttgaagccgatactgactctaagccgatggtaactttgggcttaccaaatttcactgttaacaattttatattattttttaagaaaaatacattgtttagcaatttgagaagtatgtgaaaaactagagaaattttttctctttcaacctcactagaacatagccttaggggagatatatctgaatctgatgcatgttctgtgtgaatcagaatactctaccttcgaagtcacgtgattttatccttgacatatgaatctaatactgaactatgggggttgacaagaaaaggagtaaactgatactggttgaagcttctgccatttgctgggctttatggttgagtagaactgatttggtttttaacaaatcaccatctattttatttatgcaggtaattttcagggcaacgcactggctccggttttgggcacagctgcaaaggtgtgaggatgatgcggagttcctaaaggttgcatgccgcaagttggagtcgatggttatgcaactatttgccaattatgaatggaggttcataaatagacttcaataaatgtgttctctttattttggcttagtttcctctgtttttgtttggtgtgttctatttatctgaactacactcttggatgctactgtataataattggttgtagctcttttttagcaaaggctgggacgttaaattccattatataaaaaaatatatgaatctaataaaccttggataatccacatctgagtgataaaatgtacggtgactttaaagatagaatatctcaatccattttaagagggttttatgtctaagtgcctgatctcacgaccatccatcaccatgtaattcagcctgacatgcatggtgacgataacacacgatccacgatccttgctgcaaatgtacggcgaagaccctgaccgtccacgtacgacgatgttgcgagagaaaggttgaggtcggtgatataatgtaattaattaactaaattaaagcataagcacttgagcaatatatagatcaagattataggaagcagctacgaaatgatcgtagatggataggatgagaggaaagtgcagggagatgactgcatcgagacgctttacgcgcatgatgaccgatgggtttgtgtgccatatccattccatggatcaacctgacgtgtaacgtgtaagccgcgagttctaaatcaatttctgacgaacgcactggcgctgattagcgccgcgtggaacaaccgaatcctttgcacaaaagagaccgagaccgactggctaattactttttgcttaactgaacatctgctgatcgatctgtggctacgacggtctaccatataccaactttcagcatgatcattacgatatcaaaagaagaacaaaactagtactgtcctgtactaagctgttaggagatggagggaaggaaacacacctttttttaaaaaaaaatggaaaagcatactagtgtcattgaagacatgacccaatccatttccgctaaatgacagtccttccatttttagtatatttaaacatgacgtttgaatatttgtcttatctttaataggaagattaatataagttatacttaaattatctttaatgctaaaacaattcacaataaaataaataatactgaatgagatgaatgataacatcgtgtcagaagtgataagctggcaatatcatactccttccgttcaaaaattttaacttatagagtttaaattttgtcccacaaaaactaacttctaccatcatacatatccttaacacgtaaaacgagaatctttatctcttcaatactctttatctacttatcacttttattacttttttttaatgattaaggatattttagtcattctcactctccactatttcaaacgagaagctttatcccttcaatacctttacctacctaccactcttattacttttttttaatgattaaggatattttagtcattatcgctctccactattttcattttggaatgctaggaatggttttttttttacggagggagtatatatttaaacggttgcagtactctacaacagtgcatctcgtgtgagatttcagacttggaactaaacaagtgatcctagtcaggcttcacctcagaccaaaagctctaaataatttcattcattattaattcgtcaacaagaacagaactgtcattgcagtaagatctccagaagaaatatccatcaagtttaattaaatcagtggtggtgatgctaaattaaagcacatgcatgcatgcccaaattaaagaggataaacacatatctacttagtgacatgatgtcatttatctagtaatcttatgatcttatctgcagtactcacttctaggtataaagtaacacagtaagcatcgcaggaaaacgatggaaagcaaaaaaggaaaaccactaagtgctaaagctaaatctacctacgagatcaaaggggattagctgatgagctgatgactcacccacctgatcggctgattcacagatctcacaaaaggacggccatggtgtggcatcttttaattatgattgggaaattcaaacagaaaacaacggttgtcaaattatccgagagtcaccggcgtccatggcgaaccagcttcgagcaagagatcttaatttcatcagagattcagagagacacacataccaccttaattaacacagctgcagctaagctctgttcagatttcagatatccctacatgaacccaacaacaaaattcgcctaattaagaaaacatgtgctatcaggtctcaagaaaaaaaattaatcactgaatacaataatttcttcagtagtttcatgcttttggcaaccagatatatatgtacgctcaattgttcatgtcactccaaattgacatatacatgtataatacacaaacatcttcagcttcaggcttattatggcaaccgaatatattcatgtgtcacgtacgtatatatacatcccataccatactgtccatacagtatatgtacacaatacatgaacaagagcgtgttaggatcgtagtttctccattaattttgccatcccagatgagcactatgaaaaaaaaacagtagtacaatctaacactaataccacttgcagagttgcaggtagaccagaacaataatctccggtctccagcaatggcagggcgcgcgatctcgggatcgaaccgaatgagctacctagctagagagcctagaagcggtggccggagacgacgaggccgacgccgtcgtcgaagttgcgggagtagctctgcaggtcgtacccgaacctcgccgccgccgcgccgccggcgtgcctcttcgacgacgaccgcaacctcgacctcagcttccagtacagctgcctcaccggccgcggcgccgccaccgccgacgacgaccgccgcctccctgctacgccggcgcccttcgctgtcgccatcctcctccggctgccgtacagtccgtccagaaacgccatctcttctcactgacaaaattaagatcactctctcgatcgacttgctgtactcgagatcaaacacaagcctaggagtttttgcaaatcttgtttcgccgcgctgctgtgagctaagctagcgtccctcacctgcggcttatataaagctcgcaggatggctgggcatcatcgccggtggcggggcccgccggccactcaccggccggccggaatggtccgggctaaagtggatttcaggtatctttttttctctctctctctcccattgccgctgtggtcaaggacagaaacaatggatggagatagccaagaaagaggaggagagcatcgtagatataggctaagccttttgctttagaggtattcctccgtttttaatgttacaagacattttaactttgattaaaattaaactgctttaagtttgactaaatttatagaaaataataataatattttcaactcaacataaatttattatgagaatatattcaattgttgatttaatgaaactaatttgttattataaatattactatatttgtgtatagacttagttaaatttaaaggagtttaacattgatcaaagttaaaacattttataatttaaaacagagggagtagctaattaacctaggtagcgtgagcagtgaggtgggaaatggcgatcgaacgcggccgtctccatcgcagcataaattaaaggagagcaaaagctatgttgatcgatcggaataatcgatcgtttggagatagatcagtcggcgtgtcgaggcgcgatcgatcgatgctcgctgccgtcctgaaatgttgtagtggacggcgaaagcggaagcagccagatgcatgcgtggatacgtggccgagatcgcgatcgaactgctgccgaattgaaatgttgtgcgtgaaacttagggtttgaaagtccggccggaatgaaatttcggaccccatacattattatttcggccgatttttttaatttttttaatttgataatattttgttcaaatttgaccaacatttgttcaaaatttcagaaatttcggatcaaaattttagaaatttggtatatccgtgacctccgatagaatcggtcaaaccgaaaaattaaaccccgtgaaagatatctatgcagatcgatgtagtcattatattcccggccgtacgtaggcatctgagcgccactagctagcgtctgaggcatattacacatctacacgttttacaattgacacagcaaaacgtgggggaaatataatgtcacatgaacaatgagagagcttgcagctacagtgagggttgtacaatggtcgagtttaggcgagatatctggatgttgccatgctacgacagggcttaatttatgcccgtttggctgacatgacggtgtggccgtgtctcttgttcaaacgacgacaatctgtgtgttcagttcagatatcgcgtggtcggtcgttgctgcgaacgaatgcactccaaacagggccgtgcacatgggcatgcggcccatgcgaccgtatagacctccaaatttttagggcctcagaaaatcagcccaactgaataaggcccatgcatttgtgtgaggccagagcgccataaccctgttcgagtccgcgcgtgtctccgcgcggcgacttcgcgtgcgtggcgcttcgtattctcaactccgagccccgagaccccacggcgttttgtattctctttcgtttttcgtatctgtgacttattcagttcgtctcgagtctcgacgtcttgtctcctccgagcagcaagccaccagccggctcatccaatttcaaattttcattcaaccagcgaatagcaacttagcaagcaaccaacaagtaaggcactaggcagcaagccagcaacaacaacgaacattctccattttcaatttgacagtttctgattatgcaaaacaagtgataaaaaatatactattcttgatatatcgcatttgctctgcagtatatatattattttagttatagtttgtatcctcacttagtgttttgtacagggcctacaaatttaacggcccggccctgacttcaaacagctagctaggaccatggctgtccacgttgccgatcgagaaaggttttggtgatgaaactgaattagtacagtaaagcataactgcataagcactctgcactcgttggagcaatatgcatgacagacgatgatatataggcagagagctaggaaagacaatcgcgatgaggaggaaagtgtaggaaggtgactagggttcaccataccaccggtaaccgcgtggttaccgcagttaccgggtttaccgcgtttaccgtggaggtatggtaatgtaaataccgcggtaaccttcttaaatttaaaaaataatttaaatttttgatgaattttacacggttttttacggttaccgcgataaccgtgcttaccgctggggcgcggtaaccctggccccggcggtttgggaaaccctaaaggtgactgcatcaaggcgctttacgcgcgtgattgaatattgatggatggttactgcttcctctggccggtgtatttgacgtttagggagaatctatctatctattatattattaaacagctttgaaaggaggcaccacgttcgctgtggaggctagaaattcccacattaatcggagaaaaagaaaaaaaagaaaaggagagtccaagtagaaatacaatttaaaaaaagctgaaattcggaattaaaagtaagcaatattgaaagaagtttctatataggaacccaatacgagattaatcaaaattcgaaataaaaataaaataaaatccgaaattagcgaaaaaaaagagtctaagtaggaatacaatttaaaaatagctgaaattcggaattaaaataaggaatattaaaagaagagtccatacaataacccaatatgagattaattaaaattcgaaataaaaaaaataaaaaaatcgaaattagaaaaaggaaaagaaaagaagagttcaagtaagaatataatttaaaaattaactaaaattcagaattaaatataagcaatattgaaataagagtacatataagaacccaatagtagattaactaaaattcagaataaaaaataaaatataatctgaaattaggcaaattaaaaagagagttaaagtagaaatacaattttaaaacaactgatattcaaaataaaaataaaaaaatctaaagaacacaatacgaaaaataaaataaattctgaaattagaaaaagaaaaataagatatcagctagaaatacaatttataaataactaaaattggtgataaaaaaataaagattactaaaagaaaagaccatctgaaacacatgacgagattaattaagtaacatgcctatataggagaagagtggtggcggttgatgggacatctaaaaactattaataaaataccaaataaaatcctaatgactactaaaaagaagtacaacgggcaggtcgtgaagcaatcggtcaaggcgtttggcgggacttctagaaagtaaaaaaaaataaacccaatgataatcatatttgatttttacgttcactgtgggggctagaaatttccacattaatcggagaaaagaaaagaagagtccaagtagaaatacaatctaaaaatagctgaaattcggaattaaaagtaagcaatattgaaagaagagtccatataggaacgcaatacaagattaatcaaaattcagaataaaaataaaataaaatccgaaattagcaaaagaaaaaagagagtctaagtaggaatataatctaaaaatagctgaaattcggaattaaaaataaggaatattgaaagaagagtccatataggaacccaatacgagattaatcaaaattcggaataaaaataaaataaaatcggaaattagccaaaaaaaaagagtccaagtaggattacaatttaaaaatagcagaaattcggaattaaaaataagaaatattgaaagaagagtcatataagaatccaatacgagattaattaaatttcggaataaaaaataaaaaaaatcaaaattagaaaaaggaaaagaaaagaagagttcaagtaggaatataatttaaaattaactaaaattcagaattaaatataagcaatattaaaatataagcagagtagtggcagttgatgggacatctaaaaactattaataaaacaccaaatacaatcctaatgatgactaaaaagaagtacaacgggcaggtcgtgaagcaatcggtcaaggtaggtggcaggacttctagaaagtaaaaaaataaacccaatgataatcatattagatttttaaaatctcaataataataaaatgagaggcagcggccgggtcgtataggagtacaatggcaaagtcgccgatggttggtgggtcttctataaagtaaaaaaaatgaattccaatgatagttatgtttgacttttacaatcctaataaagagtatgcggcggacgggtcatagaggagtatagtggtaacgtttgatgggatttctaaaaattataaaataaaaatgaaacccaacaagataataaactccaatttttaaaggttcgggcttctaaaaagtaaaaaaaataaaccccaatgataatcctgtttgattttaaaatctcaatgacaataaagaagggcggcagcgggtgagccgtagagtagtatagtgacaaagtcgctgacgttttggagaaacttctagaaagtaaaaaaataaacctaaaggataattatgttcgatttttaaaatagcaatgacaataaagagaagatgcaatggacgaacatagatgagtataatgatagtgtttgacgggacttctagaaattataaaaaagatgcccaataggacaataaactctaaaacatataaagattctaaggagaatgaatagaaaacggtggtagatcgagcaagcaaataaagaataatatgacagaagtaaggggtagcagttgttgtgactttagaaactaaggaaattagaaacacgaggataataaggtttagtctttaaaaatcttaagacaacgagataactatttaataaatttgaagtaaaatcatattaaaaatatataattttatatgggtgctagccgcgcaattgcgcgagccacccagctagtttatttttaaacaaagaaattcagaaattattggtggccaaagttttaaaattaagtttgattaaatcctattttaaacgttaaatatttataacttttagagggagtacgtcctagcgtcctactaagctcaagctgctagctatgacgtaaaaacacttctgtttaattatagtgctatagagtgataacataaccacacatcaacggtcggatttcagacttctggcaaaggaattatacgcagctagtacaactaaacagttccaatttcaggccaattgctgctggatactgtttgaggcctagtgcctagcttttatgttttgttattcgaaacctatattgcgagcttaaatactcagactatgtatctttggggctgcgtatatcctgctgcaggatgtataggtcgggttttaatccattattaaaaaaaattagttatattcattcgtcagcaagaacaacacattcagccgttgcagagtgtacatatctgcttagtgacatgatgacatttatctagcctttccttacgatcttatctactcataattaacaaatttctaggtcgtagtagtgagcatctcaggaaagcgaaaaaaggaaaaccactaagccctaaagctaaatctagctacgagatcaaagtgacattagatgatgagctgatgactcaccgacctgatcggctgattcacagatctcacaaaaggacgacggatggccggcagctttaggattaggaaagtatagttaaaaagcacaagtcaaattatccgagtcacttggcgatcagcttcgagcatggcgatcagattcgagcatgacatctttcttaagctcatcagattcacagaagctgccaccttaacagcaacatttatatctgatcagatagcaccacatgactacaacaacaaacaatagcaatggtgctagttaatcctatgggatttgtatgggtttttttttaccaatttacttatgcattatgcaggatctgtatgcattctatgttctaaacagatcattaaagtttgctaaagcatttatctggcatgtcatatatgatttcactttttttgaatctctcattttcctctgagcctgttggacggaccgagattggtgcagtccttactataagccctatcattttgcttattcgacgatatatttacaaacaaaaaatagtttgtgaataattttttattgtatatgttcttaacaatttaaaagcaaaggctaaaaaataaactatgataaaaaatcataaaaataaactttaaatttaaggttaaaattttaaattttggttgataagcataagcataagtgaaaagatgaaaccatataactacaactttagcagttgcaccgcaactgatggatcaaaaaccaacggcttagatcataaaaaaaatattgttcatgaattactgtagcaaatctacaacggtgttgctataattatgtcaacacattttgtgagtaatcacagtcgatttcttgttcaattgatctcccttgagattcgtgctacaattgcaataccatgtgcattgaacgtctttacatatttcgtgttgcatcgtgaagccaatcaatttaaatttctcatctcgtcagcatgtgttttcatgaaaaaactactacatatataatttcaggacttagatatgtaattttagaacttacattataaatatactaaaattacatatgtaatttagagacttacatatataattttagaatttacattgtaaatacactaaaattacatatgtaatttagggacttacaatgtaaatacatgctgactattttttggtgaaaaatatggcgacataaatataaatatagttactcccaatctacaatgtaccgattactgtagcatcgatggtgcggcatgatggcagagcaaatccgagccgttggttccatcgatccaacagttattatgtgctccttgcagtcattactactacagcaccgatctcagttcctctcgacactgatggatcattcacatagccaaagccactttagggctaagtactgttcctagtaatctaggcccaattaaaactctaacattagcagtaaatgggccgcatattgagccgaaagcccaaagcccaaaggcccacatgcctctcgccttataagtagccgaggcagtgaagccctagccgggtcctcgtctcctcgcgccgccgccgccgccgcggacgccgccatgtcgaagcgaggtacgtgcgagccacctctctccccacctccgctccgtctccttcctccgccgctgcttctgcgtcgctgatctggtcttcgcgcgtgtcggaaatggtggcgcagggaggggtgggtcggcggggaacaagttccggatgtcgctgggtctgccggtggcggcgacggtgaactgcgccgacaacaccggcgccaagaacctctacatcatctccgtgaagggcatcaaggggaggctcaaccggctgccgtcggcctgcgtcggcgacatggtcatggccaccgtcaagaaggggaagcccgacctccggaagaaggtcatgcccgccgtcatcgtccgccagcgcaagccgtggcgccgcaaggacggcgtctacatgtacttcgaaggtacgcggaagctgcacccaatttcgcccatgccgatctgtgaaatcgtgatgctctctagtgtcttgatgattagtgttgcattatgacgtgttatgagctgcgttaagtttggtttctaagtattttagtgtgatcttttagtccacctgcataaattagtgtcaatttcattatgggttacacgatttaccatattgagaatgctgatcagttgtggctgctacgattggagcaatgctctatttttttatgcttacgtcattacgtgattaagttacacattcttatgagctacagtgagcttgttttgggggctaggctttaggttgattttacttgaactatcatcaaatctaccagaaaacaccaaatatgttagcaggttttttttagtttggtgaattatttttaagcaaaaatttatgtgtttgcttattgtgagtttgtaacatggcataaaagagggtacaaatattcttctatattttactgtcttcactaggaagatgttttagatggggccttttggttgggaacatgatctttattgcctgacatggtgctggtcctacttttaataactatggtgttctcaaaatatttttcaactggaagatggctggcattacttatctgattgcgctgtataggccaattgctgaattttgttcgttggagcttgttctgttattttatttgcactgccgtaggaaatacacagtgacgggaggactgcaaggttcttcagctttttctggagcaaacttatatacatgtttgcatattcctaagtaaacgtcacaaacaaagcattgttggatgtagaggttttcttataaagattttatcttcataagagttcctccatctggaagcggtcacatattccattgccctaggtagtggcatcgccgctatgaaactttgggactggccatgtgacatatatttttgtcttctgatgccataaatataatacattagcttttattcattctacatgttttgtgtgcttttattctttggtctcttttacattttgagcagcatttcatttgtacactattcccttggctattttgtcattggttttatcatttggagctgccatgtggtctatcgaattaataccggttatgaaatttgatgtgcagacaatgctggggtgattgtgaatcccaagggtgagatgaaaggtatggcgagaacactactatactcccatatgttatgtgttattgtattttctctcgaagcctaccaggcaataatttactcactgtgtattcttttccaggttctgctatcactggacccattggtaaggagtgcgccgacctctggccaaggattgctagcgcagcaaatgccattgtctagagcttgtttggagtagtagttttcagttctgtgccggatgtgataatgtgctccagttcttttttgtttccaaccaagtttaacctgaacttgaagcaaaccttcagttaaattttcagtgcggattgtgtccttgatgaatggaaaatggcatgtttgcttgtttaccttgctccttttaatcagttcacagtcagcaaccagatcgtattctggagaaactagctgaatgaacatcaatctcacctttctgccacctgaagctgcctgaagatttaggctttgttctatgcttccctacctaatctctactcgctcattttcaatgtgccgctgcacaacctctgcgatcagcgacggcccatttgactcctttctatgtacgttctgacgttatgtgatgttctaggatgatttcctctggggttaattggattcatgccactacaaatatgctaaattagaaaaatagcactactatttgtgatatcggttgggtgccactagaatttggagaaattagaaccgtgttactccgttggttttccatccactcctcgttaatttcccaacttcagtgcttggcctcgatgcggcagcgaaggaacttcggtgcttggcctcgatgcggtagcgaaggagctcggtggcagggaaagcgatgacagccttcaagcatgacagtgacaatgacgtttcccaactctggcggcgagcggagcttcggcgacgagcgactagagcggcggtaacttgggtacgcggggaaggcggcgctcggccttgatgtggcgaaggagctcggcggcaggaaaagcagcgacggccttctccgctctcaaggggcacgatggcgaagcacgccgagagggcgaagcggcggcgacgggccatggctgtgcgcggcaagagggcgaggtgatggcgaagggtctctaggggcacaatggcaaagcacgccaagagggcgaggcagcggcaacgggccatggctgtacgcgggcggcgagaggtcaaggtgacggcggcgggtctcaagggggatgatggcgaagcatgccgagagggcgaagcggcggcgacgggccatggttgtgcgcgggcggcgagagggtgaggtgatggcggcgggttgtgactctgtgtcggaggggagaaggagaggcggcggcggactgtggctgtgagtgggtggcgagagggcgaggtgatggcagcgggccgaggctatgtgtaggcggggagagcgtaaggctgcgccggttagtggggcgagggcaaggcggctcggttgtgcagggaaggcggtgctcggcctcgatgcgcgatggtgatggtggggagtttcgacgatggtggaggagatggcagcactcggcacaaacgaaagatggtggcgccaatggggagtagataacgcgacggagtggcatggatccaatttccccaaattttagcggtactagtcgatatcacgaatagtagcgatatttttctaatttggcatatttgtaatggtgaatagtagcgatatttttctaatttggcatatttgtaatggtatggatacaattaacccttttcctgtagcatagtaagagcatcactaacagtccttatattgttcccaaaactgatttttatgtttttaaaactgatttttatgtttttaggtgaaaaatcggatccaacataaccccacacacgttttagagttccttcaccatactgattgtaagggttttaaagtgaaaaatcggatccaacacacgtttcagagttcccttcaccgtactgattgtaagggttttaaagtgaaaaatcggatccaacagatcatctacacacggatataacagaaccctgtttcttccaaaactgattttaatggttttaggtgaaaaatcggatccaacatatccccacacacgttttagagttcctttaacttactgattttaatggtttttaagtgaaaaaatggattcagcagatcccctacacacggatctaacatatctcagtttcttcgtgatctattcttataaaatttaggttttctatgagagagatcagtttttttttctattttcagtttagaaaaccaaaaacaaaattttctattttcaatttagaaaaaaaaattgggagaagattattcgtaatgtcttgatgatgctctaagttcctcttgcgtaattttccaatattctcaatggatgtgcattgttacgacgataaatggtaataactgttaaaatttctgccaacaggattttcaaaagattcagcctttggtaaggaatttcttttttttatctgattctttttttagatagtcgtgtttttagatgccacagatttcattggtccctcacttgtatttcctaatgaagtaatgatatatctggagaacttttgggtcatttttttattttttatttgtgatctttttgggaccttaattagttgattgtttgaatcaggcattctgtgtaaacaaggtttgcataacagttttattcggtgtgcttctacttagcttaattttattcagccgcttatattttgactgaatagattaggtttcttgttcccaattacacgacatgtagaaattactttgacacgcaaaaggtttgcgcgttcgcgaaaaaagacatatagaaattacttcatccgtattcaaatatatgatgttgttaactttatttagtttgttttcagaaaagaaaaagaactttattcagtcaaacttttgaaagcttgatcattaatagctctcataatatttagtttgaaaaataccgtatgtgtagatttttctttactggagcatttacaataatacagttttgttagatagttttgttgtattctaatttaaaaaaaagtactgctcagacttgaacactagagaaggaataaagtcaatagtataatatattcatatagaggtattataccgtcaaacatttgcaaatatatccttttcctttacaccctcagattgctaaaggcctaaatctatattgattttccctgctccaattttctcaaccgtttccaggaccacctcaaaacatactaggcatttcaaaatgccttctaacatcgttaagtacacacgacatttgtatctatacaaattatgcaaattaactctatctatttcattcacctgcaagaatgacaaacaagtgaaaagcagattgatatgacaacagaccgaccctacagcaactccagctgatcaacatacatcaaatttctacaaaattattcagaggtttgaagtaaaggaccggttaaatctgcacaaaatagggtggaaaaaaaaagaaaaagcaattcgagagagtttctcagtgctgtgtcgtatgagtttatatccaggattccactgtgtgattgtacatgtatgagctcatcccgctgatatgcgctagagcgtcagaatcaagcatgtcttctcccttcacgccgccctgcaaattcaagacaaaaaaaaaaggacaaaaagtcctcaaatcattgccaaatttcacttcgtaaatataatcccaagtttcaaaccgataatatcactttgttttaaagatttttttgagggcgttcttggcatttgaatgcttacaatttgttcatactcttcgtgattctgcgagccgatcgacctggatgcctcgcagtagtcgtcgttcttggcgaacctaccacggacgcgaggccggctatccgcgagggtttttctgcaagcgtactgcagattttttttttaaaaaaaaaatctgagatgtcagtaacgtggtcggcggtgaggtgaaattcgtttgaaatatgggttgggggggggggtgatattttgaatttgaatttgaataatttggaagttcttgcctcaccttgatcttcttgctgaaattcctctcgttcctcttcttgatgtacctgtggatcttttccttcctctcctcgttggagaggcggacggtcttgaagctcgtgtcctccaagctcgtcgtctccgtcgtccccgtcgccggcagccgcgctgggctactcccgcctccgcccatctgtggcaccacgaccaccatggtgaaacggtcatggcgtcatgctgcgcgtgcgcgagaggttcttgcatggcggcaatgtcctacctgcaactctgcggcggcggcgttgccgaaggccatgtcggcgccgtcggcggcgtgggtggcgccgagaagcgcgccgccgcattccatcatccgctggtactcgccgatctcgtccattcccatcatcgacatcaccatgcttccgccgccgccgccggccgcggcgaagaaggcggcctgcgccgcgtgcgcgtccttgctgaagaacgcctcgccggcggcggcggcggcagcctggtgatgtcgacgatgggactggtcgagatcggcgagtacctgcggatgatggattgcggcggcgcgcttctcggcgcctcccacgccgccgacggcgccgacatggccttcggctacgccgccgccgcagagtagcagggtggacattgccgccatgcaaga

SEQ ID NO: 3062 - DNA, 1182 bp, Oryza sativa
ccgaaggccatgtcggcgccgtcggcggcgtgggtggcgccgagaagcgcgccgccgcattccatcatccgctggtactcgccgatctcgtccattcccatcatcgacatcaccatgcttccgccgccgccgccggccgcggcgaagaaggcggcctgcgccgcgtgcgcgtccttgctgaagaacgcctccccggccgcggcggcggcggcggggagcatcgcgccggaatgctgctgctgcgggcagagcgggtcgtccaggcccatgtaccctcccgccccagctccggctccagcggccaacgccgccgcgaagacctcgtcggtgaacccggcgtactgcatcagctcggtggcggtgctgctcagctgcgcctgcagcgccgggtgctccgccgccgcgccgcccatcaccgggagaggcatctgggtgaattgctgctgctgctgatgctccggtggtggtggtggctgcgtctcgtcgacggcggagaacgcgtagtcgtcgatggggaggaggagctcgccgtcggcgccgggcggctcgtcttgctcgaggagagccgagagcgtggagtccagcgacggcagcggcggcgacagggtgtcgccgccgccggcgatgggcgcggtggccgtcgacgacgacgaggcggacgcgtcctccgaggaggccgtgaacatgtccgaccctgccgccgccgccgcgttcaccgccgcgaagaggtcgccgccgttgccgtcgtcgcagaagtcatagatgtgctgcgctatcgggctcgagatgccatcctgcaaaaacaaaaacaaaattcagacaaaaaccatcaaaccaccaactcgtaaccatttctttcttcagaaaaaaaaactgtattcttctacaggcctgtgcaatgcaaacattcatcgccaaaatcctgaattgacaaaacggtgatttacagatttgtattaggctatttaaacccatttctatgattcttttataatctctttttttgcaaggaatcaaatgccatactgttgtatttgcaaattatactgttctatctgaaatctgaaatctctgaagatgtcaagaacagtagaggtataggtccgtatgccgtatgctggggggaatgttactgttaggatcaggcaactaatcaaaaattccaatgcgcaatgtcataaa

SEQ ID NO: 3063 - DNA, 328 bp, Oryza sativa
ggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatag

SEQ ID NO: 3064 - DNA, 1201 bp, Oryza sativa
gcttctttctgatcataataatggaaagcttctttgtgacagtaatctacctgggagactgacttaaaaatgcaactgtagcagaatacaaaaccagaagcagaaagaacagaagggttattgcgcttctggcagcataaggggcacaatgtcctgtcagggggcaagggaagtccatctttagcaacctgatgaaagaagtagacgctcaaatcaaacagtagtcatataaagaactattaaaccacaaaatatatccaactgcacagtggcaaaacaaagagttctgttcaccatgttactgcaaattgagatttcagacaagggtaactgctttctgcatatattgactagcatataacatgtacctttggcagaggtggaggagggggtgggggatatacagtcggagctgacattctttcctcagcagattgataccaccattccatcatctagataagatcacgagatagagaacattaagcgaagcacgatgggggatcatgttttttcatcatattacatccattgtagggagaactgagaagattaaagataaagagagtgtgcaaggaaaaacaaatttgaccaccgagacaaacgaagaacttgggttcctagagcagaaattggagagctgaccttgaaaaagaaaactgcagcaatcaaaccagtttgtgcataatctaggctagtgtacatacagttaagtaacaccctttgcatggtctgcagggataatattaaaatattagtgttatgcgccattattaaatgactcaaacttgagcaaatccactatatgagtagtgatacaatcctttactaccttcagccatggaggaccacgaagtctctcaagttctcgatttctgattcttgataccctagaagatgattccatctaatttttcaagaaaaaacaatagaaaataaattagcaaaataaaggctaaccatctctaaatatgaaaacttaacccaatttgatatctgatatgttttcttggattttaaaaaaggacaatggtctgcatggagaaatcataatcataagaaagaaaaagggcatttgtatcaaggtaataggattagaaataggcttctgcatatttgagctaaccaatagtcaaggacacaaattagtaagtaactaagtatcaaataccagctcttgtcctgtagcacgacaaacatg

SEQ ID NO: 3065 - DNA, 1123 bp, Oryza sativa
tatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtttaacctacatctaactagggaagtgctttgtatttgaggatgtgcggactctggggttctgaattcatgggt

SEQ ID NO: 3066 - DNA, 4129 bp, Oryza sativa
  unsure (1)..(4129): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcgagtccagttagggcagcgttggtccaccaaggttgatagtaagatgaaggtgcaaaaaagtaaggcgaacaaacacactgcaaggtgttttgataagcagaaaaagacatacgagttcacagagaggggtggtataacgcgtggtggtgttagattcggcgcaagagccttcaaagttgaaggtgaggggaacttatgttcttgccaaaggccattgctctaccatatgccttgctcacatcttatacacgtttatctgattcatgcaattgatgaggaatctcccaacagaatgccgtatcagttctcttcaatagccgttgtgaacacatgggcaagtcgctttgagccatacctcgaccccacatagtggccaccgtacgatggtgaagaatttgttgctgacccaaatttgaagattaaaacaagagggaagaggagatcgaaacgattcaagaacgaaatggactcgggtctgggtggttctggaaggaaaccatcttcatgcgttcaacttgatgctgcgccggtgcaaaatagatgctcgttgtgtcaccaggagggtcacaagaaaactaagtgtcctaagcgtccaaaaaagaagaagtccaaaaaaaaatataagtgtcagggaggtaaatattttgttttcctactcatgttctcgcattcattttcttttaatatatgtcacattggtaactaacggtgaatttattactttttcatgtaggatggccgaggagggacaaccgccgacttacccagccttggaggcgtactacgaggcccgtcatcgcggggctgcgatcgaggcggggagggtatgaatcggcattgattcacttgtgcataagtatcggtagcgtgtatttgacattatattaactaattgatttacaattgctaatgtaggtacttcaaccgctccgagtcagagctcatgcccctcccagtgttcgacgataggtacatcccgtacctaaaggctgccgggttactcggggtggccttggtcgtgagcagaggaatgccagtgttcaacgctcctgcgttgacagcacttgtggacagatggaggcctgagacacacagcttccacctccccagtggtgagatgaccatcactctacaggatgtggctatgatcttggccctcccattacgggggcatgccgtgacgggcaggacagagactcctggatggcatgcacaagtgcagcagctgtttggcattccactgaatattgagcaggggcaaggggggaagaagaagcagaatggaatacccctgtcttggctgagtcagaacttctcacatcttgacgacgatgctgagccatggcgtgttgagtgttatgcccgtgcatacatcttgcacttgttgggaggggttctgtttcctgatgctgggggtgacattgcttcggcgatatggattcctttggtcaccaaccttggtgatctgggccgtttcagttggggctcagcagtgttggcgtggacatatagacagctctgtgaggcctgttgtcgtcaggcaccatcatccaacatgagtggttgtgtgctattgattcagatgtggatgtggttaagactaccgattggaaggcctaagtggaggcaaagcttcactccttggccctacaatgagccagacatggagaagacagtggcctacctttttgagagtactgccactgcacatgctcaccgggatgtggcatacaagcattatgtcaatgagatggactgcttacagcctcaacatgtaagtacttccaatatcacttctagttagacatttacttctttaattgagatactaaccaacgacatctcttcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcgggaagaaacaagattggccggttgaggacatctcaactggagttgaattacacaagtaaatatttcttatctttgtttgctttcattatcaatgttcaattttgtaccatttaacccttgtcgatgctcactattgtttcatcaccttctacttgtctaggtatgacagggtgagaacaaagaaggtgaaagactgggggctagagcataatagatacattgatgaatggaggacagccggaaggaacgacaggtacatcgagactatacaccaaaatcatcttttctcagagtaccttcgttggctgcataggacatatagactgttcctccgccctacttggacggaagccgacatagaggatgaccgcgactctgatgaggggcggaatccctatgatgtccggactagagttggatatcaaatggagcacgccccacttagagacagagtcgtaagttttcttgcatttgtcaaagttatttccatttgcaccctagaccctaacatatatcttctcacgctttcagtcgagagagctcctcaggagtgtgaatgaaatggggcatgccctccaagctccgaggggtggtgaggacacggagaacacactccgcaatgttttagaggtaaaatttatttagcactttgcattacttgagttatgcctaacaaacttctttttttttttgaaatgcagaaagttcgtcaaaggtgccggaaacttgcagcaagattaggttgcaggtcggttggattggacgacgtgtaccaactggggagattacgaccaccactacctcaatccgcgcgtccaagtatcgctcgacactccatcaggatagaagagcgtgaaggagttggtggctcgtcgtcgtcacgcattaagcaagagaggggaaaggggaaggcgccggctccacctagcgacgacgatgacgacgaagacgaggaggatgaggactacgtcgtaccagacgccgaggagatagacatgtcacagcttcccgacgcgcctcaggggacgcaacccacgcaatacaacttgcgatccactcgggcagcgaaaaagaggtaaaatgagcttaccattctcaaatgttatttgatttcccttattttgtttttaaaatgttttaaacattggattttcaaatataggtacactccgggctcgcaagcaattcggcgccaacggaagaagtaatttgtatgaagttaatctattggttggtagtatgacatatgtggtgcactatgtgatataaaatgtgatggactatgtgaggactatgtgatggacttttgacattgtttcatgtgtggaatataggatggacttttggcattgtttgatgtgtgggatatgtgatggactttttgcattgtttgatgtgtggaatatgtgatggactatgagaggactatgtgatggacttttggcattgtgatttgtgcaattggaacctgttttagtctgtacgaatctgtgaattgtgatttgaattgcgaactgtgaattggtacatttgtgcaatatggatcttcaatttgcagggaggcagagggcggcgccaaccaccctggcgccgcggttggggagggcggcaccagccagtgccgcgaggcagaagggtttcgggctgggggagggcggcgccagctaccctggcgccgtggtccatgagggcggcgccagccgaggcccggaggcagaagggcttcgatggggggaggaggggagcgccagccaccctggcgccgcggtcggggaggggcgccagccgttgcccggaggcagaataaggcgaaaatttttaggggggagaaagttggt

SEQ ID NO: 3067 - DNA, 7206 bp, Oryza sativa
aatcgagtagtaggcattgcaacggagatcgggtactatgcgtactgtactgctccttcgtgttcatgactttgcaagtactgtactactcctgcggctgctgatcttaaataacggcgaagatgaagaaatgaagtactactactatgagtaggagtatatatgaaccgaaacttctttgctgtcctgtcctgtggcttgtcgattgtgcctgcctatttattggcgtgttcctcatggcctcccgggtaggtgcatgcatcgcgaattcgcgactaattatcatcacctccaagatttgcaatggaacgacgtgaggagtgaggagaaagaatatgaaagatcctttgggtagcttgaggtcagggatttgcaacgcaacgtgatgactgatgagtgaggatatctcatgcttgcaaatctgcacagccaagccaaggccccgtttggtttcttccctgaaataaaacacacagacggttatgcctcgctgtcatgtccaaacagaaacttctcgcaatctcgctcgtgagggaaatcaggaaaatctgttctccggatagttcacctaaagtgacagattttttcttaactgctgagacattagttattgcattcggcggtttcctgacgttcacgttcatgttcatccaagaattgcagtttggttgaatgggacagcacaggccactgaaaccagagcgccagacaccagtgcatgggcaagagaagtttaaggtggtgtttagatccatggattgaattcctcgtcacatcagatgtttagatactaattagaaatattaaacatagactaataataaaactaattgcataaatgagagctaattcgtgagataaatttttgaagcctaattaatccataattagcacatgtttactgtagcatcatatagattaatcatggattaatcagactcaatagattcgtctcgcgaattagttcagtgttatgaaatgggttttgtcattagtttacatttataattctaatttgtatcaaacatcctatatgacaggtagtataattttagcccgtgatccaagcaagaaactgggagggtcagacagttaaagaggcgatgagatggcaggtggccgctgttcccggtgtcagcaccaaccgatcgagccggttggtgatgcgacgggagtgaggtgagtgacagagtgatactacagtgtaccggtacagtggagtagcgttcgcgatcgagggatgtggacttggaacggtgatggatcgtgtcgttgttggctcatcaattcctcacagtcaccggctgcgtggccggggcgccggccggggctagccgctagcagaatcggcacaaggatggctgtctgcgtggtggcgccgcgtgcggctgctcgctccgcctccacgtcttcgtcggtcgcgggcttgcggttccggggtcaaacagggggtgtcggatggatggcgagccgagagcctgagatgccgcggaggttgctgtttgtggatgcggtgggcgctgtggcgactggcgcgccatgccggcatgccgcgcgacggcgacggctcgggctctcgcgggcgcgacgcgcacacagcacggcgaggaagaggggaaacgggccgcggtttttggggtggttgatacggtttgggacgatccgggaaggagaagcccatctggccactggccttattagcccagggggcaaggtgcaaagtagggaataattttatttttaattttactagaaaaaaatgtatgtgcgttgcaacgggtgaaaattattttaatcttcttattgttatgcggtttagttaatgtggaattcactatgagaattagcttggatacatatttttctacaaaatcatgatacagttaggagtccgatcatctcaagttagcatgcgagttttcttaaaatgatttcttatacgactccttctgtgtttccagaagcgaagaaatttaaaacccgactcaaatatagatctgtatttccaaaaacaaacgaatttaaaaaccgactcatacacggatgatgtaccaaagtaccgacaaaaacatcttcaatctattatattattaatgaaaggaatagaaaaaggagcctccacgttcgctctcatggcctagaaattctcacattaactggagaaaaagaaaaggcagagtccatatagaaatacaatttagaaatagctgaaattcggaatttaaaaataaagaatattagaagaggagactagagtccatatagaaatacaatttagaaatagttgaaattcggaattaaaaaatacgaaatattagaagaggagactagagtccatatagaaatacaattaggaaataactgaaattcaaaattaaaaataaggaatattagaaatagagtatagagttgtcacaccccaatccggcatcgctgtacaacggcacctgacaggagcgtgtcgtagtaataacggcgcgaaccgcttcctacgaaaccgcgatctcagtaccagtcccaggacatagtgctggtacccacggtgacaaatatgaatcattgcaaatccttaaaataaatagaggacttatttaccttaacttaggttgcagctcagaacagcctgagaaatgcaaccgacgacgctgacggggaaacaccaacaacagcagcagcggcggaaccaacggactaacacccaacaccacaggcgacggttggggaccaggacgaaaccctaatcttcacttcacttcatcttcacttcaaggcagaggaactacatatatatttatatagagtaagggtgattactttcgtactcagcaagtcacgagaatttaggtgtttaatgcaagcttggaagagaggcaaggttgttttgcaaatcctttatttgaaacacttttgaaattactaagtgatttatttctttttaagtttgggtcgaaaagagacttgcgtctcaaatcgacttaagagatgcttttcaacaactcaaatggtaatgtaccgacctcccgggtcagatcattacttatcggctcccagagccatttcacttgattaggcggctcccagagcctttttcattttctcggactcccagagtccagctgcccggcagcacaacaatccgctttcactcgggaagcctagtctttgatgcccgtagacatcccgaatcacacagatttgtttctgaccactcaggtcatccatctgccacataggctgattctggttacgattcccacaccacaacaacttttaacaaagcacaggcaatcaaatctacgcaacaggaaccacctcacatccgcccatgaccgtgggcacggctgttcgaacagttaattaatctctacagagaggtacactttacccacaagacacgaacttactccagacactggccggtgtcagaggttcgcgacaaagcctttcccaagccgactcagggttacctcatgccacatagaaggatcaaatcctcacttaaatataggccattttaggcattcacaaatcaactccaaccaccttgatcggtaagtgagcaagcttctcgtccttgccttaccaggaacccggtttgtccaaccccgccccggcgttcccaactattggcatgcgaggttttcctgaaccaactagttacttagccagggtgtcccattctaccttgtggttgcactttgattatgttcgatgagtttcccacaggaatcggtccttatatgcgaatacgggatagtgccacataggcacaacccccgcatcgcgagttttcacaatttattttattttcaaacacaccgacaccacatgtcgggttttcaaggcttcacaaacccatttcccaagttttcgacaatcaacggtgtatgtgggatatttggtacacgcgctcagagagcacatatacctaagtacaacaagggtggagcgacaaggaatcagggtagtacagcctacaggaattagtgcgactactgggtaggtccgtcggtttggcacgcaaaccgaggccaagcaaattaagtgtgtgaccctaataatgcaagttgcaaacaaaataataatgattttccaattataggagcaattgatcaaagggtgacttgccttgctcaaggtcttcacgaagcttcacgaatcttcgagaaaaccacgatcggtgaaaaatccggtaaccgcaactatacgcaaacaatcgaaaacctagacaaaagaccaaaagaaagatcctaattagactaattaatagtgccattagatagatctcaattttatggaattactggaagttgaacggagtcaaacggatgagcggttgagaagatatggattttctaaagattaaggaatttctgtctaaaggaaaaaggatttaataatttattaaaccctttttttggaaagaaattgaaggagggaggaatatcagacttcctcagggtggctagggtgcggcccgaggggatttgcgtggctcagccgagcttattgggccggcgcgggctacggggaggcggcccaggagaggggtgcggggagagagaggggggagccgggtggaccgggctcacctcgcggggtcccgagcgggcccgcttgtcggtgaggcggtgcacggtggaagcggcgcacgcggggccgggcgctagggtttcgggtgcgcatggttcgggcgcggcgtgccgggtggacggatggcggcgggcccacgtgcagctgcacggcttgtcgtggaccgcgcgcacgggagggaagacggagggagggtgcggctgaccggattggcccggtcaaagccgaggtggcgccgacgtggcgcctacgtggcagccacgcgggccggcgggaggaggaagaaggggaggccgagatggacggcggacgacggcagtttcaccgggacaccatgcgacggcgagggcgacggggagcacatcagaacgacaaggaggacaagaaagagtgagccaacggctcagattcgccagagggcggccagcggcggcgaatcgcggcggcggcaaccggcagcgagcaaagggggaaacgacgacgagacgacgagggttcgattcgtcggagatggagcatctctaggactcagggaactcgttcccggggttggatggggcagagcggcgccgtggaagtccggcgatgagaggcggcctccgggagcgggtgctgacggtggcaagctcacagcgagtagcgccgacgcttgggcggtgtctaggcacattcgggaaggtccaggctagtgaccgcgcaagctaagagggagaggaagagcggggagggtgaacgggggctaccgcgtcgggagatcgccgggaagagggtccgacagcacgggtgggatcgcctccgcctcgggccggggaagaggaaggagagggcacccggagtcctcttcggctccgcgcgcacgccggcttcccggcacgcgcaacggcggggaaggtgacgacgacgagcggcagagatggtgcagcggcaatggcgcggtggaggttcggcaaggaaacgaggaggaaagggcgggcctcgagttgggttttataggtgcgggaagtcggttttgggggaggaaaccgacttaggtggtcaagggagctcggctggcggtcgtgctcggagctagcggccaagcagcggcagtggaggtgcggtggctgaggttgggaaaaagagaaaaagaagggggaaagggaagcttgaccatgccgttttggggagggagagaagggggagggcgagctctggctccgtgttttggaagcacgcgcacagggagtgggggcgggttgcagcgcgcgacgcaggcggcagcgcgggcacgggcggcgaccgggcggtcggccaccgcgtaggagcgcgcgcggagcaaaatcgaatagcggcggcaggagagttcaaaccgcggcggcgggaaccggcgggcggtgacgaaaatcgaaaggcggcgacgggagaccgacgccgggagagaagggagagagagagaactgagagagagagagagagcgaagagagagagagggggagggggagagcggcgctctctctcggctcggtgggggcacgtgcaactcacgtggagagggaggagttaggcagaggggagatgggccgaggggaggggatccagcccatccaaaattatgaggacgcaaaatagacttttatagagaagacagatttggagagaattcgagttgggggtttggatttggatttcgaatttgatgcttggtcttagggaaacaaggtggagtcaaggaaggaactcaaatgggaatcaggaacaggtatttcgcaaggatttcaagagaggatttgaatttcgggatttgatttggagtcttgaattggaagaggaaatttgaggtggaggattttgatttcaatgagagggaacaacgggatttgaattgagatccacggcacgacttagactcagcacacaaagaatgaattttcgcaattaggattttgccgaattagtttttaacgtctcacgaaaagcggagcgttacaagagtccatatagaaacacaattaggaaataatagaaatttagaattaaaaaataaggaaggttagaagtagagtatagagtgcatataggaatttaaaactaactaaaatttggaataaacataataaaattaaaagtagagtttagagtccgtataaaaatacaatttacaaataactaaaattcgaaattaagaaaaacatgggaagttgagtttaaagtcaatataggaatgcaatttagaagtaactgaaattcgaaattaaaaattaaagaatattgaaagatgagtttagagtccacatagaaatacaattagaaataataaaaattaagaataaaaataaataatattggaagaagagcatagagtctatatagaaatacaatttacaaaaaattcggaattaaaaaaaagaaatattaaaagacaagtctagagtccatataggaatatatatatttataaacactttgatattaaaaataattaataactaacacgtatataaaatacaatatgaatattacacattagtagttttgtaaagttattgtaaaatttaaaattatgttgtcattttaatatatttgaataatataatgagaaaacatatatgttattatatgagagaaaatataat

SEQ ID NO: 3068 - DNA, 15642 bp, Oryza sativa
cggatgtcggaaggggttttcgaacatgaatgaaaaaactaatttcataactcgcctggaaaccgcgagacgaatcttttgaacctaattaattcttcattagcacatacgggttactttagcacttatggctaatcatggcctaattaggctcaaaagattcgtctcgagatttaaatgcaaactgtgcaattagtttttcttttatctatatttaatgatttatatatgtgtccaaagatttgatgtgatgttttttgaaaaagtttctggggaactaaacatggtctaaatgtcatgaaaaatgacctcccaaatggtgttagaggtgtggatatgtaatactttgaaaaaattacaaacataattaattttttctataaaattaaaaaaatgaaaaaaatctaaagtaggagaaggcgagcagtacattataataaaaaacacagaaatactacgaaacaatatactattataatgaaatatctaacatcaatatgatacagattctgatgtcaacggtacaatgctaacatcagcatgatacttagtaataaattaagtacatacatgtatcatgttaagatatgatacttacgtgtgatgacatcagcatgatatggtatcgaaagtaccagatcggtatatatttgctattccgttacatattctgttcggtagtcttccttaaaaaaaaagaggtcatttatttcggagtttttattgattgctagtagtagtttcgtttgcaatagaaaaggatcagattagaatcaacgaagaaaaaggcaaagttagaatagtaactatacagcagcataacgtatatacagatacatattgctacgcagataccgtacgcgagcagacacggacgagacgagcgcccaaagccctcgctggcaagaggtgaagaggggggagaaagacgcgtcaaagccatcaaccagatcgattgatccatccatccatcaatcgatcgatcgagcgatccaaccgaggtacgcgagcaaccatccccgcttccccttttcctcctccgattcgagatccatggcggggcctctgccgtgcggcacctcaaaccctctccggtcgtactctttgtctgcagccggcgagcagatctgaaggcgcggccggccgacctccttccgcctacctcaagtcttgtctcgactcgaattgaaggtcttgcgattacttccctcgcgtagattgcaaattcatcagggctttgattgattggtctccgtccaatcaaaccgtcgagtttgttgtgaatttatttgatgcgtggtgtagtgctaatagcagcttgtgtttcaaaaaagaaaaaaaatcgttaggtctatccgctgtttattaggttttgttgtgggtgtagagcacagtattgctcgcagatacttttaaatgagtagagacactggaaggcgaaatctttgctagcatattattgaccttcgtaaaccataattaaccaatgctcttttatatctcagaagggacaataccgtgaagtatctgggctgttgcttcgtattttcgtggattcaccttggaacttcagaacgaatcttcctgatattttccgtgacaatgaaaacacatgagagagctgccaatttggctcttgcaggtacatttacatgctcaattcagccatcgtggtgttggcggtgttcataaccatttttgttttcctttggacaaactgaatatttgctgagctgcagttttatgcatcttacattgtatgcaggtttgagcttggctccacttgtggttaaagtaaaccccaatgcgaatgttatactgacagcatgccttgccgtctatgtgggctgttaccgttctgttaagccaactccacccgctgtaagcaatatgcttgaacttgttttatccatctgctgggcactaatgtgataggttattcatccaacttcctacatgtacctctggctctgaataacttaatttttgcctttttcttatataggagacaatgtccaaagaacatgctatgcggtttcctttggtgggaagtgctatgcttttgtccctcttccttctattcaagtttctctcaaaagatttggtcaatactgttctcactgcctactttttcattcttggcatcgctgctctctggtaagttcaaatcctattattagaagagtttttccacacatgtaacttcttaatactgtttttgtgaaattaagaatgtttatgtttttctcttgcagtgcaacattgctgccttccataaaacgatttcttccaaaagaatggaacgataatgccattgtttggcgtgctccacttttccactgtatgactcacacctcattattgccatcatgtatcatgtcagatcaatacatctatgtaatcctatctattagtagtctactatatgagggaactatttggttgcatctctagtattgccaatttgccatacatcaaaacaatgttgtggcgacataatccatatacttattgtgtgtcatagctagaaaggatttggttttatttttgggaacatggtgtctttttccagtagaccaattcatcctagagcagaactttaaactgtctgtactgtattacaaaatcataaatacatgatatcgcttaatacaagcaagtaacacaacttattcaaaagacgttaagagtaaagttaagtatttaaattgttcctaaacaatttagtggcatctaaatatgctttcattaacagcatgttgtatggatatggtatccagttttcctgagtgaaccatataggtgctgttagtatgtcagttccttttgttaggaaattattgaaatggcaaaaaaggatcctcctttcaataacattgaaattgtatcatgcaagtcacttctttgtttactggtcttttaagttcattcacttcttatttcagcgctctcggtggagtttaccagatctcaagtcgttgcatcgatcccaggatttttcttttgcatatggtatgctgcgaagaagcattggctagcaaacaacgttctggggatttctttctgcattcaggtttgatcttattgctatttttgagatataatgttaatatgcatgagtaaattaattacggtatgaaagtttcgtagatatgttttttttcccaccaacttgtagagaaacctgaatccctgattctctttgccatccagggaatcgagatgctatcacttggatcattcaaaactggtgctattctcttggtatggattgtttgtattgaactgaaacttatattttctggtggtacttgtcaaagcaccttttattatttcagccatcaaatcattactagttgagcatggcaatgataatttgaattttctgatatgctataatttatggttgcctttcttttgcttgcgaaattaaagtccatatttgtatacaccaccgtattgtgtaaagcatttttaatttgtaacttttgtgtatcgtggtattcccttttaattcagagcggactctttttctatgatattttctgggtcttcttcactccagttatggtcagtgttgccaagtcatttgatgctccaataaaggtaagtattccttgatttcactcttgttgcaatagccattcatttctatacctaatcaaaaaatacgtaaggtttccagtagttattttcgtctgtttcttttttttcgccgctttttcctttttttgtgccgtccagttgcaagaaaggctaaggatgagccatcgggcccataacaataccggcccaagggaccccttacagaaaccctagaaccacctgattttcatcacaaagacccctactgtcttcgcccttcgttgctccccctctcccagatccgaccgcctccgcctccggcccgccaccactcgccctgaatatctggcttctcaatccgcggaaactactccctgttgttcgtcgacctctttgtcgccggagacctctaggttttctccctctctatgttactgtatgtttgtatggtcgtctcaaactctttggatgtttctttatgtgctcggtggctaattagccaatcacacactgcagccgccatggcagcaaccttaaccctgtgtgaatggtcagtaagctcacctacattgatccgctttgttgcgtcgattggaggaacggctcttcttgtacgtgcttccttcattgatgcatcaacgcacgctgctatatgacctagctctaagtttaatccatcccgtgtgaattcgttttctaggttgcaaatatactgttttagaaatactagttttctaaaaaaaggttaatctagttctactcatttttttttgcacagcttctatttcctacaggtgatgctgcacgcccgttctctatgcttggccttggtgacattgtaatacctggttagtaataaaatctttagattatttatttcaacttttatttggcctgtgatttctggttgaatagggtcattcaggctgtcagctgcattagattgagaacttgtttgaatttatgatctatagcaagctgttagttcaactgggttgtttgttaaaaatagtaacccgattcaaaactgtatctgtttgctacatcatttgagttcctatttttttctcctgtggctctaaaggtgcgtaggcatgtagcagagaatcaaatcaactatatcataaaataatgtagatataattttagttccatttgctggtaataggagtacagttgtgtgtattgccagaaaataattgtaaattcagcatttcagctgctttgagttgcttgtaaaaatgtactccgagtctgaattctggctctgttatccagatgaagccaacaaggttggctatttgtcttcaaactacttagttttataatgaggatatatgttggtttttggctatgatattactttctatacttgaatctaaataaaatgaatagcagaatcatttgcactaccctggttcgttaatttttttttccagggattagtttagttggttggttagggtatgcatgtggatgccttctactgaataatgcattaaactccttgttgtctttattagcactaaagctcgaagaatttgttgttgctagttgctacttgccactgatcgtttgtctttccttagcagtcttcacaccattcaatagtgtaaatcatgaaattgacacatattctgcaaggtgcaactcttgtattgacacataatatgctcttctacttttggttccaggtatatttgtggcacttgcgctgcgttttgatgtctcaagaggaattaagaaccgctattttaatagtgcatttttgggttataccgtgggtctgactgtgacaataatagtgatgaactggttccaagctgcacaggtgagttctgttactaaggattctcgccatcgtgttgcctctttttttcccaagggaaacagtgagggagagcctactgtatacagattattttaaacaaaatgaactgttatacatacataaataaaaggggaaaaagaaggtaattatgttggtgcatctgccacctctacaccaccagaccacctccaccctgtataaacttgtagtagtacaaaggaagctataaaccttgtaaaaggaaaaacaaggaaataaaattacatcaagatccaaccgggactccagttataacaggaaaagaaagttgcctctgatttctgtcatctctgaaatattaatgcccctcttctttcattgtctttattttctcatcatatgcagcctgctctgttgtacattgttcctggtgtgattggttttgttgctgttcactgtttgtggaatggtgaagtaaagccggtaagtttgttaactctgaccatggtatttcccaacctgtccattgtcctgaaacttgagagtacgctgcgtaatttattctgttgaaggggcccctttttttgttacattactaaaaactcaaagttaatagccttcgttcatgatgcttaattgctactgcaaagacgtgggagttttatgtacaataggatggttgatataatttgttggaagagtcgctgtatttattttgatgttagtgttagaatggtgttgctatggttaagttattatgtaccacacgctgttaaatatttgattttctaagctgtgagcaatgcccgtaccatttatgcatgaaatggctttgtacgcatcgttagagattatgcgattccggtgctgaaaggctgagaacatgatgaagttttgaacatggatgatattctttgttgctaacatcaaattatttttttagctaaaaatgactagattattttccttctatcttttgatcactagataaaaatcacttggtttgctggttcgcagtggagtgaacagccaggcatgggctcaatccttatcactgaaatctgtgcgtcagtggggaacttttttcctactccctgggattgcctctatgggttaatcctgggacatttaacttcttgccacttttaagatgtggcaattaattatttgccattcactgtctatgacatgtgggtccagtggcaaataatttagcaccacttgtaagagtggcaaatagttaattattccgttaatcctagctaggacttgatacaccagtagggctcgcctcccacgtataatatatgtatctagtgtgtatgtgaaagctgatgcttgctggcgtgggagtgggagtggccgggtagtttagtttctgttatgcgtatccttagttttacctttattgttttcgtattttattatgattatacttgctgacattttattacattgccagctccttgagtacaacgagtccaaagcggaagaggaggaagcttgtgaagaagatacagatagcaagcaaaacaaaaagaaagagtagggctctaacaagtaacaatcataccttgaggactagaatattcagaaactttatgtaaggtcttcggcatctaagtaggctggatgacctttgggatacaagctcacttagaacttagaaatgattcacatgatagaatctttctggttttgagaattgtttggtctggtgagtagatgaggaatgcatcctaagtggtttagcaatactataaccggtacctcttgtttacacttatttatcctggtggttggaaggatctttcctgaattttggtatggtgaatagcgctctgtgatatctttcttggcacactgtcgtgtctgaaacgagggatctcgcagaaattcatgtgtgctgcactcttttcttgcaaaatacttgtgccattggatttttacatcctccagtgtttcacattttgaccgaattttgatttgggagtatctaaaaaaactgccgcaagtttttttagtcaaaaactattagatgcaactatagtataattagagtgtaattacattgtaacggtattataactacaccgtaactagaaatcttaagtgtaacatgtgcgaaaaattctttctagcaatttttttttcctttcatgcataaatgttgaggcgattcgatggttattaatctgatgaaagttttgagcgcaaaaaaacttgcggaagttttatagcaaatctgattttgattactattttctgagtaaattacgtaacaacttcctgagaggctgagaatcatgtattacgttgcggtgggaataagtccatttaacctccctcatgtcttgtgcttgcgtgaataacatcactcaaccggaaaaccaggtataacgcctcctcctctaaaaaccagagcaaatcacctccctcggtggtttcggaggcggttttgtcctacgtggcacttacgtgttggttgactttctatgtggcatcgacgtagcgcttatatggctctaaaataaaacaaacctaaatagaacccacatgtcagtgagtaaaaaaaataataaatgaactcggcgacagcaggacggcgggagcgacgggacaacgggacagtggtaggaacgccggcgggatcacaaagtggcgggagctcgacgggagcgatagaacagcgggagcggcgaggcggcgggagctcagcgggagcggcggggcagcgggagaggtggggcagcgggagctcggtggtagcggcaggacggcgggagtggcgagacggcaggatctcggcaaagcggcgggagctcggcgggagcggcaggacagtcgtgacggctgctgctgctcggcagcgacgttgccgacaactttgccggcatggaaggaggagctcgttagccggccatgacgcgcatggggaggagatcgtcagccggctgcgcgcgggtcctgtggtgacgccgccccttcccctttcttcaacaagcccgggcgccgtcgcccgacaatggccactatcgctgccccgccgtctcccaccacggctcccgttgccgccgctgatgtcgagacaccggtgcctactagatcctctcatcgccccgccggccactaccacggcctctcgcggcggagaccgccgctgagctgccggatttgcgcagccgccgttgtcttgccgatccgggaggtggagtcagaggcggcgatggcgatgcccaggttgagctccgccgatttcgacaaggggagcaaggtctccgtctcctccctttggaccgacggcgacgagaggagccagctcgtcggcggcgacggcagtggtggtgattcgatgacccatcccggcgaaccgcttcccctgcgcttgccgtggcaggcgaacccttcccgcgcgggcgccgtggccggcgaacccctccctcgcggcgcgcgcctacatcctccggcggtccctatccctcccgcgcgctccggcacctcccctgaccgtgctctgtccacggagagaggggagaggagagtggagagtggtggaggaagagtggaaatggcacttacatgtgggccctcacataatttttcaattttttcgatgactaggctgccacgtcagcaaaaccactgtcaaaaaccagggagttgttttgtactggttttaacacttggggaggtaatatacccgtttttctggttgagggatgttattcacgcagcgcaagagatgagggaggtgaaatggacttatttacgctgcggtggcgcgttatgccccgcgatcgtgcaggctcacatggccgcggttgaacgggaggcagcccatctggcccgttactggcttatcttgggcctttgggggtggatcgcttgcgccggccttcggatgcacaacctgtgctgtgggctgggctctcatcgtgcgttcgcgcccttcgttgccgccggcggcggccggtgttgcaagggcggtgcgggtgaagaaggtggaggtggaggcgaggcgcggcgaagaatcccccccaaggcgccgtcctccgacgcctccctctcagacggcggcgggagcgagggctcggactccggcgccgctccgatcgagtccccctcaaagcgccctcgtcgcaggtgtaggtattttcccccctaccgccgccgtcgaaagggttcgagatggaggggatccctgatcataccaaacggattcgatgtagggaatggagccgaaccaaaattaggggttgcttcccgttccgctgcccaattcgcgagttcgaatggtgatatgggtaataaaatccaagcgaggaagccaagccgcaggtggatgcgaaacccgggttgatgaagacggcgaacgcgggaggtgaacaagcctttttgttaacctatggttgttactgatgatattgatgatcctttttgttaacctatgcttcccaactttttttttgtgttctccaggttggttgaacatgggcattccggttgctcacctgatgaatggcaatttcgttacgataatctcagcaggtattacttactcctatatgattgattataacattgctacaagtaaggaactatactggtagttcagagaaaaactttcgaatccctccaaaattgaaaataaagatttgcgaaccggcattgtcttacatatttcattcatttacgtcttcgcattctgagaagctgaaagcagattttgacgactgctggattgacaaatgacaatgaccattacttgtcagagcagattcccaccttttcatattcccctctttgcagtttgcacacttcagtagtactactacatgttcttgttgtacttctacgattgatatagctacagagcagttcttcgaaacctgcagccttcaccaagtagaattgtagaaataggttcagaattcttcagaaaagaattataaccatctaatgtgatagtagtaatatttttatttgtcccattgttttcagtaccacacaagaaacaatgtgctactgctatttttctttatctcattgttttcagcatcacacaagaaacaatggaagggtgtgatcaggattgcggttgggagatttttttttttccgagcaaagagtttgcagcagttggcctttgcatcgaaggagttggatccagaaaatccaaggtagatatgcgtttgtattagattcagttgaagaaccttgcagtttttgcctgatggccggattgcagctttctatgtacctcttgttgatgttgacaagattcctgcaggagtagtatcttgtgttgtcggattccctttttttttctttttgaacgaagttctattgatagagtaggaaaaaattacaagattacaactctggagggtcataaccaggaaaaagaaaaaaaaaccccacgagacggtgcgaagttctattgatagagcaggaaaaaattataagattacaaccctggaaggtcataaccaggaaaaagaaaaaaaaaccccacccacacaccgacagtgctaacacacacacccgggagaaggctagcaccggaccggccgccgctaagcgtgaccgaccgccgctagaccaacaaaggaacatagacgagatcggcccctagaggatgccaaaatgacgtcttcaggaagagaagcgacggaagaaccgccgttgccatccgtcagggctcaaaggagtcaagactgggctttcgcccggcaaccgcccttgaggggtgagacagcacgacaacgccctcaggagggggaatgacatcgttgtcggtccggctacagccgagctgggttttcacccgccgctcaccacctgcgaatccacggctgacgcaccgatgctccaccactactcaagctctgccgacatgtgggacccctgcatcggcgtccccgccggtcagccttcgtgcgctgaagaccgcaccacacccaccggcagctcctcctcacaccgaggtcgcctcctccaccgccggccgcgcctctcgcgccaagccggcctcctccaccggatgcacctctcgcgccaatccggcctccctccatcggccgcgcctctcgcgccaagctggccaccgtcgccgccggcagtgcctctcgcgccgtaccggcctcctccaccggacgcgcatctcgcaccaatccggcctcctgtcatcggctgcgcctctctgcaccaagccgacttccgacccttctccgatcgctgtgcgccgtccaggtgcgcctgtcttccaccccccggctagccgttgaagaccgccatgcctcccaccgtcacgcctccacttgctgccgctgtcgatcgtctgtacgacgccgccagccgttgtcgcatccgccaacgtccccggccgccacacgtcgcctccacagccgcggcagctgcaagccagccgccgtctaccgccgccgccgtctccagccgtcgtagccagccgctgtcgccacaagccgccgcctcgtcgccaaccgccaccagcagttcaacggaggggatccggtctcccgccgcagtaggccgacaccgcgttgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaataaacacaggcgcgacttgggaactaggccgaaaccctaaaactcatcgtagccggcttgctcctggaagaactcctcatcagcaggatccgcttcatcttcttcagcaactgggggggattatttatatagggcaagggtgagtacgggagtactcagcaagccatgggaagtaagtgtttaatgcaggcttcaaggaaaggctgatgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggcctagctgatcccattagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccataccatactgtgccaggaagcccaggggtcctccccgacaccaccccagcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttgaaaattcatttagttcgcaagcaccgacccaggtgtcgggttttccaagtcttttgtaaaactccagttttacccaagttgttactcggattttaagtttgaaggcgaccgtcgatactggcacagggtgcacgaatatcgaggcgcaactggatggttacaaggggacatggtatagcaattaacaatggaaggatcaaatgtaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcaccgcgggtcttcgggctccgatactacacgcgaaacgggacaactcaacaaacggcgaaaataaagccctattaatgacctctaagcatgccattagaaagatctcgagatttgaggaattttggaagttgaacggagtcaaacggatttacggttggaaagatattgaatttctaaggttatttgatttttggtctaaaggaaaaaggattaaattaaatcctttttgaaaaagaaaagaaagagggaggagaagtagacttccctcgggcggctagggcgtggcccgagagaagaagcgcggctcggccgagctaatgggccggccggcccaagaggacccggcccagagcgcgcgcgggaggggaggagagagggggccggtggaccgggctcaccacgcgcggtcccgggtgggacccgcttgtcagtggctcggctcaccgtgcggagggagcatgcggcgtacgcgcgcgggcgagggagggacgcggtgcacgcgcgcggctcgcggtggatgcggatgcggcgggcccacgagcagcctcacggctcgcggtggaacgcgcgcacggggagggactgaccggggtcggctcgacccagtctaggctgagctggcgccgacgtggcgcctacgtggctgccacgcgggccggcgggaggtagacgacgacccggccgcgaatggacggcgggtggtggcggcgagcggcggagcgaaccacggcgatacgggcaaaagcgagcacaccgggcggctgttcgtgatgaggggagacgagccaacggctcggattcgccagagggagttcgacggcggcgaatcgcggcggcgacaaccggcggggagggaagagggaaacgccgacgaggtcacgagggaccgattcccgacggtgagagcatctacgcggtttcgggaactcgatgctagcgtcggattggacggagctacgccgagcgaggctagcgacgtgtgggtgctacggagctcgagcggcgacggcggcgagagcacggcgagcgacggcaacggtcggggcggcgccggctatctacggggagtctactcgagctactaccaaaagctagggggaggagatggagcgaggaggaagaacggagggaggcatcaccgagatgaggaggggcgctgtgacgagaggccgacggcgcgggagtaatctctccagcctcgggccgaggaagaggaagaagagggcgcggccgaagtccccttccgcgtcctcgaacgcaccggctcttccggcgctcggcgaaggacggcggagacgagacagagcacgggggcggcagctatggcgaggaggcgaaaacgagggagattggaggggaaggagctggggtttaaatgggcggcaatgtcggtttggggaccgacttgcgcggtcaagggcgcgagctggcgctcggcggtcgcggccaaagcggcgacagggaggatgacgccggcgagggggggaaaaggggaaaaggagggggagaaagggggcttgcccctttgccgattcgggaaaaaggaggaggggagcggggcgacgcggcagagagaggaggggcgcggcctccgtcccttggcggcttgcgcgcggagtggcgggggccaagcggtgacgacggcaatgacggcgggcggtttggagcggcgcgacgacacgggcgacagacgcggtagacgctaacgacggcggcgaccaggcggtcggccaccacggcacgcgcgcgcggcttgcaacgggagggcgcggcggatggagcggcgcggctcggcacacgcgctggctgcgggaccgagcggctgcaggcgcggcagggcagcggggccgggcggcgaccacgcggtgcgggcgaggaccacgcgggcgcgcgcgcgaacaacagcgcgcgggaagcggcagcgagggagaagcggagggggaggacttggctcggcgcgggcggcttacgcgctagagcgcgcggcccgcgggcgaggcgtatcgcatctgagcgggggagaatcggagtggtgcagggcgcggctctcgcgcccgcgcgcggcgcgcgaggtaggggcagatggagcgcgccgggaacaggagggggcgagagagagcgagagagagggagag

SEQ ID NO: 3069 - DNA, 16593 bp, Oryza sativa
aggaaatcggcccatcgacccccgggggaggcaaaatagacttttgcggaggaatttgatttggaaggatttggattcggatttgaactcgacgatagatcggggattgagatcttgagatggcacggacactagacaacaagcaaagaaacaaatttcgcaattagggtttttaaaagataatttttcccgctaggcgccacgacggaacgggcgctacacgcgtgcagccgccacgacaggtgcggctgcttgagccgccgccgcatggtccccgctgcggctgcctcgaccgtcgccgtcttcgccaatcgccgcagcggctgcctcagccgtcgccgtcgccaccagccagcgcagttgccgccgtcgccaaccgccgtagcagctgcctcagctgtcgccgtcgtcacccgccaccgcagacgccgccaccgcagccacctccggcgccagccgaccggccagatctggccacggccgccgcttgccactgcagacatggccatgccgccgcctcctccgccccgccaccactccagccgccgacgccgccaactcgccgtccccggctctctgccgcccagagcaacaaatccagccatgagggggccgtatccatgcatcccggcgctggatctggacgccgccgtcggtttctcctcggcgccggcgccttgccctgagctccgtcttgccggcgccccgaccagcttgactgcgagcgagggaagagagagccccgccgccgccgtccttgcagccgcctggctttgccggcggtggctcgggcggcggcgaggtgggggaggggaggagggggtcgggggcggcgcggcctgtttcgccgcccgcgtcacccccggaggcggagcgaccgagcgtatgcaagttcgcctttgagctcccgaaaaccacttttgaatccttgaagcaccaagaagtgtcggattcccttttgaagtatgaaaaagaaagaaaaggaaggtgatgcgatgtgttgcactccttgcgttagagagtgacttgatgaacaatatgtgacagattttccaccagattgttacattaaaaaaaattatgtaattgtttgctttgaaattgttcttttagttttgagccaacaacaattatattgttacatattgagtgaaagaacattacaatagcaaacacacatgttgtagtattataatctttcagtaaatgtacttcatgtaatatattctgcaacctgtaaacacgcaaactttgtttcgttcttctatggtatgattgctaagagctatgtgttctgtggactgtggactcatatattcatatctaatgaaattatgttgcaattttcagatattatcaatctcaaagatggaaaagagaaggcaaaccgggcataaagtaaaggtgtttattccagatatgagtcggttcttcaggtgttctttgctggtcactcccttgccacctgactttcatgcttttaattttttagatgtgactaataccttcttcagactactacacgtaacagtgtgattggcaatttggctgggacatgcacattccaggcactgacttcttgcctttgttttgctctcttggtcgagctatcacctttattatcctgtactgtaccagtctggaccacggaagccaccagttcagcattgatgccatccaacccatattccagctaactcctgccgttcttctaatgccatggcagttaagcagcaagaggtcagtactgggtactccttaatgctttacctttgttcctattcccatttatctctcgagtttgatcgttctgaaagccttaaggaatttgcgtaatgtaacacaatggtccatcttcccacttctgctatccatgaacagaacgaatgtgggtttgatttttctggtttcatgaacagaatagtacatggaaaaaaataatgcttcgttaaaatattgaacgctgcagaaacatagaatgccgcaataaagtgcagaattctgccttcaaacaaaatgaaggggaatgatttattttgattggggacaaggctagtagcgatcgatcaaagttttgtctaggttccatccagcgtgttttctcccctcagactctgtagcaatgagatctaaagttgattgtccttccctggttcttgacagctgaaaagcagctttttcataggattccaaagcctccggatttcctctagttttctcctacattccacatcggtgttggatgtcataatgctggtctaccatggacaatctttctttgcccatatggtctcacctgctaggttgccatctctttcttagatgtgccggttcatactgaaccgagagagttaaaaatatgttttgtgtcagtttcctcagtttcagaccctgattatacaataacagtgaaagtttttgtgattaggaaaaagagtaaatatgttcttgtcggtcaaacaatatgattgctatcctctgtttgcgaatggattggtgagcacacgtgcaattataatcaactcttgagcaaaccattactcctaccattgccctttgatcgagtagtctaatggatgaaagtaccctagcgtcgtagactctcttctcgtgtctgtcctcttggccccacctgcctccctttgatgttcctagctggagggggacttcgctggctgggcctggtccaccgtgcaaccatcactgtccctggctgtttgaccatacgcgggcccctcagcgacctggaaactcccgtcctagacccggtgcagggactagtgagcatttgctgcccttttgcttttgtttgcttgcctggctttctttgcgcgtagccctcgcacatttttggattgttttaagaatagttctttgaagtagaaatttttggaattatcagtaagagagtagcaacatgctaccgactagaatttagagtaatttggaggcaaggtttcatttttaagtgtattttgatcatgctaattactcataacttaagtcacaacactttgttctttaccaataggctatgcaaatgagttgaattaattgtagaatgatttaatgtattgccatatgagtgaaatgggagcttaaattaaatacgaaggtacatgttggtataaagatgaaaacatgtcttctagatatgaattaagttttgcaagttgcagtgtatcctcttgaacctatttgtattgaatggttcatacaaatgaaaaagaattctagattactatttagcgcatatttattcatagcatgcaccttttcatataaaagttttcataaaaaagttcttgatgaaagtttcttataaaagtattcccataaaaccttttcagatgaaagttttctagttaaatgtttttcagatgaaaattttctagatgaacgttttcagaaaaagcgtacgatgagaatgcatatgcgctaaatagcagtccttatgaaatcttggttctccgtgaagccgagttaacggtagtgttaaaccttcgataagttttaccactaccaattttacatgtgctatggttggttcgaagttcttttgctgctgaatgttatatgtgtcgttcctataaaatccaaggtttcatttgcaaaaagagcaatagagcacgcagcacacactccctcttcttcttcagcaattcactccagttcactttgccagcttgtctctctgattttattatccttttcttttcctcacgcagggaaaaaggcacccgttgtacacctcacctcacgctcaaaggcaacgcaagcacgcagcttttctttcttggcctcgcctcgcctcgcctctgcccatctcccctcccactcgattcctccacctctgctccgaatctccctttccgcgtgcgcgcgtcgattcctccgtgctctcaccacccgatttgggggccggtctgagatggggcagtggcactgaccggaggaccttcgccgacgtcgtccatggcgcagccgcagaagcgagtctacgaagcttggaaagggaataatgtaagatcctaccccccctgtttccctcacatacctctcttgttcttgctcgcgcttcctcctcttgagctccgaatcttgggtggacgattggtacagtctctttctcgggaaattctgtttcttgctgcctctctctttttttgaaagaaagaaagaaaaaagaaccctcttggtgcttccaggtatgagcagtagtagatttgctgggttgctctgtctgtgctgatggcctgttgcatatgtcagagtgcaatgtgatgtgttgctgcccctgacaatggttggttcgcttcgtatatgcagaggttcttgtttggtgggaggttgatattcggacccgatgccaagtccctgctcgtctctgtttcgctcatcgtggtgcctgttctcgtcttctgcgtgttcgttgcgcggcatctccggcatcagttctccacctacaacgcaggatatgcgattcctgcggttgcagtactcttcatgatctatgtgagtgcaatgtcttggtttggttccttcaggtagtagccacatggtactgcattttgagcactcgactgaatacggctttgttgtccttcttttgtgtgcatttgcaggtacttaccttgttgttcatcacctcagctcaggatcctggcattgtgcctcgcgcatcgcatccaccggaggaagagtttgcctatggcaatccattgaacgggggcacaccaggcaggctgcaatttccccgtgtaaaagaaataatggttaatgggatgcttgtgaaagtaaagtattgtgacacctgcatgatttaccggccccctcggtgttcgcactgttcaatatgcaacaattgtgtcgagcgctttgatcatcattgcccttgggttggacaatgcattggacaggtacaatttctctgtctgctaaagctatttcagctttcatgaaaattgatgagctcaacagaatcattaacttgttacatttatcttgacaccttagagggcaagtataccaagagataacccatacacaatatattgtagtttctggggttaaatttagttgttttaagaaatgtattttcctggctttggcttatgcattcattttattaaatactgttagtaagtagcaaactcgggatctcacatgtatccttccaaagagctgagagagggatgataagttttatatggattgtgcaagatagggtcaatttcgttctggacgatggaataaacccatttgattgagcacaattattaataaatgggttaacatagcaattggagcatgtcatgattgttatcatactccatagaacaaggcatggttaacatgattgttgctgtctacttagggcctatttggcaaggctcgaactcctaaatttaactccgttcattttgtgggagcactccagcccactccgctcctttttagggtggagctaaaactgtttggttgggttccagctctaggagaggtggagctggagctggagctctgccaaacatgccttattaaagagcattagtcacttctagttaatggacgcataactcattccctatcgctgaagttggtgttctccttagacctttcatgcctgatcagttgtgcaaaaattgctgtatgatgtgcttggaattattaatgatctatttcatgctggactactgtggctgtaccttttttgacctggcttcagttaattttgcatagttctgctctttatatcccaatttaacaccagttggcaggacatgcttctgttccaacttatacatgcatataataagcccacagttttttacttcaattcaggggaattccaccatgactagtttcagatagtgcataacttcagtacatttaggaaccacacattttaggtattaatactctagtatttatggactagcaagaagctattaattttattctgaatcctgtaaaatccctgcacgtcacaggatcgaccaactgaaacatttactagctggaaaacatatctgaaattgagagatgctcacaatatcgttcttgctgcaattgttttaaggaatggttcttgaaatctaattgtaagtttgattcagtctgtctcttactgctttgtttctgaccattcttgtttcatttctacattgtgcagcgcaattatcgattctttttcctgtttgtttcctcctcgactcttctttgcatttatgtatttgcaatgtcggcgttatacatcaagttcctcatggaggagggctatcctacagtgtggaaggctttgaaacactctccagcatctttggtgcttatgatatactgtttcatcgccctctggtttgttggtggactcactggatttcattcatatctcatttgcactaaccaggttagttttttaatacaaagtttggtgatttatttgtctagtgattacttttgttcatgaacacaaggttttgtttgcctgcttattaaactgaatgttaaagagaagtgttatagcatgccaaatcgctaatatgataaatagggttgtgatggcttgcgcaaatgccgggttagaataagtgatatactatatgttctatgctcaacaagctccaggaaggtcaatttttaattgcttctatggaaaatgcaaaaacaacattatagccttatgagtttatttgtcatatgctcgagcctcgaggtctcttttcccattgaagtcatggtacaaatctctaatatgatgtttcaatgttgcagaccacatacgagaactttcgatacagatcagacaacaggcctaatgtctatgatcaaggatgtctgaataattgcttaggagtcttctgtagtaagacaaaaccttcaaaacacaaattcagagcctatgtacaagaggaagtacgagctccagtagttaactttggcaggcagatggaagaagagccagctggtggccctcgggcaaaagtagaagatgatcttgagatcggtagtgatctcctgcagatctctcagcggcgcaactatggggatgttgatcttgaaatgggaagtcaggactgcagtgagatggaaggcattcccaacgccaaacttgcgataggttctgaatcgcagattcctgcaatcggaagtgaggtacgagtgcggcactcgagctgggatcgtagaagtgggaattgggacatgtcattagatgtaattggaagaagtgcatcagatgtaattagaagaagtgcttctggccatgaggctgcacctccatttcaaacagaaactcactagtcagttattcgtgcattgagaagatgtgtcagaaacctgaacttggatttcaaggctgtttaactgatgatgacagtatgacacatacccagagagcaagaaagaaaaatgcacatgacgcattttgactttgactgccgtaattggtattttcaatcatttttcatgtatgaacagttactttagtcaaagattccgtgcggttggggtcacatatttgtgttttttttttctttttttgtgtggcaatctgatctcacagcgtcttcatgattctttatgtaaattactattgcatgatactcatccacctgtaattcctctgcagcttccttcaggaatttctgtagtgcatctccattagctttcattatgatcttttaccttccattgtggtcagtatatcaccttgatcacaatgctgtttgattatatattccattaggtctcaaacctctatggagttgaattctatcttcattccatatttggtacgcaaaataaatctaccgaagtcaattgtttcatgtgtaattgctattttcaaaatagggccacattctagcagaccaaagcatccaacccagggatcataattcataacactttgggttgccaatccaactggcaatgaccggtaagaggttataccattcaaatttgtagtgcaatcttgatgctaataattttaaaagactgaacaaacacaacactttcagaaaaaggaatttgttgaagaaaattagcaaacccgaaaaggctggataatgcccgagtttgatccattaacattttttgggaataccgatccattaatatgttgtcatctttgtttgcaagcatagcaaacactcactgcttttttttctagaatatgctatttcaatgttgatatgtccatttgtaattttgtggaaattccatatgctcaagggtgagtgctgcttcagttagctgttggattctgactactgcaaaggactctactggaggactaatccatgaattctgataatgccaaaccaggcgacttcacaattctttgggtccatttggaccagagcatgtgaccagtgaatgcttggcttttgcaacggctgtttcaatgagcttatgtgaaactcaaaatatcatgttaatagtaggttgatcttattaatcattggtgcactgatactgactcccacttgaagagttgctgatctttgtgtatatcaaatcggcaaagtccactcaacggtcagtcggatatatagcaagtcatatcattactttgatcttgactatatttgtgattaatgtgctgcaatttctgaacctggttggtttgatgcgctggcatgtcaagccgtggagcctactgggacccaaaaaaaaaaaatctgaaattggtatggtagagcaaccacatttaatctgcttgataattggaacatttgtagtcatccatgcaggtttgttctttgcttaagtagtactccctccggtgtcattttaattaacgttttagacaatgacacggtctacaaaatatatctttgaccttatttttctatatatatatatataataaataaatgtatgtttacttttattatagtattttgaaagacaaatctatgggcctgttcactttgatgccattttcaaccttaccaaattttggtaaagttgctaaaaaagtggttacatttagtttgctgccaaattttgataactatataagaaatcctgccaaaattttggcaataatgccaaaattttggtaaggttttttttcatcaaagtgaacaagccctatatatgttgttctagttctttaaactaaatattttctaaattattgatgatcaaaatattataaaagtttgactccaatcttgtccaaaatatcaattaatatggaatcagagggagtacagtaccttggaaagactcctatttagtaatcttttttactgctcattagggcaagtactataagcccctacatgttacccataaatttgccacgtaggattaggtgatgaggtggaggagagaagttaggagggagagaatgagccacccctcatgcaaggggcaacctccacacaatctctaagaaaagtacaagatgatatgagagtaaactaatattggggtttgtgcattagatgtgatatgttgtacttgttacctcttaattaatgagaagatgacgtggtttaaattagatgtggcacacacctccactataaaaattgcccttacagcatttcttttcatgcaaaaagattctgctgcttgtgctacagtctcatttcatctgtaggaatctttgtgctggaaagtcgtttcatacacttcttttttttattgaacgctgaccttaacgcgttttcatcatcctcaatcctcatcactcaccagtcatcactggctagctatgctttttggtagtgatcaacttatcattccatgaaagcaaccttcttcagagatgaggacttcacacactgcacaccgcttgctcgctctctccactgtccacttcaaaacaaattccgtctggttcgcatgtcaaagcttataaatccttcaagttggaatccactacagaattcttcaccattaaatagtaatagtatcaccctttgctcccagaaaacaccaggaggagcagatcgaggaaggcgaagacttcagcgttttttgtttcgttgactggtggaatacacttttgtcctctcggagcttcagttttgttcgctttgcgtctttttcacatgcatcgagcagaggacaatggtgttatccatgtggttgcgatctgtgaattctggcggggaatgtgggttgatcaaacagacaggttagcgttgaacgtggcattgatggatggatggatggatgggcatgtaggaatggcggcggcgcggcgctgaaggtcaagttgacttggttagttgggaggcattggcgtacattccttgggaggctagctaggtttaatttaacgggtttgtctacttcatgaacaatcgctagacaatatttcaacgtgacagagaggccaactcagtaaatgacagtgatcgcggaaaaatagcaatatagcataataatattcctagttgaaaacaatcatcacgctatctcgtgctgatcgttcaaaaataatagagctcatcaatataataatatattttgacatacttcctccgtttcataatgtaagtcattctagcatttcccacattcatattcatattaataaatctagataaatatatatgtctagattcattaacatcaatataaatgtgaaaaatgctaaaataacttacattgtgatacagaggaagtaacatagtagaatccttttcagcctactgtgttaccgtagcagaacatacataacaaaacattgctaaacgcttagcagctggcaatacgaacgcttagcaatttggtgttaattgcagcgctcctgcgtgcacaaaatgaagccaacgtaaacacttcgtttgctagtattagaggaagcctaatacactaattgctttagataattatacactctctccgttttttaatatataacacggataattttaaaaaattatgtttgcttgaatgtcttatttaaaaatttataattatcatttattttattgtgaattaatttatcattaaatattctttaagcataacttatatttcttttttcacaaaaattttagagtaaattgcatccacggtataacaaattgacaggtgggtgcgatatagtgcaagaacttgagaattgagcgtccgagtacaacaacttgatgagtgggtgtgttctagtataagaacttaacaatttagtattttggtgtatcaacttggctaaaaataaatatgctaggtgggtttttcacgatgtcaatatgccattacatactaatcataaggatattatcttataatattgaatttaatctttaagaattatactgcatataatagtacaatttacatccaattaccttctagattttgtttttgttttcttcaccttctcaaatatcaactgaaatataataatttctacatccagtttaattggctttcagttattagttattaggataaaaatataaatatacttatacaaatccgcgctagtatattgtcgaaattagtacttaaaaattgaatttatataaaaaatactccaaataattaagttgtcgcataattttttaatttattgtatcaaaatcgtaccgaccttataagttgttgcatttatacgatcacatataaagtttttgtactaaattgcacctacctgctaagttgttacactagaacactcatttctcaagttattgcaccaaattacacccacctaacaagttgatgcaccgtgaatgcaatttactcaaaattttaatagaacgaatgatagttaaaaattcaacaccgtagtatattaaaaacataagtggtactgtagctacttagctggtacttaagatcatgtacattagtccctgaggcgtagccctactcacggcgtcgactttttcggccgaagccgtctcccagtagagggccacgacccctctaagggggacacgcctctctgtattccttttcgtcgagccacggagctgggctccgcattgggtgcaccgaggctagggagcggctcgtggacaccgctccaccctcggattttccccttccacccctcgccctagtagatccggcggtgaagaggagcttcgtcggtgacgatgaagagggagagagaggcggtgacgagcagagggatagatgcggcgacgacttggagatggcgccggcccaccagatccggctgccggcacgcaaatctgcgcgccgctcgccgttgaccacctcaacaatgggcggagggggaggggcggagtcggcagtggcgcactcggccagaattagaggcggcatggtggggtgaagtcgacggcggcacggtggagtaggtggccctcctcatcaccctcacggtggagaggacgcgcaggtcaccgacgtgtctccagcggtcctccttgtcaccctcggggctgccggcgatgggggggggagagagagaggcgagcggcggtggcggcggaagagagagggagagggagtcagccgatggtgtctagacgaggagggaggcggcgatggtgtcttgggtggtgcggtgcgaggcgggggggacggcaacgatgacgggtggcgggagagagacgaggcgaagaaaaagagaaggggaggggtgacgaagaagaggggcgggtgaagaaaaagaggggggagagagagatagtgtagtcggtggattagcggtagggaagtaaaaatatacatggggcttcgtggctgtgacacctattatgggcaggagtatctctgctccgttgctttggacattgaagacactataggagtggcttaccatattgtagatgctcttaaggaaacaatttctgttggggtccttggggagtcctccgctggccccctgcccccttggctacgccagcatactttctctttttaaaagagtatagggaaggatgagcttcgcacgcatcacctgtgagatcagtttgttatgtgcaaattaattaaggacgcaatgatcagcatatgggacacatctagcatccacaccacaacagtacctcattaatccaagatagttgctcctttcttgcttttagagcacaatcgatcaacgcccatgcgagtgagccctcttgcttctcttgcccatgcttggaatttgataggaggtggcaataatcaagggccatctcttccactaaatgcacttcattggaattacaggtgtctcaattggagttacattattgggacatcgagacatgttcaaccatgaggcactgtacaatatacagtgttgtctactactccctccgtacatctctgtgaatagggacaatgctagaaagtcttataatataaaatagaggaagtatatactaatatgagtgctatgagacatctcactaactggtgttctattactttcgtttttaatataagatgcaactgatatttactcaaattttgactaataatgcctactacttatccgtctcaaaatatagtaatttttggttagatgagacatatctggacctgtccagattcataatactagaatatgtcccatctatgcaaaatttgctatatcttgagacaaatatagtagtattcatcaattacttaactaacaggaaatagtaacactagattcgtcattaaaaggattgtaagaatgtttagcatgtttatctacgtgcacaaatattttagaaaaactaatagttaaataaaatttgaaaaaagtcaaatgtattatctataattgcctctcacttttctgtgattagaaaactccatcaataacaaaatgggctgtgtttagatccaaactttggatccaaacttccaactttttccatcacatcaacctgtcatacacacataacttttcagtcacatcgtaccaatttcaacctaaacttctaactttaaaaggaactaaacacagccatggtttcaagagatagatgttcatgttgtagactgcttactagtatgaaaggcatctgcacagtctcctctaatgtaatatcagtccatagataggcccctcaaatcaggccttttgaccttagacttagccgcgtttgcaagtcttcatggtgcaatagctaaaacaaacagtagctttgtcagggataacgcatgctcgacacccatgcatggagtagcatcgtcaaaactcaaaaggaatgtaaaatgtagagtagtagcttctattttgtattcttaatttgtcggtgttaaaaacccaccaatttggaagtttacattattgctctgtcttgctgcaaaggtattattcaacattttagtacatttgacatgccaaccattgccatcagcttgtcacctcctttttcatcattgccctgagatgaaatgccctaactttgccatgtgtttggcaaaacctttgctttgttaattttccgaagacaataatatttgcgccttttgtagttttttagtgccaaaagtaccaattcaatctttaagtttgaagcagcggtagtgtgaaatcaatataactgacaaaatcaacatgtcgtttgacactgtcaggtacaaatcaatcttaaggctggtttgaactcttgccattggaggaatataaagcaacaaagaataaatcaataaaccatttagctcacgtttttcgtcgtcatcatgttcttggatcaaatgcaagtaatgcaggggccacactctgctttcagtgacaaaccatgcgatttttctcaacgatgtgatgtttttaactcaacccgtacaaatgtgattgatcaggcttgcaaaaccaggaagaactcaaagccgtttgacgaaatgctcgcgtgtggctgcttttcccaggcaggcatgcacgcatgcccctcctcgagctaagaaacttgaccccctcaaacctcccaatccctatgcactttgccactatctagaagctcttgtgaaatctttgtattaagcaaagttcagagttggaaaccttaatcacattgtggattaagcatgcagattagcctaagcaattctttggattaatcaaactgtggtctgacgtgtgtgcttttagtatagcgcatagatgcagattaggtcaagtggtcaaccggccgtcagacagcaaacacgctgccttttggaaattccctattaagatagtactagtactaatgctgcaatctgatctgagtaaattttcaaatatgattaaattacggttgtattgtaaagcgtttattgaccgcatgtgaccaccgactcctaattaagctatgtgctcaagcagggccttggcagagttcatgagttctgggtaaatcagcaaattaacaccacttctgtgaatatctagtcgaattccctaaatcaaaattgacctgtttattacttctaaaagatttcagctgagttgcccttttattttttttctgttttttctgcagacagcaagctatagcacctgtttgttcagttaccaacttttttttttcttgaaacattccattaccaacttggagttgcatttcgcatgcttcaggtgctggacaatgatgtaataacgacgactatgcaactaatcacaggccactacaccctatttcagtcaaaattgacctacctagtttttagaatcggtagaatctattgtacctgtagcgtgtgtttggtttgagactaagtgggatgggttccatctatcctagtttttttttggatgtgatggttctagttgtcaatttagtttgtgatatgggaatgtaatagctttttgtttggtagaagggattaaggtgggataggaaggacaactttgcacggacgttagtgtcgtctggctcctaacggctggggcgcatttagctgtgagcgtgggggcgaggagctcgttggcgcgagcggaggaaaggcaaaggcaggtcgtggacaagcagcggaggcaggtcgcggacaagtggtggtcactcgcggaggagaggcgggtcgtggacgagtgatagaaggcgaggcggctcccggaactaagagaagcagcggtcgagcggcggcagtcggtcgcagaggtggcgcctggcatagacgagccggcggcggtagcagacaaggcggcggtcggtcgcggaggcggcggtcgatcgcaagggcgacgacggtcgcggacgaggcgacggtcggccggtcgtgggggcggcggcagtcgcggaggtggcggagtgcgcggacaagcgtcgacggatgcggaggtgatggtgggtgtggacgagctgacgccgtgcgctcgtcccgggtgggacgagctcctccggccatttttcccggatggattggtcccggatctaagaggaatatttctctccaaggaccaacccatctcactcacccctcaaccaaataccctaaaagtgggttcatcccatcccatccttgcaaccaaacactaccctagtgtctgcagtgaaaaatatgctactagtactaattattctgtttttttaacagaaaatatagagggagctaaaacacgacagagtttagaggtcatggtagttaaaagttcgtggcttatttagacaccatggtatatggtactaggagaatatatataggtcgcttggaaataccaaggttgccatataaaccataaat

SEQ ID NO: 3070 - DNA, 8941 bp, Oryza sativa
ttgcaaaataccatcgtacatgagaatgatatgggagggcctagaccaatatatcattcaactcataatttttacaatggtatcgggtaaattggccctagtagggcaaggtaccatggcaagaggtggtaaggagacagggatgcttgatgttgtctaataagatcggtttagccatcctcgtgtctgtcgttcctcctgatcctaaacatccttcgcaatggtgagtggtgtacggttggcttatgttggctcacgatggcaacctagacattagtgggattgaacgtgataccgacaacgaccggtttagatggatccatcctaatggctagttctaccgccttttgggtgaacctacttcttttcctctaaattgtttatgggatgagggtgttgaaggtcgatgccaataaggctgcacgaaagggtcttaaagtcctcaagtagcatctctagatcttgggtttgactctccctaagggagcaaatttcaagcatgaataaaagagaaaaaaaacatgaggcatctatcacttcttccggtaaaaaaaaaaaaaccttggttgcaaagacactgtgttgacctattcacatcatcacccacaacggacttcatgtcactagtgtgagggtgtcatcgctaacatcatttacgctgaggcatttaccctcggcaccaaggacttgggtgccaagctttgggtccatctttaaaacaagttctttcaaagggatctatttacaaataatatttcaaaagggcccaaacgtaaaaattcactatattcgtgatttatctgattccttagtgctggaccagtaattggcttgttagcggtcacatactccctccgtaaaaaaaacaaactcttgctatgcactcatgtctagatacatagatagggttgttttttttttctgggacggagggagtactagttttcattgaacaaatattcaaatctaaacttttgaattcaaaaacctgttatcggcccaaaaagaaatggatggctaaagtgcatttttacagacccaaaaaagacataatgtaatacgttatagatatatcacaaatagatcaaaatgtataatgcaattatcaatataagcatgcatcacaaaatatgttgtacaatatacaatccaccaaaatataacaaaagatgaagctttaaaaatgaatctgtcactttttccttttgaaatatatatatttagcaacatataaccttgccagagaagataggattgatataaattcttttttgtttacggggatatagattcatattcgattcaagttattttgtaaacctttggttgactggtttggtttcaatccaaactaacttgaacccaatatgttctacttctcgcgtgcatcggacaattcatctcggaactaaaattctaagcactgttagtttcaagaaggtatgagaccgcgtgccttcgaaggactagttctagccgtcgtggaaaaaacgattgatgaattttcgattagcccggccgagaataaatgtagccaaattcgggtcaggacgacgaaattttgcaatctccaataccaaatgaagaaacttcgtggaccagataagggacaatactgttgggtgcatgaaccacaacgtcacttggtcgttgcattgctcggtgctagtttgaccaatgtcagcttaattaaatagtgggtgcagttccaaatgacgcactttgatcgccagttactagtaaacaaatgtcaattcggctacgtttatatatttagttatatattaattattttcaaggaagtagatcaataacaatgtatataagcttgaagtgcggataaccaaacttcctacttaattagaggccgatttggatggatactaattcaaagtgtgtcatgccaattttttaaacttaaatagtataattgggatgtttagaattggaaccaaataattggtattgctgatgccctattttatcatattttaaaatgttactttaaccatattaagacttggcttcatactgatagcaaaacaatcagtaaactgcacgacgacttaagtacttttgctatattaaaaatagtaatactaaaatttacctagaatataatacttcatccgtttcatattataagactttctaaaattgtccacattcatatatatattaatgaatttagacatacatgtatttttaaattcattaatatttatatgaatgtggacaatgctagaaagtcttataacctgaaacggaggtattatataaaataaccgtagtaattaattagttaaatttcttacaatggaacctgtccaccggattcgagccatccatcgatctagcaaattatcgctaatctattagtccattctcaacccaaacactagacataatttccataaactccacgtcatcaataaactagtactagacattattcttccaatgcaaacatcatacatacttaaatttaatactacttatctcatataatgtcttggatgttgtaaaccatgtctcatgcaagacatgatttctttcgcttttctcatttattcatttgccacatcattttttattctaagtaacagtttatttaatgctatggacactattctagtcattgggttgggaatgaacttatgatccagataactacttataatttatcaactataattaccgtggttaattaactgatttttgaagaagctagcggtagcccgagtgagaccgagtctaatctgaactgcacctttttttaggcggcggctatctgaattctgaagcgctgaacacacatgttttcctttcctttttcacagtcgatctgtgtatatatatataacagtcgtctcgtccgagtccgcctcgtgcaaggaattaacggatcggacagcactctgaacggctcgatcccagtaacaatttgagcttttgattttgatcagtgcgcgctagctacagtgcactcgagcgccggcattgcctctgcagcagccgagttaatggccgaccaacgccggagatttcgcggcggaggagattggcaggcgagcgtcgacgatgtggtggacgacggtggcgagctcgaagccgcggcggcggcggcggcgaggggatcggtgctgtccggggagtaccaggctcaggagatgtccacgatggtgtcggcgctgacctgggtcgtcgccgccggccacgacgaccacggcggcgggcagtggtctggccttgtggacgtgccggcgacgacgctcgccggcggcggcggcggcgactacgggcatggcgcacaggggagctattattactatggcgcagcgccgacgtcgacaccggagttcgtagcaggtgaggatcatttccttctcttctattctttttctattttatttttaatcttattaagaatggttgcatgcttgcatcattagcaagttaagcaacagtttgcacgtcacccattcgcacttacacgcttttgcttttttttttacccattttctttttctcgacgctcttcgtgtttagcatgtgttactcatgttgcgtggtagaatcaaattaaataaaggtgtttatgctaatattgtcccgtttcaacgaatattttgatttggttccaacgagaggagtgctacgtgtcgacacagccattgaattttatcttgcattgaattttatcttgcattgccagctaagctaaagcttattcattcatctaaagactgcatacttgaaattttctttattcagcaaagaacaatggaacagggcaacttgccctgttctgacttcaaacccgattactttgtacgattcttcgaagaaaactcaaagatcatcatacaaaataattgggaatattggttaatgatgaaaaccaaatccacattagtttgctcgatcgatatatatccactttctctatccatttgaatgagctagctgatgctatccatgttcgttggtatttgaaagcccgactaattaattataattagccggccctacaaatctgcaattgcttacttcctccatcttaaaaaaaaatctaaaactgattataacattttagtacaacggatttggatagagatatatatattagtactggaggttatttttatatgggagagtacctcgggaaaaaaaaatctgcaattgtgcacaacatatacatgcaaatgatctacccgttgcacctgcatgcatggggatgtggatatttatgaaaaatgggggagaaaaacaaaatggcaagcaaagctcagagttttctctcttccaaaatttccaacatccaaaagtcccatcatcgggccatcgtacacctgcgtgcatgtggatctcaccaagagaaatgattagacaacttcacatcaatttaactcttccaagatctcaccaagaaagatggttagacaacttcacatttaactcattccaaaatttccaaatacccaacaaacatactacatgttccataaaaaaacccaattctaactatgtatctggacatacatctctccatgttcagtctggattggtcttttttgaacagatgggtacgtactgcgtactccctccattctcttaatttgttaaacgataggtatacatcaaaatttaagcttgtttagcagaacacggaaaacatatttttccatgatattagttggtttttcatctactgaaagtacctccaaatattttaggtttaattatcatagaactagagataatggtacatgtataggagaataagtcatttacatataaaacaaaagtaggaataaaatagcatgcacaatttcactaacactggtcagtaaaatttccggccttgtgacttagcaataaccatgttctccttatgcttttagtaaaagctgggccttgtgccttttctccaaaataaccatgttctccaacaaacaccgctgcacgtactaaaagattaattcttacatggtagtaactcttacgaataaggctctcaattgttcgattttactaaacgggatcgagtcataggaaatctagatttactttgccacatcagccttttttaaaagttaagaacaattttgtgcatatatatatatatatatatgtatatatattttccatctttaattagatggaacggccggtgtgatagcagcctaacagtacgcgctgcctaagttgcggttttgaatgcaattgttaggtgtcaaggagtggtaatgcatctggcattgctagctaagtagctatagcctatagggataggagagagaggaaggagagttccactttgggtagtggtagcaaaaatgtatacgagacgtacatatacgggccgatgcattgatgcgtatcagcgtactacgtatgtggtatttaacggtcaggtgaggcgtcaggatggaagaatcacaactgtgctggggaagaaagtgtaactaacggcgagggaagttgggcggtggaagtcgttaaatttgattaattagatccaaccgctacaaaaggacgatatatatcttatatttaggggagaaaatgtgtgcatccaaatttatatatacccaacattcatgcaacggaacaaaattgattacaagccttcccacgacgatgggtatatagaaatgcaatgcacaatattgcgcctaatgctaattgcatgggatataaagctgagtttgatttagcatttcggctgagctaatttatcgttatctgttaacacattttccaaactactaaataatggttcgtacaacaattttgcatatataagatttttcaaaaaaataaaataaatcattttttaagtttgtaacatttaatagttaattaatcacctcctaatgatctgcctcattttgcgtgaaacaaaatagcccatccgaactgcagtttcgaatgaaactttgatttcattgcatctaggtgttgaaaaaccttgtccgatcctacatgtatgctttactaatcaaacacaacgtaaataattaagaaaattttgacaatgtggatcacatgacattctttcttccacttaagctgaactatatattcaattcaatatactacttttctctattctaagatttcacacttaatcttatattataatatgtaagttgttacattgttacacttttctgtttgtttgttaatgtggatcaagcatttttttctcaaaaaacaatgtaagtatttcttagattgttgtaccaagtttatagagatatttacatatgttatttcaaacaaacaaactataacgatactaatttagtattataaatatttttttaaaaaaaaatctgatagatatagaatagcgattgtttatattttaaaatggagggagtacgttcttgcagctggtcgcaagctcgcagccggtcgacagagataagatgcacatttaatgcatggaagcaaagtgtcaaagtgcgtacgtagcctgcgtagcgcgagacaacggagtcgtcaaatatgatgcactatatacgtagagcttttctagcgctagctagcttagcttagcttcgcttcaattctcatcgatctaattcgctcgatcgctcgcgcgcaggagggcagcaagagcagctcagctccgacgtgccgcagggcggcgctagtctcggtctcgccatggacgagcactcgcccacatacaccgtcgaagcgtcgtcctccgccgatcagcacggcggcggcggcggcgggcggcggtaccgcggcgtgcggcagcggccgtgggggaagtgggcggcggagatccgcgacccgcacaaggccgcccgcgtctggctcggcaccttcgagaccgccgaggccgcggcgcgcgcctacgacgaggccgcgctccgcttccgcggcagccgcgccaagctcaacttccccgaggacgcgcgcctcagcagcccgcccgccggcgccggcgccggtggcgccaccgcagcggcgcagacggtgccggtggcctacccggccagcgcggtctcggactacttgcagtaccagatgctcttacacggaggaggcggcggcggcggcggccgttatcctctctactacggcggcggcgccgccgctgccatgagtagctctttggggccttactcctccatccccacctcctcggtcaccgtcgcctccgtgccgtcgtcgtcctctgccgcgtcgtcttcttcgggttacggcgcgccggcggagcacggcgaggcggtgcagtggaccagctggccggacggtggtggctggacctatccggcgacgacgagttcttggtctggttcgagccagtacccgccgccacctcggcctcctcagcagtagttctttcttcgtttcttacttcttccatggcaagtggtagctagagatcatactaggttctgaatattctcttacttaattcttgttgttttcttacttagagactactaagagcttgttattttcttccttagaaaccaagagtcttcagtttgtagctagccaagatgatgatatggtggtgttgtgtgttcaaaatgcatccatgcaagaaaccaaagaaaggtgcatggcagtgccactgttgtatttgttctttattttgatggaattgttcttttctatcatttcctttagtcaataaaacgaaaataactataatcttttcgcctgatcttgtaattagacatggatgagtgcagcaaaccacataaagagtgcaagatggcatgcattttttacctggaaaattgaatggagtaaaaaataatttatatgtaaaacttttatatctttattcttagtagtagtaggtttaaaagttaatgttaaaaataaagaataataaaaaacctcaaaatcaattctaatactaagtttcaaaatttaaaattttgactttatctgatataagccaacaaacaaaacgagctccactatttaagttttataattttcgtgaggatatttttgataattagtttctacatcgaaattaaaaggttacgactaacttttgcgtgtgtgtaatctttgcgaggatgatcttgataattagtttctaacatcgaaattgaaaggttacgacttaactttgattaacacatagagtatataggccacaaacccaaccaaacaaaagcaggtttacttacgcctcatgttctcacactaattctggcccactgagcagtctactgggccagagccaaacgcaagataagcggcccaaaacaatccgccggtgcccccgccctcgtcaaccaaccctgacctttgacctagtccacgtggaaaccgtagccgactcgtcctcgtcttccagctcagctgcagccggcgcccgcgcgggcggagcaaaccacgggcggggcgaccacgccgacgacccgcgcacacgccggcttcttcgtcctcttcttcttcttcttcttcttccacccccgcgacccgccgccgcccccgcgccgaagctcgtggcctcctccgccgtccacgtgaggcaggcagggctaactccgccgcggggcccacggagcagtgggtgggtggggcccgcggcccgcaccgtccctcggatcgcgcggggcccacctggggggcaattccgtctccttcctccctctcgcttacgaactccgctaccaaccgcttccttttccttctgctgctgctgctgctgctgctggtggggggtagacagcgaagcccgcgaaccacctctgtttcgttggcatcgtcatccttcaggtccacggccactagctaccatctagaagcttccggaagcttcgggaaggaagccggcccccgcgccgccttggcgggcctgcaatgccggaagagaaggagtacgcgcccgtgcccctccgacaggcgccgggaggcggtggaccccgaagacccggtcaagtcg

SEQ ID NO: 3071 - DNA, 24212 bp, Oryza sativa
aaaggttacgactaacttttgcgtgggtgtaatctttgcgagaatgatcttgataattagtttctaacattgaaattgaaagggtacgacttaactttgattaacacatagagtatattgggcacaaacccaaccaaacaaaaggagggttacttacgcctcatgttctcacactaattctggcccactgagcagtctactgggccagagccaaacgcaagataagcgggccaaaacaatccgccggtgcccccgccctcgtcaaccaaccctgacctttgacctagtccacgtggaaaccgtagccgactcgtcctcgtcttccagctcagctgcagccggcgcccgcgcgggcggagcaaaccacggcgggggcgaccacgccgacgacccgcgcacacgccggcttcttcgtcctcttcttcttcttcttcttcttccacccccgcgacccgccgccgcccccgcgcagaagctcgtggcctcctccgccgtccacgtgaggcaggcagggctaactccgccgcggggcccacggagcagtgggtgggtggggcccgcggcccgcaccgtccctcggatcgcgcggggcccacctggggggcaattccgtctccttcctccctctcgcttacgaactccgctaccaaccgcttccttttccttctgctgctgctgctgctgctgctggtggtggtagacagcgaagccggcgaaccacctcggtttcgttggcatcgtcatcctccaggtccacggccactagctaccatctagaagcttccggaagcttcgggaaggaagccgccccccgcgccgccttgccgggcctcgcaatgccggaggagaaggagtacgcgcccgtgcccctcggccaggcgccggaggcggtggaccccgaggacccggtcaagtcgccgccgcggcccacctcgccggcgaactccacccgcaaggtctagatcggtcttacccttccttctgccctcttaccccttccttcctcccggacggattaaagtattaaaccctaatggttgcttggatctggccgccgcgcgcctgtgctcctgctgcgttttgatttttgatgtccagtcttctgctacttagctgtttggattggaccgttgacctggccctcgcgttctgtggcttgatgggatgaacatggcacataatgcgttgatgcgcgtgttttatgcatggatttttatgtgcttcaaaacacttcctgatgatgatgatgatgcttacatagatttcgacatagtattggataaaatgtaaattctgactgttgtaaaaattaggtacgaaacacaaacaagaggatttaaattctcgagtgttgatgttggatagtttgtacattagtgtgtaggagaggagtgccctcttgccgtggacacatggatttaaagtttagatgattcttgggctaacggatcatctgggttgctgtattgacctatagttattactgcttctacacatttgggaattgtctactttagagcatgccttaaacactttctttttgtcataagcagggattgcgtatactaacagacctaaaatcttatgatggaatatgtgtctgacagtacgaatttgacaaatggcactaaatttgcccctacacgttggtccctgagtcaaactattattctaatgttgacacttctgaaaaatcacatttgagaattattacttgtttagttttgtatgcagtctgatcatgttttccatctttgaagggttatttcttatttgataaatattagattctgttgacttcactgggcaaattagacaacctggatccagaattattgtgttaacaaattttctgttttcacccaaatgagttatacttctcctgtccatgcatgtgctaaattatcttcaaaatagtagttctgtgcttaaccttgtatgattaaacaggcatgttttgctgttcttcaaagctgggtgtcaagaaaatttatgacaggatggtatgttttttcaacaattaatctagacatatcacaagagctaaagattatatccaagcctattaacctgttttatccctcttttgatttgcagcgtagttcttttccctgttgctgttacattcttcatcacctggtggtttgttaagtttgttgatggatttttcagtccactgtatgcaaagcttggatttgatatatttggtaactcttgcaaaaatgcttctctctggatatttgtacttattatggaaaaatactatactgtaatagttgagaaataacagtctgtatattactctttttttatatgtaatgcagttgtatattaacataattagactaggatgtttttttttcctgctggatttttttgtgtgtgtttgatctagacttgatctccaaatattaacttggatttgcaaatctgggtgcgaaataatgtggtttaggtgctttagtcaggtaatttagtttatgatgctttatttttattggatacaatgttgatcctgaactgctgacaatgccaataacaagacacttttagccattcatcagtatgtcgtgcaataacaacatcagctataactggcaaaatttcatggtttgttctgtgtggagtaataaaagttatgtcttgtattaatattttgttcatgacaaatggttatcacatcttttcaggcattgggtttttgacttccttgctattcatattcctagttggaatatttgtttcttcatgggtgggttcaactgtcttttggattggagaatggtttattaagaaaatgccttttgtaaggcacatatattctgcatcgaagcaagttagcactgctgtttcaccaggtgattcatacgtatatacaaatctatgtgctttgaaatagtctacccatgatatttctttttaactcattcatgtttttcacttggagtgacacattgacactgtttctgaaactcataaattatagttgcaagttgcaacactatgtttctgcccacttcatgtcttcatgttgtgtttttgtaggtattgataggttaatgtatcattttaatcattatattacaagtttccaactttgttgtaattcattttctcaaccagaattttttcttatttcttattgacagatcaaaatacaacggcatttaaagaagttgcaataattagtcatccccgtattggtgaatatgcatttggattcataacatcgacgatgatccttcaggtatttgtttatacatatcatgtgctctagaatgaatagaatcttgatggtttcagcctacacctgcctagatgattacctccagatgcctcattcatgtataacttccttgcttagcttagctgactccgagaaactttttgaatgtttttaatttgttgattttcataagcatgtgttcggttgctccttttctgtgtttccttgtttctagaatagttccctcactttgagggaagtggcaacgattagttatgttcatctgagtcaaaataatggtcacaagaaattttacaaaaccttgcttggccttatcttattagctgactattgaacttagagattatactagaagatagcttactaaagatttgctagtagacctatgcaaggccaaacagcaacacaaagcaaacatttgcagtcggaacagtgaaactgatgccttcgactttttagaaattggtgtacattttgatttagcaagcagcacaacaaatactgtacttggttacatattaattatattacagaggcccatattttgttgctctgtgcaacttcataacgccattattatctatgattgacactttttttctgtgcgctctgagatgatcatttaatattgctttacagactgacaaaggtgatgaagaactgtgcagtgtatatgtgccaaccaatcatctatatatcggtgacatcttcttggttaggtctgaggagattataaggccgaatttgtccattcgagaagggataggttggttccttttccaaattttgaagttaccgtttgtgtgctaggtcttttctcctatccaattcagtgttttatcctagtacatttctcttattcatctaatcttatgctctttgtactttttacagaaatcattgtttctggaggaatgaccatgccgcaggtgattgcagcaccaggacaaacaccccataagggtcagagcacccgtttaaacagaatgatgagtgcgtgagtacatcaggtaaaatctgcagatgcgatcaggcctgtaaacctgtcccaggcggttgccaatagatttctgatccatggccatctcaatttcagcagctgttctgttgaatatacatagtatactgatattgccacctagcttttgtaggtctgcccagagttgctgagagagggcaaatcggtggatgacaaagctggaacaaggtgattgagaagcagcattgctggtagattaggcagatcaaaatacgaaagtcagtgttgactagtccgcatcgcttaggtttgctcgctgagtgaaaagttgtgtaatctttcaatcacgctccaaatgtatatcagtactgtgaccaatagtatttatactcctttcaaaagaaaaaaaaacgatagcatttgtaccttgtttacttcactgcgtcctggttcttttatgcacttcaactaaggtcatctggaggctgtgtaccggtcttatgcacttcaactgaaaccaggttaacgcttggtcatcttgagcatgtttccatcgagaaaccaaaaactgatgtatcgtttggtccttttgagtcggttcatattgagaaattgctcggtatacaaacaagttaaacaaactgaaattttttttaaaaaaaaattgtcgaaattttatctgtagtggttatcgacgaaataactacgtgaacggtaattcgtatgtctacccctctttcttttctttttttcacttgctagttctggttagtactccctttccaatttgataatacttattattttggacaaaaacagtctcaaaaaataactttttatttaagactaatctatgtggtcaccttatttctaagacattttaaaagctatttttagttaaagattttaaagttaaataacagtcttacaaagaacaagtgttatcagcattgagagagggagtacaaagttttgtggtgtacctatcgggaaaaaaaatggttttgtgatgttgcactttacaagttctgattagtacaaagacagaagagaagaaattcgtaaacaagcaagaatggcccttctggcctaatcaaacacctccataataacacaacttttttttagatcaacaggcacgatttgttcatggcagggcagaactctctcttagaacagcacaatatccagacacaatccttggatgcctaaaaccaacaagggaaagaaaagaagcttaaaaccatttggtgcagctaaaggccccaacgtcaagcttgttcagtcagtctcacagcatggtacagcaaaagacaaagcatcggcctacaggagaagacagaacaggattcacatctaaagttcaatgctttcctaaataaaacttgctactcgtcatccgattagctggataagtttccccacgatgagtttctatatgctctgcatctgggagaatgagatcctgatcgtgttaccctccagcgaggtggcatgttttgatacaagggcttcggtcgcctcctcttcgctctcgaactggatgagcgcctgcctcttgccgttcacctcaaacagctttgtgtttacaacagaaccatgctctgaaacatggttaagaatcgcatcctccgtgatctcttgtgggagggctgaaatgtggatcattttggttggagcgcagcagtgacggtagttcttgattacattgctgttgaacctgttaagacttgaagtcgtgtagtcgtgcgcatcaggagcgcttgttatatttgggtactttgagtagttaacctcgagcttctttgcaaatagcactgccccctgtgaaaaacattggcatccaaaatgcggcaaaacagtaatcatacatatgaaaatagaaaattagttttactcaatgcaatgaagcagataattgcgaatatgagagtaccttcagataatgcacagctagctcagcctgaaacccatcagccatttcaacaagggcgtgatctggtttgttgcgcagtattttgattcggactatgttcccatatagagagaacagattgaaaagcttatcttcatttattttctgcaaggcagatgagttaagaactaagatgccaaggtttaaggccagtaacatcttgcacaaaagctttgaataccttataagttggcatatcaggcttaaactactcttgccaaacgaccactttggttcgttgagttttcactaaaggatcagtctggtagctacaattttctaaaaaatgacaaagatcctcactattcaaaactctggccaaagaatggcccaatcctaatattcatgccaacagcctgctagcttcaatcgtactcaagaacctctctacatgatgagggaagtgaagtctcttgacgagcaccccactaacacaccccactagagccatgcatctttgatgcttcctttctaagggctgcagagagcaaaatgagcatgtagcattctgcattcatttgctaaccatcttatggggcctgactagagagagggatgaatgcttgtatcagcaccttcacctatatttgaccctatcataacataacagataggcaacaagcagctgttttattccagtttggccatgaattgttgacttactgatgatttcattgactgggatggctcacataggtaaacacaattatacgacttactgtcactctacttgatctccacctagccgagtaggacccaatccacaagtgtagttggcataacaactttgattaggtcctctggttttatgttcaaaacatcagggccctcattggacttctttaacaccaaggaccaaagctaccttttagcaaaaactcagggaccaaagtgttcaattcaaacagcttaagcttagaagtttatgaataatgaatataagtggtaaggttaaggtagtcttgaacgatacagaacagatggagacttacatcagtgttcaaattactgactattagcgtgcaacgttcgttggtaccagtcaccccgggaggtaaagttccaccgaatgcagctgtgatcattgcagctcttcccatctgaatgaatcaaatgcaaatgtttttttatgagaacttatagggttattatccatctgcattttccacaaagtgaaagacatatcactggagactaacctgtgcatatgaagctgcacacacaaaaggaaattaaatcaggaacttttgcaaatatcaacaataaatatttgattcaaacaaaattgaagtgtgctacctcctggttgttggaaggcataaagaccacctggatctggatagccttgctgcttcaataattttcaaataataaaattctctatttagtttcagagcaaaaatgggtccatgaaacaagtgatgtgataacaaaaagaacataagcacactctaacctgagaggcccttggacgctgttctgtaggcaatgatgggtttgtgaaatccctgtataaaggatacaattgagagaaggcaacaagatgattaaaaaaaagtcaaaagaaaggaggagttgtgaactgaagtttaattgtactataacttttaaaggcaagtacaactccctaaaaattattgatgcttacaaattgtccaataatgtcatttgtaagtactaaggatgagaggttaattttacctagaacgatcattgttgtaatggacttgcagttcgcttagactgaaatacaaggaaacaagaaaataagattgagaaaaataaataaatttcaactaagactagtcatgggtcatactttgaatattgaatgtctagctggcagcaaccgtcatatatgttccttccctggaatattttgtttgcaagaatgaagacaccagaaatgtacacagggaaattaaatgaacaataaaaatattacatgcaaagcaccaaatgcatccatagcttcttggagtgactgatactggataagggcttgaaaacctgcatcaaacaaacaaaatgcaataaatatactttgcaagcattatcggtgggaaattccatacttatttatcccagtgggagatgaatacatgtactacctctgtcccataataattgtatttttaggatttgaatttgtcccaaaatagttatcacaatagaatactaatggtttcattaatcacttctcatttaaatttctccttattttaccctcaactaccctcacactcttacctatacaccatttaacaagggacatcatagtctttcttctcaaaccttaatatatgctaaacaaattagaattacaattattttgggacagaggtagtaccagtaactgaaaagataaaaaatatttactacaacagatagactaggccgcttggaaaaaatcatgctgtcacccacatttctttatggagaacatatgaaatttgcagcaattggatgagaggctgatatctaataatctatgtgcttcttctataattgagccatgttgttgcttccattagtactacatgcatgtaaacatctgttgctctatgatacgcaatgctgcatctactgtaatcaattgatatgcactacaacattattgctgcaacagttggcataaatgcttttgtaaccagggtacagcgtagtaatacccatattggaaattattgagtttataaaattgataaatcagccttgccattcacatgcatctgctaagtaacatccatatcaactatgcatgtgtgtgcggagtgagagagagatgggggaatctgaccagctgacttctgaaatgtgacaatcttctccacatatccataagctttgaaaacttgatgtagaacctccacagttataggatacatcatgtggtgaatagtaactaagaggattcggttgggttctgactcctgaggcccagcagcaaacaagcaccaagacaagagagaggagagagaagaataaatagagaggaatacgcagatctagttgtaacaataagatacagtagatacggtatgcaatttaactcaactatctgaaagatgaggagaaatggaatagctaatcaccctcccagttctgacacaataagtgtgtaatataaaatattcaaagtcaaatattgccacacttctattatgagcagtgattcaagtttccggttttcgcagattaatattgttttctggctctagaatacacctatattgcattactaactttaggcatcttaaaccatgccatttgagaagaattaaaccattagcacttaagtgctgcgattggagggaattaaagattccactgagtaaaccaacaatggccagcggattgtccatcacaagagtattgtgcaatcgaataaagacttgtgcatttttttttgtatccacaaacaagttaaaaatcataagtggtttaagaacttaagaatgaggaccttgaagaaaaattaataattaaaactcatgcagacttcagagctcaaacatgacattgtccacctttggtcatcttgaaaagcttaaaagtaagtcctaaagttcagaaaggaaaaatctagtgttatatagatgtgcgtgcatacctgatctgaatttcgtccatgagagttttggtcagtggtaagttcttggtgggacgaaaattgcatgtacacattccttcccctaaaatagcataacaggtgaaccacatgccaaatgagatgatttaaaatcatgaaggacagtaaaattatatgttgtgtaaagtagaatgtaacacagtaaactcagcgcattaacagtttaacacttgtcaataaaaaatcacataaaacagaacccaaaacctcctggcttccataagtgtccagaaggaggccatatttcaacagcagctaaaataataagacctatataaaaaaaactatcctttttaggagctacttgcatccaaaatcatcacatgaagagtgcaattaccttacgctaggttgaacagtactgtagtattgcagcgcactcactgaattatgcaagtcttgcatttggagaagtgcctgaaccaccagaaaccacccccaaaataaacataaatcagcacacatctacctagcagctacaggcatagcaggcaaaataacggataaggaactcgcctgattcttggcacgcagcatgacgatcttggaaacattgccaaacggctgcaatagctgcagcagatcagcctacaacaacagcaacaaagcagtgagcgaacaggccgtaaaggtaataaagctttcacagtaaaaccaaaccatctatctaggcacataataagcacgaaatccagaaaggagaagaaacaaaagatccacgattcaatcctccgtcacctcagcgatttcgtgcccgacgttccggatgtggatcaccttagacgggtccgccatcctccccgcaccgcaccacaccacaggtctacctgttaaccgtactaaggttaaggccaaaagagagaagcttccaaaccaaagaagagaagataagatttaaggcgaagagggtgcggatagagaaggatgtgaggaaggaagagggacgtccgtacggggtgctcaccggcggcggaagcagcaggacgccggcaccggcaccgccgctgctcgcggggggatggagatgagatcggcgcggaggcggcgggtgaagtcgcgaggagacctctccgtgggggtggaggaggccgaggacgaggagaggggagatcggctagggccggcgcaagcgcaagggagtggagtgagtcaggcccattacagttacaattggtgtaaaagttgttggaggtttgggggcactctgtagtctgtagcgggagatttgatcgtatactacagtatctcggtctctcggatgaactacggccgtttaaaaataattttttttgggctcgttcggtttggacgaaaaacaaaaatttggaattataaggattaattgttaagtgatattcagttcataggacatgtaagtacagaaaaatcgaagaaatatttcatccactcaaacctcttgaataatttattatatatggattgaaatttattagaagtattgttgggagcgctcccatattccaagcgccaaacgtgtatcaaccaggcccacctcaccccacgttccatcatcccgctcccaccgttatcggagtaaacgatttacttcgagaaaaacaacttctctggttacgatcccaccccacgtcccgtcatcccactcctaccgttatcggagtaaacgatttacttcgataataaaaacaacttccctttcgatcccaccccacgttccgcttcgtgctcccaccattatcggagtaaatgatttactccaataaaaacttctctacttctggtatatattctatttttcccgtacccaaccaaccactctcacccccacttcattttttccttttttttccggatctgaatcgatccaccatcccagcccacagatcggcgacgcaccatggaggacgacgacgacatcgtggcggttgatggcggtggcagccggttgatggcggcgcttgaggtgaaggcactgcttcaggcctcgctgccgcagcatctgcttcagatcgatgctgaagagacgtctggcgcatggcgaacgaggtggaagtcgtggggacgatgagttctctcagcaattcctaatgaaattcttgattttcttgcaagtattgtatacaatctatgattaattaaattctttatccttcttgattctatgcagtctgacttcgattgggttgagcactcatcttggtgtgcttctctattctcccttacatggcggatatcatgttcgtgatggtcaatcgatttggtaacatcggcaagaaactgtgatttgtttcatcaaaaacaacggcgacctccatctttggcttcgtcgccggatccaactcctactgaggtcgcagcggccagacttggtgctgcctcggctccagcctccatctctgctgctttgtcttcttgctctctctagtaggacaaaaactccattaagccatcatgaggaactggggatggcgtgtattgttgtgtgtgtgtaaaatttttattcttgtgcttttactatgatgtgcatgtaaaatctttattttttttgtcccgtgatttaggatgcagtgattcaatatataagtaaaaaaattattcacgtattatttggggtaaactaattaggccccagtaactccctccttatttatttttccttttttttccttgcttgatgcactcactataagaaatcatcaaccaaggctagcaataatgcaattactataagttaatgcaccatcaattttcatttacatcgatagtaatatgaatactacaagatttgatcaaccaatgttgttcttaatccaactactacaagcacatgtaccatcaattttcatttatgtcgacagtaactcgattactacaaggtttcaccaagcatggttgtcgttaatccaattactacaggcacatgcaccatcaattttcatttacatcgacagtaattcgattagtacaagatttggtcttagtttgttgcacaccatatcgtaactacctcgattggaaacatagataaaccaattacaacgattattttcaatagaccactgattttatagatctgtaattgatttaccctgaattcaaatagaactaatctacacaaatcgaacgtgggcaaccgaacaccagattttgcggactctggacgcgatgtgcggtgctcggaataatattccgcgctctagcgctcagaatagcgctaccgtgaaatttattatataggggctccttcattttttttctctatttctatgggttaaatttcctccaaaccaaataagcttaacttttgtatgttagatttatgggcttattttgtttggatcaatttttgtgttatcaaaataatggtagtgacaaaagttgctaaggttttagcactatcaaacttggtggtatacaatttgaactagtgtgtgtaaaaaatagtcacaatacaaaacatccatttgatactaatgaatttgccaaaaaaaattggtatgaaaattttggcttcaaaccaaataggccatatatacaaaagtttccttattttgagatgaaagaagtgttggtttactctcatctactaataacatgtggtgtcatgattgttcgacgatataccacgaggtgtctcccaaaattacttgacaaggtgacaatcaaacaagtatatatacaattcctcctatgagaataaggcatcaaaatcccgataagccaacataagctacgttgagtcgaaatttggaggaatcttaagagctagccgtcgaccacaataataggatcatttccaaccgacatagttgtatagcttaaactatggctttcgttgacatttcgtatttggtgtgtccataagacaatatatattagggtaaatagggacgtagctttatgggtaattaaggctatagcgatgctctggtgtcgttatagcatcgtggcgttcccggaagggcaaggcatcctccgccttatggcatgaactgaaggagagagggtaagagcagagggaaaaggtttgttgtcttgttgttggtcctccttgacgtcgccctatcccttcttgtgctgatggggagtagagggattgctgttgttgtgccatatgagagagaaaaggtggaggagaggaggccatcggttgcaagcctgcaagaagggagagatgataggaggatggtttgcttgctgcatcatgcataggaggaagagaaagatagatacgaggagcatgcagcagtgctgcacaatgggggatagagatctggatggaggtcaggtggtggttgctggaactgggaaggaagttgttgggtagggttaaattgctccctactaggtcaagagagggaagtagtggtcccaggctagataagtgcttaaatgggatactgttgggctagactgggataaatagagtaccctattagcatatttacattccatatttcttattctttctattatttcattgcacgtaaggtattgccatgccatatgccttgtcgctatggcggtaaggttgtggtgggtcgttatacctcgccataccgccttactaaccttgccatagctgtattacctatttctaggggcctagatctataatatgtatgttgcttccttgctacagttttgttggcatcttgcttataataagttgtgtcttctctggcttaaacttggtatgaaattatcaggtaacagtgttgatcactccttacactcaatcaaattatttctcgattagcaaaatgcatgtgcttaatttataaggaaggcatatggtccaattctatctaaaggaaatatatatataataagtttcgtcttctctgacttaaaaacttggtacgaaattactaggtaacaatattgattactcttgaactcaatcaaattatttctagatacaagtgaagataattttaattgtttgcattacccatatgagcaacttcgaagatcctttgtatacactacccatatgagcacctccaaaaatctaagacgacatatcttgacattggcgatgtcaccatgagtgtctcgcgatgtgaacgtcgcctagcactgaaagaataattagctataaatgtaatctcgtgacgtggacgtcgcctagcactgaaagaataattagctataaatgtaagcacccatatcaaatctaggatttatcccgtataagctatttcaccacaagaaaactaaccagttaaattactctcacttcgcgatatactgtacttttagtttggagttcacctcgaaattcactaagtcgatatattgtccttttagtttggagttcacctcgaaattcactaagggtatggaatataatgttgtgcgggtttccaagtaacagtgtgcctaacatcaagttatgttttcctggccatattccaacttttggctttttcaattctaagctaaaattttgtcctttgattagattagaaacatctaggccgatgaacaacattcaccgaataatacggaagctagagctgccttaacgtatgcgcgtgtatttacgttcaaccgggaaagtcgtgtctgcgtagcttaggcctctctttcccccaatgttgtgaacttgtgttcttctgcagatcaaaacctggagcgagcatcgatctagctagctaattgtaaaccacgatcgaggtttcgattaaattcagtgtaaccgcatctgcaagcatgaacactgttagttcgttttcgcttgtgccttgcatatggaaaccagatctaagatcacgaacatctcgtcgtcgcaagaaacagataaatcgatctcgagtatagcatccaatcatccatttttacaaaaaccgattgctatgatctactgcaactagaaatctacaatcttgaatcttgcatacctctaacaatcgactcaatgatgcgcatcatgagctaccatttcttgatccttagctcgagcgacatgcttgtcacgtactacttgtgccgctcgatcgatcaccttcccttgccggccaccgccgcgtcgttcgccgccctcttcgtcgtcgtcgtcgtcgtcgtcctctcgccatcctcctcggccgccccggcgacgacgacgacgacgtggtcgttcggtctcctcgtctccctgtacaccgccgccagcgaccggaacctgggcctccgcctcgcctccccaccgataaccacctcgtcgatgtcgccggcagccgcggctctcttcctgctgcagctctccacggccgcagccgccgccttgcggccggtcgccgccttcttgccgcagcgattattcttgctcacgctgtccgtgctcctgctctccgactcgcccccgccgccgtcgccgctgcagcaaccgctcagctggatgagctgctccgccgcctccatgtccagctccgtcgcgccggccatgacatcaacctccacgaacatgcccgatacaggagatagatcgagagagagagagagagagagagagagacgacgacgacgaaccacggcgaccacaaatagcccctcgaggaggatcaccaccgagccgtggatggcgcggccagccagaagcttaaatataggattccgccgcgtagcgggagagatcgatcgatcgaacgaacaggccgagggtgaggaggtgccaaggaaagacttggaaggtggcaggaaggagacgactcgtccttgtcgtgtgtcttgcctcgttttagcttttgcttggactcttgtattatcttcagtatttgccttggctaaggcgtgtttttttcaaggaaaaaaagcaagaaggttatcttatacttcctccattcaaaaatatagacttaaccatccttaacctaaaaaccaaaaaataattattttttaaatactccctcatagtttagatcaccctaataaatataatgtatgcacccaatacaattaaatatcttgagaatagaggatttaaaaaatgataatatagtgaaaaaaaagtgctagtgattaataagatatgtaaaacggagggagtgtattgattgagaaggagagagctaagggcctgtttgagatgagaaaaagaataaaattaataagatatgtaaaatgaggtgataattgagtattaattatcacaaccttgaaaatagattaatataacttttataaaagaaacataccgtttaaccgtttaagaaatgtgaatgtggaaaatgagagaattttcctctctttctacttttgctgaatgcagcctaagtttagtatatttgtcttggcaacaactctctgaaactcgaccccgtccgattacagaagttgaagccataaccgtgtaaaaacatcacgaattccgctcaattcgtgtttcttgtatatatttgattttcattggaattcaaaggatggcggaagcaaccgtagtgacgggcttgatcaggacgcgtattgtgtcggctgctagcagtggacggaggagcacgtaatagattacattgaccttgaacggagagattttggttagccgtgacggcgaatgaataggtctaaatctctcaggttgaagtattgtcatgatcgtgtactgtacatgatccatttgacgcgttgcaatgtatactgtattaaactatagatcactttcacttgggatcagtagtgcgtgatactgtatacatacaccaagtcagaagtttatgctagtagtactacgtcttaaagcaagtcagaagtcatcagcaagttcagattggtcagtcacactgtctgcagagtggagacgatgagaagtgcacatcaattgctcaatggaccagaaataatggagcaactcatatgcgaccaatcaattcattcccaattgtttcatcaattgtagcctgtggcgatttgcacggctgtttcagcacggcagaaaccggatttaccgtacttggatcattgacccaatacgcaatcatccagttgcatcaaccaaaaattccaggaaacagtcatgtactgcgtaggcaggaagtactgttgctttcaggtcagttagttaccaccagctagcagtcaagtaatacaggatagcagagccgtggcaacatggcatagatgatagatggtagaaccagagcaccgcgcacaagccaattcagcagtctacaaattattttagattgtgcaaaaagatgaatgtgcctttacaatatatgtactatatatattctactgcattctactggagtagtaccctacagccttacgacttctgcttatagaaaaggaaaaaaaaatcatagctgaactaaaagtcagcaacaacgacaacaggaacgtgtaactaattctgtatgaattatgatgctcaaacgggaaacaaaactcaggattagtagcatagcgactattccgcccttaatctattgcgatgatgaggaacccaacagagacgtacataaggaagacaggatatagtgccaacgcctttctccttgggttaacagcagcactcatgaatggatatgctgcccaggagctccaggccaatgtaaccactactgcaatgatcttcagtagtacattatccttcagcatgcaaatcaaagctccgacatccaaagggaacaggcagtatccaagaagactcaggctctgaaagaagttgatgcgcccaccctacaatggagtgtttagttattggcaagaaaagaaaatccgttggttctgaagggatttgagaattcccaagcaagcatatgatatgagagagtaaaaataccaggagcagcacattcaatgtgagaattatagcaccagcagctagtacagcaaaagcaacagcaaacacttcagactacaaaagacaaagcaaatcatcagaatcagcaagtgatatatcatgtcatgccaaagaagtagaacagcaccctcaggaaattgaactattgaatatccctggaatactggcaaatatgttaaatctctgataggaacatttacaaactacaaattgtagagtaaattgaaatagcttccttctaatgagtgtgctttctctgtgttactgatggaacgttgtacaagcattcaaatgcacgatttactaaatatggttcttattgttgcatccataattttacaacaggaaatgtattaaaaatctaataagaatatctaaaactacagagtgctgtagaaataggacactactttatcctaataggggagttttctctttgttacccatgaaaatttgcaagagcattcaaatgctcaagttactaacagtggtccttattgctacatccagaaattttcaatagccaatcctctcatactgtttgtcaacacacaccttacataagaacctggtaaacattataatctggcaaaaccaaaaatatactcatgaatcagacaaatatccacagaaaaaaaaagatgatacttcttattgatgcacaaggttggaaatgctatgtgaaaataggagtccagagattcattaattatagactggtccccaatactttcttccagtgctctaaagatggtcctaggtggcactaaagcactaggaaatatcctgttgctgcagtttttgccaaatcagcttggtaggcaccagtgctgtctaagcaggttagatgcacacctaggcaggctaggcatctttccaggaatacaactcaaatgcacaattcttcagactacgaatagtttcagtgtagacattgtattacattcatgcatgcatgaatggaggagatgtttatagatcaggaattgtcagagtatgactattaatagcacataatgtcccggatataaactctgtattcatcaaatttgactaggcaaactagatttgagttacacctcaggacttacatagtcaagtttagctcttgatctcatagtgaagatgactacttagctctactatacaaactgatccagcttttcaacattaaactaaagatgctggaatttatcttgtctgcaagatttagcatgatatgccttgtttgacatatttaatttaagatgtgtcatagtctgttgcagctacaatggtgcaaaacagtgagagagcaagctagccttccattaacaattttagtagaaatcgacacagccataaccattatacatgaatctgataaataagtacaacatttacccatttcttaaacttcatgacggaccaaatacttaagagagagatatatacagagataactgtatccagaattccatatgagatgccttggaagaagcatgtgcattagggaaattaggcataaaaaattctaggaggatgctccaatttctccaagtaattactaacacatggaaataacatttatgggactatctacacatctttcaacagaaattggagctaaaaactgtcagtttttttcccgccgcaggatacatggacaacggccaggatcagcaggtctctatgcacgtgctggttttgaattgtgcagcccgattaaatgattatctaagcaactgtgtactgttattatcctttaccaaaatcaatcaattttcagatggtaggattaacaaaaaaaatattattaatcataaaaaccattaacttgcaaattactatgtcaaacaagcttactggaaaacataacctaatttattttccatttgaaaattgaaaataaaaattacaaataaatctactcaaagttacattgtaactacactatagttacaatgtttataatgtaactacattgtaacttttgtagttacaccaaaattataccgtaattttctcttttggtgttatctctgattctcggtgcatatatagtcgtctagttgctcaagtattggcttgttaggcagcgaataatcaactcgtcggtttaagtagagaatacaatgctccagaagtccagagtacatacggagtatatcacatagaagtccagagtacatatcactgagatggaggtagagctttaatgattgccgtgtgaaacgtgaggagtttaattactgtacatatacaagagagcaaacaaatgcacgaatcacaacgtcatatctaagtaatctaacgaacgagaaaacgacaatttgttttgcaaaaatctgtcgacaaatttctagcagatcctaacatttattggatcattcaacggttagtcaagctatgattttgtaattcacagtcgtttgtcctgcaacatctgtaataactggctatatcttctttgaagcaaaatccagaatggattccattatctaaaaaaattcaatggatagtcgatgtattttcatctaatcaatgtgattttggtgattcaagtgctctacagttttacatagcattttaggttttgacattaaagggttggggaatcaactaaatctaatcgatcatggaaagagatcggacttcacataagaaggcagaaaatcaaatgcccagatgccgtggtaccttcttgacggaggctgaccaggagagggtgaggccgaggaagacgatgaagaagaaagggccccagagatcccagtcgcgcagcgccttcccggggtcctcacggaaagggtttgggaagacgacgagcttgaggttgctgacgatgcgagcgaggtcgcgcttgacggtgtccaacacgggctcggtgagcgtgttgggcggggggccgaacccgtcgccggcgatggcgaccgagacggaggaggggagcggcggagacgacgacgacgccacgcaggaggaggaggagaacggggggagctgcggcttggacccggccaccggaggaggcatcaggggggcgagctggagacggggatcgaggcccgcggagccgacgccggccgcgcggggagcaccgcgaccgcgtagggcggcgccgcgtggatgaggctctcgatctcgtccatgtccgactgcgcggacgaggagtggagcgggatggtgtcaccgtgcgacatcgcggcggcggtgtgcccaccggcggcgattttaccgtgcgatcgcgagtcgcgacggcggcggggagagagggtggagacgtgtgcgcgaatcgcagaaatggtggtggtgcgcgcggtcgtgtttttgtgcgacccgacccgatcgtgtttttcgctagtggggcgtggaatggatccgcggctcacgggcgacacgatgcggggggctccgtgcctccgtgtacgacatcaccgtgcgtgaaaccgcgacacacgggtacacgacgccacgcccggaagcacgaggtgaaacggctcactcaagagtttactgaactgtttgagggtgaagttatcgtcaccccccacaatttaattgttatcgctgttaccgcgaaaaccttatgattactatgagatataaggtgactttaaaaattaagttaccacatgtgatagtcacgattagggacgaaaacggttatcgaccgatgtcgtttccgtataagaagtaccgttttttttatcatactgttttttttgttatttataaattttgttttttttctaatttctatctacatcgtattaatatcgatactgagtactaccttcaacccaaaatagtatttttcttgtaacgtttgaccattcgtcttatttgaaaaatttatgtaaatataaaaaaagataaatcatacttaaattgcttttgataataaatcaagtcaaaaacaaaataaataataattctataattttttaaataagataaatgattaaaagttataagtaaaaacataataaaacgataagtattttgagagggagatactagtttaaatggcaagtatgataccgatttcaaccgttttcacccctacccttgtaaaggacctcagccgcgccgataatccgcggccgcgcgcggggggcctcgcaaaaacacaaaagcacacgcacgccgcgcacagcgcagtcactcacactcgcggtctccctccctccctccctcacgtcacgtcacacgcgtcgcgtcgctcgcttgcttcgccctcgtgtcgagcactctctccctctttcattccggctccaaccaaccaaccaccccccccccccccaccacggcgagagccgccgtacagccagcaagctgccgcgcggcgcgaggtcgccgaggctcgggggccggcgggcggatggcgtcgtcgagggtgatggcggcggcggcggcgtcgtcgtcgtcgtcgcccccgcccccgcccccggcggcggccgcggccggcggggccgccgatctcgcgcggttcaggagcaccagcagcggcatcggatccatgaacatggacgacatcctccgcaacatatacggcgaggccgcgccgccgcctggggccgccggctcggccccggccccgcccccggcgggggaggcggcgggggcccccgtggcggaggtcgccgcgcggcggacggcggaggaggtgtggaaggagatctcgtcctcgggagggctatctgctcccgctccagctcccgcggccggcgctgcgggtaggggtggcgggcctgagatgacgctggaggatttcctggctagggaggatgaccctagggcaacggccgtggaggggaatatggttgtggggttccctaatgtaacggagggtgtgggtacagcaggaggaggaagaggcggcggcggcggcgggagggggaggaagcggacgctgatggatccagctgaccgcgcagcgatgcagcggcagaagcgaatgatcaagaaccgcgaatctgcggcgaggtccagggagaggaaacaggttgggctggattcttcagtggggagagaatttgatgcattcatcaagtgggtttggggctgtttggctttgcacagtcatgagttcagaacatgatgctttccattttgttctcaatgcaggcgtatatcgcagagctggaggctcaggtcgcggagcttgaggaagaacatgcacagctgttaagagaacaggtactgtttacttttgcgtttttggaaatgttatctgtgaaatgttgaaatggagcatggatacatcaaccaattatactcatttgccgctttattatgcctgaactctttctggtagtaatttttcccatgttagataactgcttagtacattacattatttcagtaaagcaccagggcatattgggataaaagggacactgacatttgaactgtcagcaattcaggatgttggtgtgttcaaaatataaagttgtcatgcatcttaggatggtcgctatataatgttagtgtttttacagcatgtaaggcaatgcttgatccatggaaattcactaatcaaacagaaaatgtattttagtattaatatttcagtaccaaatatgtaaaatctttcacataagtaaaata

SEQ ID NO: 3072 - DNA, 2229 bp, Oryza sativa
agtttatctaattttaccatctctgttgaattgcaggaggagaaaaatcaaaagaggcttaaggaggtaagtttgattgtctaacataattgcttctgtatcttttttactttgaaacttgatttaacatctgtatggtacagtatcataatatgtccttaaaagtttcattctgcttgagagctgagacatttaattgagttgcatatatgtttccatgtttaaagtcgtagtgtggtttattggacatttaatacaatcttttggaaagcgtattgcagaacttttaagctttttaaaatgaaggcagtcgttatgtcaaattacatgcttccttggccattttgatctggtttttcttacaggagctaacaagcttaatgtctccatcggtgtttggtgaactaaataattaatgcactgattaatcaagtttatctgcacactatgtcagcttgcttgggattctttatttcatgtttggtaatacatgattcaaatagttttttgttatttagaagtggtccgtccagcaatcctgacaactatttctcacgacaacactgcttgtcaagttgatccacccaggtatagtacaataagttatcattttgtccctaccattgggggtggatggcgcttgctgcatgcatatgacataatgaaaatggtatcacatcttctatataacaatgtttgcagcccaaatctagtacattgaggtgttcatatagcaaatgtatacacgataaaagtccatattttctcccaatctaatttctgtgttgtttttaaatttattttgctaaatttgttgtttgttatttgctgcataagtatgtagtaagcaaaacatgccattttttttactttatttctcagaaatggcacgtgtttatgcagatcaaggaacaagccgttgcagttgtcataaggaaaaaaacacaagatctacgaagaaccaactcaatggaatggtagaagtaacccaatttctgttgttactctcttacagctacagagattctcccgttttctgtttcccctagctgatgtttcaggcgacttggtagaatagtcaaggctttcaggtgacatgaaatctcaaatgccatcagaaggtgtagctgtgcgtgatcaaaatgtcacgccattcagaattggtctgcgatctgttatttatttgtcatcaggctcatgcggctaactgtgtgtacaaacaagaataagccggtttacatgaaaggtagattaatgttacagatctgagccacctgtgttttgagtgtgtttctcttgtgtttccactgatgaaaaagccttcgatttattcttcatttcttcaaatataaaaggaaaaaaagcagtgctgtttattagctgatttgatttgagctgcttagatgtggggcatccgggcatatcacttcattgggctcgatcgtctcgtccattgtcaaaacagtagagagcatctttccatttagaaagttgcgtaacggaaattttcatcagaactggaaaaggacagcatgagtacgacagtatcggttattaaaagggacagcatgagcatggaaaaatggtatagaaatataaaaagttttagaattggtcacgtttattaaaaaataggcaaaattaaatagcgagaggttgtgattggttgagaagtagagataggtcgaaaaagtgaatggtaaagggttgtaattggtaagtaggttaaaataaatagaaaaaggttgtgattggctaagaagtgaaaaaggggaatggtggagagttgtgattggttagaaagaaaatgttggtggagaagttgttatattttgggataaatcctgagtcctaaaagttattatatttgagacatactcctgttatatttgggacggagggagtacgctgatatttaccagtacaattcgcctgcgggcctaattggcactcttggatatatactccatcccatttgatcatcctctaaatttgttgaggtcttttcaaattaatcatcatctaactgatatctatttgtttattcgtgcataaataaataaaattgttacgttttgtttgtttatgtgtgcagagtaaatgcaattatagtatgtctattcgtttatccgtgcataaatgacatcgtcgcatgtcttgtatgcattcaattgcacatttgcatacccacatgtatgtagagcatcttatcgatgaggtttaatttca

SEQ ID NO: 3073 - DNA, 30542 bp, Oryza sativa
  unsure (1)..(30542): unsure at all n locations
tcgcatgtcttgtatgcattcaattgcacatttgcatacccacatggtatgtagagcatcttatcgatgaggtttaatttcaaaaggaatgtttttttttgccttggtctcgacaccatttgcaaatatgatggtcaaattgaaaagagggactattatattccaattcatttgcaaattttaaattttacaacttcattttaagaataatttaagttaattttgtcattttgttgtctactctctcgtaatataactacttgtagtattcaaaatttactctacaatatagttacttcttcgtatataccgatcataaatatttcttgtttaatttctttacctatttcatctcaactaatcaatcacaactatcatgtatttaatttcatctctctctcctaatcctggtaaaaaattttcagaagtgattatattttaggacaaaaggtgttcctctctgttttttttaatgatagcgaaagaaatatgtactccttatgtttcatatcataagtgttttgacttttctcttagtccaacctttctaaatttaacctagtttataaaaaaatataataacattttctatacaattaaaatttattcaatgttatatctaatgaaactaatttggtgtggtagatgtgctagatttttttataaacgtagtaaaacctaaaaaagtttaactagaaaaaaaaattaaaactacttataatatggaacggagggagtataaaattctacctaaaatttcagttacaattcagaatctaaattaaaaattacacttgcttgttggtggtaaactgctctacaaaatatatatgaattagagcaactccagcaaaaccctaaacgcaccccccccaaaaaaaacaattttggagttaagagtcgacagcgaggcgcttgtggtgacttcgtcaatctcaaggatttactggtccagtcttcaaagatgctcataggggtagaatttgtgtgcgtgtgtcggtgacatgggaccgggagtatcatgacttagagacttgaggcagacacgatcacccacgtggcctaaccccctcggggggggggggggggcgggcccgagggtgatatggccgcccttctctttgtctccccgaggggtcgggcccgagggtgatatggccgcccttctctttgtctccccgaggggtcggaccactcccgtcttggccccgagggccgaggcgccccgaccccttgtgggttttgcgccgcgtatatgaggtaggtgagcgtagcagggctcacctaaccacatttattgcggtttggacgagcgcgtcacgccgcatgtaacgcagtgcagcgcgctcgtttatccggtctgtgatcagtcacagaccggtcagatcatgggttaggtggcgacaggcggtctgacgcacgcctcgccccatcccgccaggacaagagcctccaagcactcgtccctatcaggaagcggcgtggtaagctcctggaaaaggcccgttggttccggtcagatatatgccacgcttcttcctaacctttacaggcaaaatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctctgtccattaatgaagagaagtgaagtaagaaagagagggagagatggtgcatgtggtatccccttgagatataaaaggaggaccttgcccacttagagaaaggggagaaaaaaggatcccagaacgattgggggctggctcgcactttgtagcttcttcatacacagatccaccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacactccgtcatctggcgcgccaggtagggggctctgtgagtgatcttctgagctctcgcactctttcgtgtgcgccaagcttttcctgttcagcccgatggccgaacaagcaaaggcacacaacctctctccgagtgttagcggtgacgacggggagccgaacccacgccgtcgagctcgtactccaccgccccctccacgccaaagtcctaggcgagaagaggcgctcgagagggttgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaatgttggctggacgacgtggccaacttggtcatgacggcacggcagcgcctaggtgctggtgggcggtcctccgccaccaagacctctggcgctgctaccaccggctccgtatcgtcaaggcgaagggcgcggcgagcggcggctgttgctcgccattcggccgccactccttcgtcagcgcctccgacccaggaagatctgcgtggggggccagatgcccgcatcgatatcgagcgccggcgtaatggccgacgtgctgcccacgcaacggagggcgccacctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcaagggcgcttcgcgggccacccgaaaggggaggcctgcgggcgacaaaaaaaaggaggccggtgctcctagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccccggcggttccttacggcaatcggcgaagtgaggccaaacagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtacgttgcccggggaggacagatcgcaatggtggtttctcccactgtttgcaacgtgaagctggggcgtgtcctcattgatgggggagcagccctcaacatcctttcccccgcagcctttgacgctatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgtcgggccccggtggccccatctctgtccatggcgacctcaaagtcgcgcttgcttgtatggagcagcgcgcggaccacctcgccgccgcgtccaagcccgagggtggcgacgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccatccggagtggctggcgaatccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctagttaccatcagattcgcatggctagggaggatgaggaaaaaactgcattcattacccccataggaacttattgttatacgacaatgcccttcgggttaaagaatgcaggtcctacttttcaatgtactactcgaatttctttgggtagccaaataggacgtaatgttgaggcttatgtcgatgacttgattgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcattgaggccaaccccgagaatatacgagctatagagcggatgcccccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaagcgtatctcagctctcccccagttctggtcgccccggagccaaatgaacccttgctactctatttagcggcgaccccgcaagtggttagtgcggcgttggttgtggagcgcgatgaggacaatcctcattccgcgcacccccaccctgtgctggcttggcccgggagagagcagggaggagaggcccccgagccgaacggtggcccaaggcccccgacgaccggagcaggccctctgcccgcttgtcagacggtgccaggtgtccccgacacccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtcgaacgacgccaggagcccccgacccccaggacggccccgaggccactgtgggaagaccgcccctgtcatcctccgaccccgaggtcgtcggcacagaagacaagtgcgccccgcgaggccgcttggacgaagagtgccccagggacgtggcccctagcgaagaggatcggccccaccgaaaggtgcagcggcccgtctactttgttagtgaggccctccgggatgccaagacccgataccctcaggcccagaaaatgctttacgctattctgatggcctcgaggaaactgcgccattatttccaggcgcatcgggttatggtggttacgtcttaccccctcggccaaatcttgcataatcgagatggtactggacgggtggtgaaatgggcaatcgaactttctgagttcgatttacactttcaaccacgccacgctatcaagagccagaccctcgccgactttgtggcagagtggaccccggctcccgagcccgtctcagtccccgaagccagctcgggcccctcgcagctgcctcacaccgcccactgggtgatgcagttcgacggttccctgtctcttcagggcgccggtgcgggggtcacgttgacctcgccgagcggagacgtcctcagatatttggttcgccttgactttcgagcgaccaataatatggcagagtacgagggactccttgcgggactcagggtggcagctggactggggatccgccgcctcctggtgttaggcgactcctagctggtcgttaaccaagtctgtaaggagtaccggtgctttgacccgcagatggacgcttacgtgcgccaagtacggcgtatggagcgtcattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgaccccttaggggagacggacacgcatgacaggcccccgatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgtggctaacggaatcctcctgaagtgcattcctcgggaacaaggcgtcgagcttcttgccgatatccatcaaggcgaatgcggatcccactccgcctcacgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcagcgattactgcgaagacatgggcatcaagctctgcttcgcctcacctgcccaccccagaagcaacggccaagtggagcgcgcaaatgcggaaatcgtcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttttttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtctcatacacacaacaaatagaattgacacaaaaaaattcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccacaccgccgtcatcgccctcctcgtcggagttgagggcgaacgcgagccgaggggccgaaccctcgaagctgtggacgatatggtcggcggcgtcccggacctgcgcgcgcgcgccgtcctcggtcccgggagggaactcgtccagcgccgtccatggggagaagtcgggatccctggcttggtaactcgccagtacgagctccaccgctcctcgagcgaggtccctcgaggatgacttaatcgtcctctcgagctcctcggggagccgttggagagtcccggccatctctgagaggcgctgagcgaggcccccctggttggcggcgtacttcacagtccgcccgccccaaaggcctgcctgccggccggcgtgatctagacgggagacggcgtcccgaagcatgccgggccctacctcgcctgccaaacggagggcctcgacctccccggcggacgagtctagcgcgccctgcagatcggcgatggtgtgttcggcagctgcgaggcgggaggctaagtcgctttcgcccgtggccgccccgccgctgcgcgccctcgcgtccagctccttagcctgcgcctcgagttcagcggcccgctggttcagtgcggccttctcggcgcgggcaccttccaaattgcggcgcgcttgttcctctagcacagcctcacggagggacgcgctctccgccagccgttgcgccgcggcctcggcctcctcaagagctcgctcccgctcggtgagcgcgtcctcgcggaggcggagtgcgcactcctcctcggcgcaggcggcctcgtgcgccgccagcgttacctcccggatggcaacggcggcctcgcggtccgccaggtccctctccacgacgccggcgcgctcttccagcgccatggcacgggcctcaagggcttcttcacgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcatggtggtggcgatgagggcagcctcccgctcctcctccacctccttggcgatctcccccagcaccttccgacgggcttcgagctctgacacgtgccggcggtgtgccttgcggcccacctccaccatggcctccaccgagcgtcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcgacctggcgaagtctggcctcctcccgagcggcttctttagcttggcgagctcggacggccacctgggcggcctcctcggcttcccgtaggcgatccgcggcttctcgccggtcagattcctgcctccgagcctctgtggtcgctgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgtgagggggtcggttaaacgaccaccttggaggggaaataaggtttccccgggatggttctgtcccccccgtcttgcggagccgtttcttcttccgctccccctcgggctgcgacgtcggcgtggccccctccgggcgcctgctgctggcacgcgccgccccgccccctcagggaggagatgggggaggggttccttcctgcttcctcttcccccgggcgtcggcagggcggccgctccccgggcccccgtcgcggggcccagaagcacgaccccctcccggggtagattgttcccctctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccaatcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactctagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggggttagggcgcaagcggcgaagacaaggggaataatagcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcatcatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccactcccgtctcggccccgagggccgaggcgccccgaccccttgtgggttttgcgccgcgtatatgaggtaggtgagcgtagcagggctcacctaaccacatttattgcggtttggacgagcgcgtcacgccgcatgtaacgcagtgcagcgcgctcgtttatccggtctgtgatcagtcacagaccggtcagatcatgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtgaagtaagaaagagagggagagatggtgcatgtggtatccccttgagatataaaaggaggaccttgcccacttagagaaaggggagaaaaaaggatcccagaacgattgggggctggctcgcactttgtagcttcttcatacacagatccaccaaaacacaagagtagggtattacgcttctcagcggcccgaacctgtatacatcgcccgtgtcttgtgtgatttcactctcgcgaactttccacagaccaagagcttagaacctcacccagggcccccggccgaaccggcaaagggaggcctgcgcggtctcccggtgaggagccccacgctctgtcagcgtgcgttcataagggtgagtgtgcgcgcgttatgaatgtcaacgttgtattgtgtaattctaaaaaaaattatttagagttaagagtttttttaagaaaagatatagccttacccataccaagagttatccgagagtgaaggcctccaatcctatgagatctaggccagaccctatgcaccgttttctattttttgggtggcgagaggacattcccactacaaccccctccagcggcgaagccaaggcccagcgacccaggcaaattgcccgggctccacaactacatgcaatcatgcccaatttcataatataagaatttctagcattgcccatattcatatagatattaatgaatctaaaaattttatgcaaatgtataaaatataaatcgcacttaaagtactatgagtgataaaacaacccataacaaaataaattataattacataaattttttgaataagacgaatggtcaaacatgtgagaaaaagtcaacggtgtcatttattaaaaaatagagggagtatatgtctagattcattaacatatatatgttgtctacattcattaatatctatataaatgtaaataatgccaaaaagttttacattatgatacggaggaagtactttatttattgttaaattttctccaggctcgtaaagatttctggatccaccactcgccccctccacgtcctcccttcagcacaagcaccaccgcaccgccagccctcttccagccatttccgaccactggcttgatacttccccactccccatcctccactgcctccttaggctccttagcaagccattattaccactggctcgatacccttagcaagccattatttttctttggaattgtggtgttttaagtattgttagtttgaatatgattattctatgcatgagaaatagttaaactatacacaacatagagtacacattaaaatataagagaaaaataaataaagttgctagagttggaaaatatttttaggtcctcaggaaattggaccagcccccattcccaattcagcctgaccttttcattttagggttatggacttttaaaacgagaggctgttgtctgagttgctattatgaaacacatcgatagtctccattccatctgtgcttgttttcgttgaaaaaaaataggtggacaaagagaagtatgaactagaaatttcaatgtttttcaatggaccgtatacatggataatccgaagaaaaaatatcttacttttcaaactgatcacaacgctgtgatcagagtatgctgtacaaacagggtaaaaaacacggtaaaaacacaacaatgtgaaaaggaacgcacagacttgatatatagtttcctcaggagtcctctgcgagattatacatttgacgaaaaataaaaatcacattaacggtaggccagttctaatctctctaaaccatggccacatgatcatcggcaaaagcttctcaaatataaacgagataaagagagcatcacatattacgaatttttacataaataccagggaggacgatccacagatggactcatctcaagcaaacatgaaaatggtaacaagaatgccctcagagctcatacaaatatccatcgatggtgcgggagacagcctcaaattgtgtgaaggatctgtgatgctaaaccacttcctgggatgatggtaaagtacacagccttatatttgagggcacaggttggtagctgcaaatatgcaggcatgggaatgatgatgtgtgcgagttggggatgaaaacggtcggaaaaatgctcaaaccatttccgttaccatatttgagagagagagagagagagagacgcacagagcgagagagagagagagatgggtacagcacttcccagaaagccaaacaccatctctgtatatcaagtttcatcattgggcttcaaatcaaagcatggcacctacgtagtgctaaaccttggtgaaactgccaatatcaatcaaataaaacaatgatccaattcagaatcgcaaatactggccaagcaacaacacaaaggtactagagagtagaaacacaatatgatattgaacagttaataaaaacaaacctacacaagcgacaacaaaaatgtactaaaagaaatgaagcactcattatgtgatattataacagaaaagaatgcaaatgatgagtctctcgtcaagccaacatacccaaacctgctggaaacaaaaaatagaaagtgtccattttgattaaccccttaacacttgtccaagtccaggaatcgctaactcaacaaaccgtggccattcaacattacccacataaatagtttctttgctgcctaggtggaggggccataccaaaacttataattatgtgctaagcagtgctgactcatcaacatgttcacttgtacacatttcaccagcatggttttgggcaatggggagtttgtaatgattttgatagatcaaagatgttaaacatgcgatatttgtagttttgggttgccgcgaatgttcaggtaaaatggccaatagtacaataaaaagaacattgacaaaaaaacttacaacttgtgcatgtgcagggaaactttattgatggcaagtctctctgatgcatttcattgatggcatatatggtcagtgatttgcccgctaaaacttatgcagtacctgcattccaaacagatccttcgatgacaaattccctactcgtgcatggattttgagggaggagagaagaccaagtgccatctatgcatattaagtttttattattaggcaatgcatttagatatgctactaccaagcaaagcaacattgtaaaaatatggaaatatgaacctgctggtaatcaagaccatggctatcgcaggctcttgattcatcgtattatacaggaggtaataaaaaaaggtggtaaactagatgagagaaggaatatcgacaagatatgttaacacaaaaaagagataaacaatgtagtggcataagttgaggtattttgaatctacgaggaatagacaaggtggagatatttgaattgttctgaacatcaatcactacatctgcagccatgatacattaagtgtgtacttgtttgcacggcaatggaccaactccgtcagatagtaaatttctgggagttacatcaggctattaaggagacacagagtctgagaggcaagcaacaaaactaaaagatccaaacaaaaagattgaaaggtcgatattaccaaatggccctctgatttcacaactttgtttttcatcttaggctggctaatgcggcagccctcaatgctggcactgaagcatgtctcaagggaacggcagaactggatgatgatgatcgatgacgacgacaacgacgacaactgccacagcagtggcaggagcggaggaggacgaagaagaagaagagaaaaagaaagaaagagagctacttttccaaagcagaagcagcagcagaaaccatggtcctgccaattgcgcggaccgacatgtcagtgtttctccaacccctgagcatgcttcagcgcccagatcattgaggagccaacgccacactagccattttcagctcaacccattgcagatgcaaagggcaaccccattagagctcaagtccgagccgatctatctatccatccatccatcaaccaatcgatttatcgattcacgagggtcttagtcacaatcatcattgggccaatggcgaatccaggcaaaaacgagagagatcagaggcaccatgccacagtgaaaacgaaacaagcgaaatgcataagagacaggtgcaccagaaaaaggaccatccatggatggactcatctcaaacgaactggcaaacgtgccataagaaaaataatgccctcagaactcacatacacagtatccattgatggtgcaggagacagcctcaaattgtgagcaaggaaatgtgaggctgaatgaattcctggaatgatgatggaaggttaagctagctagctacacatgcacaatcattggaatgaaccattccaaatgatgacatgtacgagagagagagagagagagagagaggagagagagagagagagagagagagagagagagagagaggacggatggatggatacagatcatacagcacttccaggaagcaaaacaccatctctgtaaatcatgtttcatcactgggcatttaaatcaactaaatcaaagcatggtacctgttattctactgcagaaggtactaaatttaggtgaaattgctagtctgaatcaaataaaacattggtccaattcagaatcaaatccagatgctctgcaaaggtggggaaacatatatgactacgtggtcttgaacaaggaaaacttcaaccaagagaaaaggaggggaaatcgtgcaagtgagaattttccttttttaaaaaggaaagtcataaaaaagaggggaagtcacgttcttgattgattgtatgaaggggattaagaaaggaagcaaatgagttatttctcaaaatatcatggctcataagtggatagtgatttggttttatgatatggacgactgtcatgaagtccaaaaggtaccacttcaatacactctggtttcttgaacaaaataaataacatggcaatgaaaaaaataacaaatgaacttatcacagtgtaaataaagtaataaactagtcaatctgcagaatgaaaaccctcagaagctctagcctagaaaaggtgtcgaacttatcacttggagcacaaacacaagctgacttagaataagtcaataagagtatctaggaaccgtcatctgggaagagttaaagagtcagctctgctgggtgtctatcagttaaaaatgagacgaaaatactggccgagcaacaaacagaaaggttagagtagaaacacaataaacagtttaacagaacaaacctacacaaaccacagcaaaaatgtactgaaggaagtgcaaatgaaaagcctctcatcaagccaacatattcaaacttgcagggaacaaaattttgaaagtactaagtccattttgattaaccccctcaactcttgctcaagtccgcaagttaaaaaacagtgaccattcaatatttgtacccacgtaaatagtttctttgctgcctaggtgtgttttgagtatgatgtgaggagccatgcaaatttttattgtgctaattgagcatttcaccgggtccactacgtccatttgtacgcatttcaccggattggtttcagcaatgggatgagttgcaataactttgatagttcttgaacatgtagtttggggttgaccaggaagttgaggtggtaaaatgggcaatagtagactaaaaatatcgaaaaaacatacagcttgtgcatttgcaaggaatgttatgccctcaagactcacttatgcatttcatttatggcaacatatatggtatctgattttcccgctaaaacttagcggtacctgtattccagacaaatccttttgatggcaattcccaactgctgctgctgctgctgtcacatgaggggggagatagaggggggaggaggagccgaggaggaggaggaaaccatgtgccatctctgcatagtaagttttcatcattgggcaatgcatcatcatgctactaccaaccaaagcaacatggtaagaaaaaaaataatatgaaccagatggtagtcaagatcatgcctattgcaggctcttgattcatcacattatacgggagatgataaaaaataataaggaatacaaaatgagacaaggatgaaccagaacgtatgtaacagtatgatcctaatgccctctggcttaagacataaatgcacctctgcatttcaagatgacacaagagacgggcatccaatttgtaaatcaaaattagaactcgacgaggcatgttaacacaaaaaacagaaacaatgtagtagcataagttgagatatttttgcaattgctagcaatagacaagtggagagatgtgaaccgttctgaagatcaatcactcagacatctccaaccatgatacattacgtgcgtgctgtttacacggcaatggaccaatttcgtgcattacatcaggctattaagtagacacagagagtcagagaggcaagcaacaaaaccgaaagatccaaacgagaagacagaaaggtctgtattaccaattggccctcagatttcacaacttcgttttccatcttaggctaatgcggcggccctcgacgctggcactggagcatgtctcaagggtacggcagaagaggacgatgatgatgatgcacgacgacgacgacgacccgccgcagcggtggcaagagaggaggaggaggaggaggaagaggagaaaaaagaaagaaaaagagcaggttttatagtatagcagaagcagcagtaaaccatgttcctgccgcgtgggcgggcccacatgtcagtgcctctccgacccccccagcatgtttcagcgcccagatcatcgaggagccaacgccgtactagccattctcgggacctcaacccgcttgcagatgcaaagggcgagcctcaaatccgagccgatctatctatccatccatcaaccaaccaaccaatcgatcgattcgcgagggtctaaatcgcaatcatcatcgggccaacggcaaaatccaagcaaaacgagagagatcagaggcatcaagccacggcgaaatcgaagcgagcggaaatgcaaagacgagacggtaggggaagcggatacgagtaaacctcccgccgaagcggggccggaggccggaaccccggttgatcggatcggcgagctccccgtggccggcgggggctccggaggatcggagagcacgagggattgcggcctctccgcctccgcgagacaacccgaaaccctagttttgcccgtgctctcgcgttctctcccatctctcttccctcttcccggttgctgcctttcgaggctaccaatggcgcgactcccaaagaaggcaaggccacgcggcagccgcatcggcgcggtgtggtcatgtgggccgggcctggttcgacgtgggcggaagttttagcccatctgtgtttctatatgggccgtaaaatcacctgggtcatcgtgtgctcggcccatattgtctccaagagctcccctaccagcgattacaggcttacagcgtgtgatcatggcacttctatatcctatttccttcaaatttaaaaccgggtaggggtagtgtcactaaactcgtatttggatccgtgggtagagtttgatgatttttgtttaaacttgtacttgaaaaaacaatctatagggagtagtgaacaaagtctgtgaaaatgaagatatttacttcatatttttttagctccagtgcttctaaaagagtaaattatatccatggtatatcaatttggtagatagatgcaatttagtacaagaacttgagaagtgagcgttgtagtgcaacaactaattaatagataggtgcgatttagtgtaaaaacttaacaaattgtactaaattgcatacgggtgctacaacttgcaaggtgcgtgtgattatagtacaataactttaaaaatatatgtaacaacatttaattattttgatcattttttaccataaatattcaaattttaggtattaattttttaatatactcatggaatttgtagaagcatacttcaatttagtcgctctagtaactaacaatcaattaaattttaatatctaaataatatgtattccggttgagattttaaaaggtgaagaaaaaaaatccaagatgatggtgtaaatcggatgagaaacataattcttgaattatagattaaattcaaaattataatggaatatccacagtattgctatgtgatggcatattttcatattgatatcataaaaaaaactcatctagcatttattgaccaaaataacatatagatagccgagttactgcaccaaaatagtaagttctcaagttggtacactcatctagcatttattgaccaaaataacatatagatagccgagttactgcaccaaaatagtaagttctcaagttcgtgtaccagacgcactcacttgctaagttattagggcatccacaatgtactccaaaagtagtccataagcaatataatatttgattcagccacctagcaacattgtgaaactagtccatagaaaagaaataacaaaagctacccataagtatatgggctgcccatagagaataaaatatattatttgtctctatctcttctctcctactaatactatttgctatccatatacattatgaaggttacaatagttaaagttcatatatgtgggtcccatctctatggactacttttgccatatacattgttgttgcccttacacttggacgctcaattttgaagttattgtactaaattgtatccacttgccaaattattatacctggagtgcaatttactctttttaaaatatttgcaggtccattgctgcttcactcactcatcagtcatcacgaatccatatcagctatttatctcaaaagaaaaaagaaaaaagaatccatatagctaccgagcccaggttctacccgctgaaaaccagactcggtaaagccattggaggagaaatcctattctcttccacaatccgccggtatatctccattccagattcgatctgtgcaagcgacacttcttacggcgcgtgactgcagccacaatgcgaaagaagaagggatcggattacaccatcattactcgtactatgggggaatccattacgcttctcctcctcatagtgggattccgccgcgtcgtcccatcatgctgtccaacgattcgatccggcaaagaaaagcgaagggacaaagaacgaaattgttccacctgaattatagggaagtaatgctctttactatgctcgcatctacaagccactctccagtctccactcaactgaatagacagagagatgagattttattctttgcttccctatctgaatatgcagtcacaccatgtttagtttttaaataattctttaaacttccaacttttccatcatatcaaaacttttctacatacaaacttccaacttttccgtcatatcgtttcaatttcaaccaaacttttaattttagtgtgaactaaacacaggctcaatatcatttctcatgtcgaataaactggtggaaaattaactcgcaaacacatagtagtactgaagaaacttcatcaagaagtaataggactacgagtaatgctcccttaaaaacacctgatttgatggcctctccaattacgtgccacccagcgacgagatcacgagaccactcgccctgcacaaggcaaagtataggcatcagtgcatcaccatcatcatcagatagatatgcacactgtcaccattatgggaacaatgagaacggggcactactgatttgcacaaagaattactccaccatgcaccacatatattcaattattttccttcactcgtgctctccaagcatgccacaacaacatgttccatggaagaaagaaggaggatttcatttcggtttccagtatgatgtgcattccagctcaatcacattctcccatcaccaagaaaaatactcattcttctcatccagtcacactcatcatgggtccgtccataagtactcatccttttactattttaattgctcctcctagctgtactactcattgttgtcaccacagaaatgtatcttcttcctctccaatggaaagagctcagcttaaagagagctaagacacccagctttattcaggagataaaaaagaaagaagaaagcacaggtacatgtgcaatgattctcccattagtcacaaacactgtatttcgcgcggcaagcaaggggacatttgtaaatgatgccatgatgatacattgtggttgtggcaaaccttattaaaatggtagtagcagtagtagtacaaagtagtaggaagagtaatctgaaaaagaactaggaaggctccatcatgtgagacaagtccagaacaaccggatgcaagcatgattctgatcttatagaataatgcaagcacacatgcacaacagcacaaatagttgtaaaagaacagccttgaacccacccgggcacaaaataagtgaagcactgaatctttcccttttctttaccagaacacggcatccatgcaaagcttaacaaagacatgaacggatcctttcagcttaaatccggaaccgcatgtacaccacacaaatggaaaaatgcaatgcatgaaccgctgtcccaaaggaaacctatcatggtgctaccaggtgaaacatacaggctgagaaatccagttccaggctacaagcagaaatacagccaagacgacacaacaaaatgcaaacatgatctagagcccttgggcattacatttctcaagttgctctctgttgcatttccagttctgcctccattagagctcactgtttccctcattcgcaggccagttttgtgtcgaagctacttaaacatattgcaaatgcctggaaagctgagagcggatagcggtaatccattgtgaacatatcttttgctaccttaccaaactgtagaataatcttgtcctgctctggtggagcaggttgtgacggagttggagcccctgcgggaggctgtgctggtgcagcaatcaactggaaattctttaccgacgcaatggttacacgcccacggaaattaaggcaccagcattggagctgctcatgccacctaggggccttgttgcgaagcactagtggcctctccttattttgcccctcttcatcaccatttatggtgcctccagcaatgtctgaaaagcgagcactgctgaaatcacgggaactactgaaatccatggaccgatccatgatggatgacttagaaaaggaggtggtgctgcgaaatgactcctcgaaagctcggggaacaatctgctcgggctggccagggacaatgccaccaggctcgactgaggaggcaggtatggagtgcatgacacagtgcatccgcctagggcccctggtgccaagaacattaagctcatatgtcacctgagctatgttataactaccagacggcatcttaggagacactttcttggagttgaatcttcggctgctccgtccaacaggagggattacagccccattataagagggctgtgtgtcatagattataaattttgtgccaaggaagtttgacctaaaaatgaaagacacaacaaggttggtttgtatcatcaaataaatggagcgaaaggaaaggtgtaccatctgcacacaaaacagttaccttagttttccaatataggtgctgcttgatcttgaaatgttgtctgcatccattgagataacatattctgtgcaggttgttttgcggtgccttttagcggacaagaggaacttgccactatccgcaagtacagctgattaacaaaaatcagtagtgagccaacttattcaattcaggtgaaatcaaatttgccagttgtttaaacattccataacaaaaatatttggagaaaaaaaaccatgtatgtgcacacataaatgagggataaaaatggtgctagatggtagtagatgtttaaccaaaagataaagccttgcaatactgttaaccaaattaagaaaaaaaatctggtcgtatgagtgaaagaagcacaagacataccagtactcaggcacaagtagagatgataagttgatttagatttatcccgctttatgaaacattgaatcattccatctcgagggccaggctgaaagtcaaaacaaggattatgaatttgagaggaacaaatgaataagcaacaaccacacttgcaggttgctatcactaaggtacgaaaatataattcttaacaacagtcagtttaagttctgctttcattacaggatgtgaaattttacctgctttagagagagcgggaaggtaagcttcccgcaaaactccgggctcagcacaatctctttacacatctccctccatgccttacagacggcagcacaggacacgacatccttgcgtgacggccaggtgctctcactagcctccagcctccggatcacatcgcggaggagctcaggagggaggctagcccaacgactctcctggattatgagatctgcatcacagagctcgtgaaccgtactctgagacttgcctctatggtggccggtaagccccgatagaccagccagggtgacctcaaagcttcgcctcgacaggctaccaaaactatccctaacatcacgaacaatgctgcgaaacgacatctaggctcgctgaattcagcaaactgaacttgaaacttagcctgcccaatatattatcagcgaagaccaccgacaatcttcgcagctgtgtttccacttatggtacaattggccacagtcccagatcacgctgacacggtaagaattactgctttagttgtgttcacgcacaagcaatcaacaatctatacctgcgagaagaaaagaatcttggtgagaaagcgtgcgaatatatgctaagaacagcgaataataggccaattccaagtatagctcgcaacgactaaatcagagtttgtgaaaaacatatcatactagcaaacaagggagttgtggagagagtaaacagcctatactttttcaggggcggatccaactagggatatggggtttcagttgaacccccaaatttggggggggggggggggggggaacaaacaacaaactgttacttgtattaaggttaaggctctgaaattaagagaagagcttcttcccagatctagaagagaagctagggttaacaaacgcaaggaaattccacacaaaagaactcccggtgggagagagatgcatcagaaagaggatgtggatgctcaccaggatcccctcccctgctctgctcgccggatggagatcggcgcccctctcctgctcagccgcgactcgtcttggcgcaaggaagcgggggagacgactgagagatgggagatttctcgttctcttacgccaagggaaggaacggggaagatactcgagtactccaccagacaccagtccaccttttatctcatttttttcacattaccactagctatgttattcaatctttaggatgattttgtagctcacatgtcgatagtacttgaaaaaaaaaaatacaacaaacttagttaggaattatgtcagacagcaaactccttaaactaccgacaaccactggttatcactccacacaccactaccatcgttttttctccatgagccaccatcattccccctctccaccttcgcatgcgcaaccgtaccctctagacatcgacatgtatcttctcctcctcggtcgtcatgcacgctattgtcacggttgtcctaaaggccgatggtgtcgggtttgcagggactcgggaaagcaggagccgacccctccttgctggatctagcgattccctaattgtcggagggaaaaaaaaggagagagcgagagaattagtgtgtgaaaagcatgagccgacccctctttgctggatctagcggttccccaattatcgaagagggggaaaaggagagagagaattagtgtgcgaagtagttgtagactaactggacttggaggtggagcggcggtggagttatcggatttggaaatggatagaatagggtggtttaaattagaacaaaaatataaaaatataaagttagttgttattaaatggaaagaatggttaaagaatactataatatgaaaactttaaagaacacatagcacttaattttttttctatagcacaattgatgagttgtctattagctgatagtctcgtgctatactaagcacattatagctttatcgtctctgtatagtatggctagaccggtctacttaactactaataataatctcatgatatgttgatacacgacgatatgaacttctgctaaccaatgcgcagagtcagaaatttaatcttgtgggggtcaattactagtagtttgtatttaagtaggaccatttctcaacaattttgaatttatacatggaaatcaaggtttatggggtgttttttaaaaagctgtagagttagccgacctcatagaatatgtctggatacgccactattgctaacacaggttgattaactatggttagatagatttggctataaaagaaaaaaataataaccttaattttgcttgatataaagcattcgattgtggtctcctcttctcatgcatgatatgggatgactatatcttatcaatatgtatattattttttacatatatgttaatgtggtctaatatttttctcataattaaatggatactaattaaatagatactccctccatcaacaaaagttacacctatttcacatttgagtttttccaaataagttgtttctatttgtactcttcatgtattcaagacttaaatgaagagataaattaaatgttttattagaacccaaggaggcatctaaatactcattggttacatgctttcattcactccttgattttgtagtatccaatgtgatttaatttctccttggtcttggtgtcaaaagtaatatgtgtaagttttgtggatggagggagtagtacggaatagatagagtattttttttatatttctcctactccctccgtctcaaaaaaaacctgggtttccgtgatcaacgtttaactgtccgtcttgtatgaatttttttataattagtattttcatagttgttagatgataaaatatgattaatattttatacgtgacttgtctttttaattttttttcataaatttttcaaataaaacggacggtcaaacgttggacacggaaacccagggtttgtctttttttttacggatggagtacaaaatatgaatagtgcagtaatttacatgttcaccgtgcctgcaacggcacgtaaaacgggaccacacagattaccccttttaggttgtgtttatttcagcgcaaagtttggattttggttgaaattggagatgatgtgactgaaaagttgtgtgtgtatgacatgttgatgtgtgatggaaaaggactgatgtttggatctttggatctaaacacagccttaacagttttacagcagcaactttaggcacaaagcaacacatgttaactttctctcacatctgtccttttccgtgcagtgcagcctgtgcctgtgcaggcatgctctccgttatccgagaaggggaaaaaggtgttggaattaatagatgggctaaggcccattcgaagattaattctttgaaaaatcacaaaagcccacctcatgggatggtatgcatatggagtttagtaccaccttacttattctaggagagggggacctccttaaaagggaggatgcccttctagccacttgaagcatgtgtggtggagagaaggggggaacacgcacgcgcttgcctcgcctggcagggcaggcggcgcgcgtgcatgacgtacgcgttgaatggtccgaaaaattggctcctcacccttgcgcagatgcagcctccttttgcagttttgttttgctgcaggaaaattcggatttgttttgttgttggaaacattccgaaaaatccggtgcgtgaaaacggcgtggagtccggataagttacacggataagttcctgcaccgggagaaggcggcaataaggtttttgggaagcgcttcgcgcgactgctccctgttcgtccgcgacggctcgccttcctctccattcgcgtgttgcgcgccttcgtcgacgctcgcaaccgcgagtagttcctgccgagcaaccggtctttccgccacctcggtacgtgtttgacatgttgcacatatttgatctgttcatgttttactgcttagtttacatgtgtagatctaatgatgcgttaatgatattatacatttgtaatgtcatgatttatttatggaatatattaaatcattatatgcctatattctcaacaatccaaaaaccttattataagcgctgtgattttactatggctggttttgccgatgcactgaggccggataaatttaccggtgtgcactttaagaaatggcagatcagggccactctgtggctgacagctatgaaatgcttctgggtgagtactggcaagcctataggcgttcttaatgctgatcagcagaaagaattcgatgaggccactactctctttgtgggatgcattcttagcgtgcttggcgatcgtctggtggaggtgtatatgcatatgaccgacgctaaagagttgtgggatgcactgaatactaaattcggtgctactgatgctagcaatgatctgtatatcatggagcagtttcatgactacaagatggctgacaaccattctgtagtcgaacaggctcatgagatacaaaccatggctgaggaactcgaactccttaagtgtgtcttacccaacaaatttgtggctaggtgcattattgtgaaattacctccatcttggagaggtttcggtactgcactcaaacacaagagataggaatactccgttgaggggttgatagcgtctcttgatgttgaggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3074 - DNA, 740 bp, Oryza sativa
acaacagggagtagtttccgcggattgagaagccagatattcagggcgagtggtggcgggccggaggcggaggcggtcggatctgggagagggggagcaacgaagggcgaagacagtaggggtctttgtgatgaaaatcaggtggttctagggtttctgtaaggggtcccttgggccggtattgttatgggcccgatggctcatccttagcctttcttgcaactggacggcacaaaaaaaggaaaaagcggcgaaaaaaaagaaacagacgaaaataactactggaaaccttacgtattttttgattaggtatagaaatgaatggctattgcaacaagagtgaaatcaaggaatacttacctttattggagcatcaaatgacttggcaacactgaccataactggagtgaagaagacccagaaaatatcatagaaaaagagtccgctctgaattaaaagggaataccacgatacacaaaagttacaaattaaaaatgctttacacaatacggtggtgtatacaaatatggactttaatttcgcaagcaaaagaaaggcaaccataaattatagcatatcagaaaattcaaattatcattgccatgctccactagtaatgattttgatggctgaaataataaaaggtgctttgacaagtaccaccagaaaatataagttttagttcatacaaacaattcataccaagagaatagcaccacgtttgaatgatacaagtgata

SEQ ID NO: 3075 - DNA, 36816 bp, Oryza sativa
  unsure (1)..(36816): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacatggggagtcctaggggatttacgtgccattctaaagcctcagcagcaattcgacgttcatgctcatccttccaccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttttatccatttgaacttcgaatagatgaagcatacctgatcaaagttcgcgcattggaagaatctcctgccccgagtttgtatcatgagggaagacttgagtatgcatctatccccactatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcatgagcataagttgttctagcaccatatgaacgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagttgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgccgttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgcgagaatggaacatcaagttacgacggggtgatgtttttgtacaaaaacagaaacaaaacttaagaaacctctgggctgagcagtaccgtgcgaaacaggtaccgtaggtcgaggtcctgctccgacggtaggcgcgcgaggccgtggttgtaccggaccagctggaggtacgacgtccacggcgctgcgacaggagaagatgcgcatgaccgcacgcatcttctcctgcatccggtcgaaggtcatcctctgctcaacgtcagtcaagtgcaaacctctgttcaacctcacttggactgcggtgatatcggcactgatatcccgtgcagcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcgcctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcgacatggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaacgacgaaagtcctagcggtgctctcgcagcgacggcctcttctgtgtacggctcccaaatgacgtcgctcggctggagacggtcaaactcgaacacgaagtccgggtaacctcgtctcacctggacgtgagcgtaacgacgctggaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagttatcattagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagcacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggttgtccgccgccgcctcaacaagcctacaaagtggtagaaggcctgccgcacgcaacctgtatagagcaaacttcaaacataagtacaacacaaagcaaagttgagttgaaatatgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagcgaattactaacacatattaaacaagagtacaaacaaacaaaagtgtcaccatacggaatatttctgattacaacaataactgcagttacacgatatgagtaattagtccgaacactcatcacgataacattatgatacaacaccgaatagttcgcaatactactagtacaacaatagtcggaggtactcattacaacaacattcaattgaaattacacgatacaagtatttagtccgaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatcaatatcatttctgatgcgtctagtttggcgtcgaccctttttcacccttaacttagatggatctggaatgtaaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatcactaaagtacgcttgcgtgccgtgaaggatgaattcaacaatagcaaccaatggaagtatccgaactcctcgcattacccagttgtacacctctgccaaattggttgtcattatgccataccaagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggattctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtacaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagtttcaaatgtgccatacctcatctcaataatcttttgtttggctctccaggcctttgcatagcttatggtgtacttgaatttgttctcgatgtgcctaatagttgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcatcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcggccccccgcacagtacaaaatcgccctagcggatggcggcaagggggccgcctgcaaatttcgttgacggccgtcgcccgagagcgaacgggcgtctgccacgtcattttcgccgccctctgggatggcgatttttaaaaatcgccctcccagagggcggtaggcgaccacttccgtcaatttttaaaatggaaaattatttttgtaaaacttttaaaaaaaaaaattaaaaataaaaaaaattcgctggatagccctgctagaatgggccaaaaaagcccaaattgttgttggctggtccagccaaaaactctggccttgtagtggtaggccaaagcccaaatgggccacattgtctgaccacagaggctgtttgctactgcttttgtgcctacaactttgcattttgtggcatgcaaaaattaataaggaatgtcactctaagaatatcagtattttaggagttggtacaatgcatcttaaaacgtgtcaaacagtgaggctttatataactgccctactgacttttttatatagtcgagacgttgtttgggtttataaaacaattgattggatacaatatcgttgcttttgctccgtaagtgagcatttttattgaccattatgtttaggattgatctagagacagaaatatactactcccttcatttttttaatacttatatgacaacgttgacttttgcaacaatttataactattcgtcatgtttaaaaattttatacaaatcttaaaaattataagtagtgtttaaagtttctttagtgataaatcaagtgacgacaaaagaaaatatatttacttaatttttctaataagacgaatggtcagacatgatgtaaaaaatcaatggcgttatatataaaaaacggtggtagtatggatttaaggtgtaatatttaaaaactagggggaaaaatacggcataaatattgatacaaaaccttttgtgatagatttgtcaataaagcgagagtcttgtaatactatatgcttgaatcgactttaccatagtttatatcaaagtgcaattttgtgaaatctgctcttaacttcaactaattttgtttgaacaactcctaattcaatgccgaggtatcaggaaaaatagtcgaacaagtcagtgttacggctattgttgttctagagatatcagcaggcatcaagaaaaaattaaagaactgctgctgattgcaagagaccaacacacacaacgataagtcgataactccataacagtggtcaattttaggtaactaatactattatcatatatcatccatgttgaaccctgtacaattgcaaccaacctggagactttcagagcctcatcggttgctggcttattaggaaacaaaaattaatttataatttataggtaaaaattttatatatttgttcgtagcgagttaaaagccaacgctaattaaaaagaaattatgttgaaaaatatcttaaaattaactttaaatatttaaattttggtttttctttgacttgttagacccaccgatagactctcaaaaagaggcacagagaaatctagagagagatagatggagttgcaacttgcaagcttaatttgaaacgtagtccaagcacatgccatggaccgaggaggaagaagaagacgacggcgaccaaagttagaataattaacaaaacaaatctacgtcgtcctactcttctagcagccggtggatccgtcgtccatccagtaaaagcacgttgcattcggggatgtttaggtcccatcccaaaattttacacctgatcacatcgaacgtttaagcatctatataaagtgttaaatataggcttaaaaaataactaagtgcacagattgcaactaatttacgagacaaatttttttaagcctaattgctccatgatttgataatatggtgctacggtaaatatttgctaatgacggattaattaggcttaataaattcgtctcgcagtttactaacggattctataattagttactccctccgtcccaaaatataagcgtttttagttatgaatttagacaactgtgtgtccagattcgtagccaaaaattgttatattttgagacggaggtaatattttattagtgtctgagcacctcatgtcataccctatataattcctgatgtgatacgtccaaaatttacacccctcatctaaacacctcatgatcgattgatacatgtcattggtcagactacgagagtagactgagctgtcagtgccaacgaatagtctgcaactgtgtgtgatcgatcgatatgcaatatttttgcatggccatggatgatggatactaataaattgactcctgatgcgttatgaactgccgtcctttgaccaaactatgccctgggctgcttgtaattgacttcgaattcgatagatcgattggttggttggtttgattggctgtgatcactagcttagcttcaccgtcattttctatgtgcgtgtatgtatcactagagatctctccagtccctatgtgtgtgtttctcgttgcattcatgttggcatgttgttgctgcctacatagttaatttgattgtgattggacgaattaatgagctaggatttctgcttgctttgtgtggctaagctaagtgccgggatcagaaagggaaaatgaaaacgagagggcggatgattttccattttattagtatatatacatgcatgtgtggcagtgctttatgcagaaattaatgctactgcaatatatatgcatattgtttgtatttatatatccccttgttaaatatagttaatatgattaattagttctcttttatctcatgaagctacgttatcgtacgtatcgtcttaatattgtttttatctttggacaactgtacgaagcaaattgtctctcatgtctcctcaattcatctctcgtagaacatctcaaatatcttttagcatatgaataattgatcagatacatatatatttggatagtcgctgtccagattcgtaataataagattcatatcatgtattagatttattttttatagaatggagagggtagttggtagtagtactatactaggaattctttgtgccgattttacggtgcttggcaggacacatctccaagccatggtctaaaaaaagaaataaagctctattctttttgtgaacaaaaaagaaacgtaaaatctaaactgagaggcctatctatttagtcttaacgggagacaccacatacatcagagaaatactacacatctatatagacatgcatgtatttttttccttcttataaaattttctctcaaattacttatccgatctacaatctgattacaccattgtgttcgttgcaattaaaatctttacaacaagatcttacatgattatattacgatgaaaaaatatttatgtttgtaaattacttttattatatatgtaagttacttttgttatatatatataaattactcttagatttgattaaattattatataaaatatttattgtttttagtcatcaattctataatttgtgggctttcaatttaatttttagatagaccatatttttctccctacaatgagtttacttctaatattgtaacaatttacttttattttgtgctaagttagttttatgattgatgtaaattacttttagactttattgaatttactttcataaatgtatttacttaaaaatcttctctacattttgctcgtgaatttactctctatagtttcttatttcaactcaatcataatgtaattactatagatcgttacttctattgcatagctaagttttacgcattacgcattaccactgttgcatccaacatctcagaacatccccaatatattcttatcgacgtaaaaaataaaatgcaacaaaaaaagtatatgacaatcaactctaaaattaacatttagaatttaaattttggttgcaatttgataagctgaatagttaataatggagctgtatttgaagaggaaaaaaacaaaaggttctcttcaaatgaaatgctagtgtctttcattccttttacctccttaaacatgggcatgatgcataatactaacgcatattaatattctactcccttcgggatgataatattagttgttttaaacaagggtaaagtcaaactttaaaatctttgactataaataatttctaaaatatttatcttaaaaatatgaaaaccatatgtgtagattagtcttgaaaagtacttcaataaaatcatatatttcttgatatttctatatatattataatagaaaatagttgtcaaagctacgttttgaagaccgtgcccttatccaaaacgataagtattatcaaccgggagggagtaattaaagatgattcttctagtatgtactgtatataacctggataaagctaagctagctagtgccacttgttagatagagaattctctctagggactatgccatatctctacccctatccatctctgtaccatctcaatagtttaattaaccccaaatcaaagcaacactatccaattaacttttcccttctctctgatgagttcaaacttgcattgtgggcacacatcacatgcccttgcacccctcaagagaagcatgcaaacagaaacaaaaaaaatggattcataagcattggtaaaaacaaacaagcaaggactcaaacaaaacaaaataaaacaaaacaaacaaccgtgtgcacacacacatgccaacacacccggaatgtatttcagattttcagtactttcagtttattactccgtatcaccttctctctctctctctgagttttgttttttgtgcattgtgatgtgtttgtcctagagggtagtagagagttgctgccatggggaggagcaagctcctagatcgagtagttggaatccttatttgaaaagaggatttcaaaaagggagtagtaaattttaatcagattccgtgtgtacgcagggacgcatgcaggggttgtgaagctcaaggtctaggcacggttttatatatatttgaatgacattgtaaaagggtatttgcgcacacgcattcgtgtacgtacgtatgtgtgacgctgttgttggactgtgagcaagggagtacattcaacgcagcattgctattggtgatggctggctatcaaatcaaaaaaaaattaaccattatatatcaatatatgcttgccgcttattggcgcatatatcttcatgttgttcttttgtgctggatggctgaatctcagaatgatttgtaataatgatggccaaataaatgagtgaactattatcactggtggagaaatgttttttagtcccggttcgtaaccccctgtagtcccggttttccaactgggactacgaatccgggactaaagatcgctatctttagtcccggttcaaataaccgggactaaaaattaatctttagtcccggttggtaacattttttctttttttttctgcttttaatattgaatattgatttcacaccatcccctcccatatccaaatcatcacatattacagaacatctccaaatcctcaaacaaatcatctccaaatacatcacaaactcttaaaaaaattacatcacagggttctaaaaaattcatcacagattcacatctcacacaaaaatacatcactgttcacatctcaaaaaaaaagaagaaaaaaaaatctggccggcagccactgccgcctcccctcctcccctccgctccggccggccgacgccgcgccggtcgccgccgagcggtctgccaccacagccgcgcctcccgcggtcccggcccgccgtcccgcgccggacgcccaccgccgtcggcgcgcggcccccctcgccggctggccggccactgcgcaggccaccttcagaccggcccccgagtaaccgcctccgcgccggccgcctgcactgtggtgaaggaaaaaaggaaggagaggaggggagttagagataaggaaagagataagaagttagagaggaaaaaaagagatagagggaggagtttgttgtgtggacgggaaaagaggatcggtactatggattatatagtgtgttttgatttttattcccggttagtaacaccaaccgggactaaaaactaacaccaaccgggactaattggtgttactaaccgggactaaagatcatagggccctgacacggcctgacatggaatcaaccgggactaaaaataaaccaaccgggactaaagatgatttttagtcccggttggtaacaacaaccgggactaaagatcttcctcttattaaccgggactaaaaatcattttgtcccggtttttaatggaaccgggactattgtggattggggtcgaccgaccaaagatggtttctctatcagtgtatgaattatgttgaaaattggactttaaaacagttttgcaatacatttatatatagaaagcattctttaaatcgtactgttaattagttcggagaacatgcctattcatccatttatccgttaaccagtaaagaatatggcagcaaggttaagatgatatataaaattgggaaaaagtgtgtgaagcaagtttaagtcgtttggagagggagactcgattgggtatttaagggaaaatttcacaagattaatttttgaataaatttctaccaaatttggacattatttaaagaaaccttcacgaatagtacgaatttaaattgctaaggtccaacatattaagaccgtatcttgcgaccttgtttttttttaatagaaatgacttataaacccatcaaatcctgaaccaatcttccattattagagcagcgaaattcgaattcgggtaccacaaatgtgcatatggatacatgagaatcatagtctaatttgaattttcaaagtcgattttatattactcttgatgtttttcccatcgtttttcacttttcatccctgacttttaaaccgctgaaagtataagcataaaaatcctattgtagaattatttttcattgctttggtcacatattatggcctataaaccacagccaaaagaaaatctcagccttcagactatttaccattaaaaaggataatacaatactatagccaatttagagctcagtaactatacatctggtccatcaaccataagcagctggctagcaacctaggagatgaaaatggtgacggaattttcagattggtttctgtaaaagtggtaccattatcgccagatttgaatcctagctatatacatagaatttatatcctctaatttttcatagaaacaatattgtttctggtcgtttataagcattttgatcccaattatagcacacacgcatgaaaatttagtaatatattctatccatccaaaagagttagatatattacttttatcaccatgaccaaaactacatgtaatgtaacaaagatcaaagaacactctcatcggttcaatgttgcagaggcagattttcagcaaaagtccatcggttagcttattgggctgattatgcatcagccattggtagtgggaccaatccttcccgacacctttctacggccacatcgctaggagaccaacctcgattccccactcccctctctcgaaccctacctctcaacgatcaccatgccacagaagatccactaatcagccattactctttataagccaaacgatggaaacgcttataccgataaacatcagtctgcttatgctgaaacgcaacaacataagccaaccgatgaaggtgtaagtgtatataatgcaatcgatgagtattgaatgtgtatttgggttccggtaaatcatttaaatttcagatatatacatgaaaactacaaggtatgacccatttactttgaaaaatcaaaatataaaataattctaagtcttatcggcttgtttggtaactcgagggaaggggattgagagtttacacaagggaatttatgatgagattaagatgggaatttgatttttaatcccagtatcttgtttggttggagtgatggaaactgatagggagtttagttggagattatgtcattaataaaaatggatagttgagatttgcatagacaaagtaaaggaggaattccctcccaatcacctgcccctacccaggtattgaaaaggagggagttccttcctcaattccacatccccatccccatcccaccaaaattctcatgtctcctaaataaacatgtggagattatggataccctatatctacatggcggtcatattctagctgggtacaggataccgaataaagacagaatatcttcatgaggactcgggttagattctaaacttgtatgtcaaggaaatacccgagatcctagtcggttacgattatattttatctgtaattccatgttcttttaggatatggactgtattttgtaaagcggaccccttcccctatataaggaggggtccggatgcttatcggggcacggttttttgacctagattatacaatcaataatacactcggcggaatcatccccggacaggagtagggtattacttcttgaataagaaggcctgaacctgtataaaattcttcgtctccaaacccatccactttcctagcttgatagccacccccttttagtattgccgaaatcttgtttcgacagttggcgcgccaggtaggggtagcgtcaagtttttaccggctaagtgcgatgggttccgtttctggcatcgacgacttcgccttccctcccggacaggcgttccggttcggcagcctcaacttcatcaccaacgacttcggcaagatctctctcctaactcggattcgaactagtcggggagagatcaggtccccgcgccgttcggtattccgaactcggccgaggcctactccaagatcatctctcccgagtcggcttcaaaccactcggacgagatctaatctactcctccgcgaccagatcaagatgacgggtcctatccctcaatcctgataaaacttcctgatgatttggccgctgtcttcacagccaagacatctcctgctcgaagatctaggcgagctccggcttcggccccgatccgatctagatccagggaggttggcgttatactccaaccccttgggacagtctcgacggaagagttggatggctaccttagctcccccggtgtcagttctcgaccaaccgagatcctcgactacgacgacttcggctaccactacgaccacgacgacttcgacaacttcgacgacagctatgaggataactacacgcctctcttcttcggcgtattcgtggctgacaacgaaacggaggaacaacgccgagcccgagaagtggaccaagagcgcgcatggcaagaaactgaacgtcgccaactggaggaagagcgacagcaacaggagcgagaacgactacagcgtgagcaacaagatcgcgaacggattgcaaaggagggtgaagatcgacggcagcgcgccttggaatttgggcgacgagcgagagagctcattgggcaacaagacgtcgatggaacagcggtttttcgcacccccagcagaacgcggttgcagcaatcactctcctcgacaccctcctcaaggaagacgtactcaatcaagctgatcatgttgtaaacatcttgaatcaaacgaagaccatgatcgttgcttcgtttccagccaactccgcaagcgcccgcaccccgactggtagccgagtccctcaccttcgatctcaggactatcaccagccaagcctcagcattgacggcgccagatctagtcgcaggagcaggggacatgatgaacggtctgttcgttcgcctcccgaacgatacagggagcgtcgagttgaacgaccacactccccacatcgaaggcgccccatcgatcttcgtgacaccatcaaccagcaccgcgcagcaagaggccatcattcaccggatcgctacgacgacgatgtggacggagttgctgccttcacaagcgatctgcgtcgagtggattggccagctggctttaagtcgaccggaatcgagaaatatgacggcaccaccaaccctgagtcttggctcaccgtctatggtctcgcaatccgcgtagcaggaggagacagcaaagccatggcgaattatctacctgtggccctagcggattctgcccggtcatggcttcacgggctaccccgcggcacgatcggatcatgggcagagctacgcgaccacttcatcgccaacttccaaggcacttttgaacggcctggtacacacttcgatctctacaacatcattcagaagtctggagaatctcttcgagattacattcgacgcttctctgagcaacgcaacaagatctccgacatcaccgatgacgtcatcattgccgcctttactaaaggcattcgccacgaggacctagtcggcaagttcggacacaaacctcccaagacggtcaagcagatgtttgaaaaagccaatgagtatgccaaagccgaagatgctattacggcgtccaagcagtcgggcaccacttggaagccaaaaaaggatacgcttcgcctgctccctccccgtgtccattagggctcctgtccagagcgaagagaaggcgaaaaagcgccgccgaagcagcatgagcaggcttgtattgctacgcaacaatagagcaggagcgccgcccacaaaatgtttgaatgatcgggtaaagagcgagcttcttatatgggatccgatgcagccgaccgcaggagggagtggaagtaacaaccacaaggatcgcaagcgtaagcccgaagagcttgtggcaacaacctctccatcttcccgacaacgttcccgcgtcaacaccttcgacaagataatgaactcccaatgtccgcatcatcccaactccaatcacgtggcgaaagattgcttcgtctacaaacagtttgtagagcaatacgtcaagaacgcacgtaagccctcagacggagaccaaggcacatcaaagaagaaagatggtgaagacgatgtcccacttggttttcaagatcatcgcaaagaactaattcacatctttggcggacccctggcttatgaatctaagagaaagcagaagctaacagaacgggagatcaatgcggttcagcctaacacgccccaataccttcggtggtcagagatagcaattaagttcgaccgctcggatcatcccgaccgagtggtccacccggggcggtaccccctggtactatacccagtggttcgtaacgtcaagctccaaagaaccctcatcgatggtagcagtgcactcaacatccttttcgccaagactctggacgatatgcagattcctcgaacggaattaaagccgagtaatgcacccttccatggtgtcatcctaggattatccgctacaccactcggccagatcactcttccggttaccttcggcactcgggaaaactttcgcacagaaaacgtttgttttgaagttgccgatttcgagacaacgtaccatgctatacttggacgaccggctctagccaaattcatggccgtcccacattacacctacatgatgatgaagatgcctggtcctcgaggagtcatatcactacggagcgacatcaagcaagccgtcacatgtgacaaagaaagttgcgaaatagcccaaacccacgagatcactctcgctcgcgaagagatccgattggctgccactacggcaagcgaaggagaggtgcctacgaccaagctgtcaaagaccgaagaaggcgacgacaaaactaagaagattccactagatccctccgatcctaccaaaactgctgtaataggcgctgagttagattgtaaataggaaagcgctctcatcacctttcttcagaataataaagatatttttgcgtggaaaccatccgatatgcctggtattcccagagaggtgattgagcactctttacatgtcaaggaagacgccaaacccatcaaacaacgactccgccgctttgcacaagataggaaggatgcgatcaaagaggaattagccaaactgttagcagcaggcttcattaaagaagtcctccatcccgactggctggctaacccagttctggttcggaagaagactgggcaatggcgcatgtgtgtcgattacaccgacctcaacaagtcttgccctaaagatcctttcgggttacctcgcattgaccaggtggttgactcaatggccggctacgagctactcagtttcttggactgctattcgggatatcatcagatccgactgaaagaatccgactacttgaagacctcgtttataacgccctttgggtcctactgctacatcaccatgtcctttggattgaagaacgcatgagcaacctatcaacgcatgattcaaagatgtttttcaactcagatcggtcgcattgttgaagcttatgttgatgatgtagtcgtcaagaccaagcagaagtatgacctgatcgcggatttagaagaaacttttgcaagcattcgtgctttcaggatgaaactaaaccctgaaaagtgcatcttcggagtaccgtcagggaagttgctcggatttatggtatctcaaagaggcatacaggccaacccggagaaaatcaacgccatgctcaacatgaaaccgccaagctcacaaaaagatgtccaaaagctgactgattgcatggcggcgctcagccggttcgtttcgcgactcggtgaacgggggatgcccttcttcaagttgctgaagaaaactgacaatttccagtggggacccgaagcacaaaaagcctttgaagacttcaaaaaatttctcactacaccagttttggcctcgccacatccacaagagccgctgctgttatacgtgtcggcgacctctaaggttgtgagcacggtcctggttgtcaaacgtgaagaggaaggccatgttcaaaaagtccaatgaccaatatacttcgttagcgaggttttggccgactccaagacgagatatcctcaggttcaaaatttattatatggcgtcttaattaccgttaggaaattgtctcactattttcaaggtcactcggtccggtggtcacattgtttccactcggggatatacttcataaccacaaagcaaacggacggatagcgaagtgggccttagaattgacatctttggacatatctttcaagccacgaacttcgatcaagtcataagctttagctgacttcctcgccgagtggaccgagtgtcaagaaaacatgccagaggaaaagatggaatattggactatgcattttgatgggtcgaagaggcttacaggcactggagctggggttgttttaatttccctgactggagaaagattgagctacgtattgtggatacatttttctgcgtcccataacgtggtggaatacgaggcgttgctccatggattaaggattgccgtctctttaggcattcgccgactaatcgtccgaggagattctcagttggtcgttaatcaagtcatgaaagaatggtcctgtctagatgacaatatgaccgcttatcgacaagaggtacgcaagttggaagataaattcgacggactcaagctcacccatgtcctccgacataataatgaggcagcagacaggctggccaattttggttcaaaacaggaagcggctccttcagatgtgttcgtcgaacatctttacgaaccaaccgtgcccagaaaagaaacaattgaagccatggatactcaaggcgtaagcatgattgaagccgactggagagaacctctcataaaatttctaaccaaacaagaactccctcaagacaaaaatgaagccaagcagatctccaggcgcagcagactctatgtcattcatgagaccgagttgtacaagaaaagtccatcaggaatcctgcaacgctgtgtatctttggaagagggaagacaattgctaaaagacattcattcaggcatctgcggtaatcacgctgctgcacgaaccattgttggcaaggcttatcggcagggttttttctggcccacagctgtttccgacgccgacaaaattgtgcgaacatgtgaaggttgtcaattctttgcccgacaaactcacttaccagctcaggagttacaaaccatcccgttgtcttggccgttcgtggtttgggggcttgatatggtcggtccattcaaaaaggcagtcgggggttatactcatctctttgtagctgtggaaaagttttccaagtggattaaaaccaaaccggtcgtcaccatcaccgcagacaaagctagagatttcttcatcaatattgtacatcggtttggagtaccgaatcgtatcattacggataacggcactcaatttacgggcggaatatttaaagatttttgtgaagactttggcattaaaatttgttacgcctctgtggcacaccccatgagtaacgggcaagtcgaacgcgccaatggcatggtacttcaagggatcaaagcacgagttttcgaccgactgcgtccctatgctggcaagtgggtagaacagctgccgtctgtactttggtctttacgcaccacccccagtcgggctactggccagtcgccgttcttcttggtttatggcgcagaagcaatgctgccgagtgaggtagagtttgaatccctccgatttcgtaacttccgggaagagcgccatgaagaggatcgagtggatgacatcaaccgactggaagaagcccgtgaagcagccctaatccagtcagctcggtatttacaagggttacgccgttatcataatcggaatgttcgatcgcgagcctttttagttggcgacctggttctgaggagaattcaaactacataggatcggcacaagttatctcccttatgggaaggaccattcataatcgctaaagtcactcggccaggttcttaccgactcaagcgtgaagatggtactcttgtcaacaattcttggaatattgaacaccttcgttgtttttatgcttaggcatcacttctgtattttcctcttcgactgctaacatcaagccttttcttgagttgtcagtcgggggctactatgataatggagtgtgatctttatcaattcaattcgcttacttgatttatcattgctctgtttgattttttggcttagtcaatgaggactgaaagttttttaacaacttttgcgagttttaggctcaacaaggtttgacaaaaacttttaagaaatcaggagctaagtttgaaatatcatgcacagcataaatttatcagtattgtacaaattgtacctccatcatcgtcatcatcatcatcagaatcacaattacaatataacatcaatcagtgtcagttttttcatcgtcggaattatcagacccagtcggccgaaggtcgccatcctggaatctctcaactatgtcagcagcaatcttgtcagcggctttttgcgcatcattgatgaggttgagggctgtttcttcgcttgtcccgtctgcaaacccatcaacggcgtcaatatcgattttggggtataaagatttggtcatagctaacgccatgcttgctcccatacatccaacctccctaatattcttgaagtaagtatccggagcgactctcagcttgtcgaagatctcggaagcgtcaagtgtactcgaaccggcgttattgaagaacatggcttggatgagtagggtagcggcattagcgactttatccctggccccttcaagcctattgatcttattgattaagacatcaaactgtgcctgggacttgattttgcgatttgcacgaataaatttgtatcaacaggtggctataagagcatggggaactagttatcattaccttcaacatcttttaaggccaagtccctctgctttgctagttcggccttgtccttctccagagcttcgacctgcctctctaggtcggaaatcctggcggcttgcactgaaatgctcttcggttaatcgatatgacaaggaaggtttcacgaatatgtcagacggatatggtatttacctttggatgaaccactcaattcatagttagatttttgaagctcagagattctattcctcagatcatgctcagttttcctcgcgagctctctgacctcatgtaactggcttttggtggcttcaagagttccaagatggggaactaatttctcaagtgtcgtggtctttgcctcattcctgagatggattctctgcaataagaatttaccggcgttttcagcaaaatatgaaggggaacaattaaagctatgcgtaaatggacttacattcacaatgcgagtggcctggctgagtgcctttttcagcaagcatacttcctcatcttctttttgtttgtttattatgattccttgaggttgcctgtcatcgtcccaccacttgactaagatagaagggtgcgagtcttcagctgcttgtatacggggaatttcttcttcatcaccaatcattggtcctaatgtatccactgacaaaggttagacaattgatcagagttatttggatcaacacgatttcaggcaaggtgtttacctgtgatgatttccggacgggaacgagtcgactcttgcaccttaatgggagaccctggcatcgggtcgttgctggcgtcttgtctacgagggctgtctgcccgagctccaacttctggaatctcttggcttggcctagtgtccgactggtttttagtcgggggctcctgattaactccggctccagcttcggccgactcattctcagtcgggggttgatcaccagatcctacattatcggttgctggctggctgtgactcggctgatcctcgtcagttggctcgattccttttaagtttgtttccctgctagtcgggtcagagtcttttccagaaggatctatatcagatggtttcctgcaagtttggttgtcagtattatttctgcactgggtgcacatcaatgcaagagagatcgttatatgatttgtacctggaagacttcctgatctttggcacaggacaactggatgttttcttccttggagtagcctgctttggcagtttcttggttgcctctcggtctccaggctttctagcagtatcgctttcgtcatcacttgacaccaacttccttttgcgtaaatctggctggtcagtattatttctgcactgggtgcacatcaatgcaagagagatcgttatatgatttgtacctggaagacttcctgatctttggcacaggacaactggatgttttcttccttggagtagcctgctttggcagtttcttggttgcctctcggtctccaggctttctagcagtatcgctttcgtcgtcacttgacaccaacttccttttgcgtaaatctggctggattggaagtatttggccgggcttcagaacgggtcttgggacccccgctcccttgaccggtttggcggtggggtgatcggcattggacgactggggggtccgatttcatcaaagcaaattcctggtcgtaatatcattcattgttaattgattcaacaaaaagacaagactatattctgtgaaaagttgaaatgtttgattacatatcggtggaggaggattgaaagcattgaatggcatgactagcagcaagtgcgaatagctgacgacgatagcattcgagaagatcttgtacatcctttccttcataatcttaaagttaagagagtctggatcttcacgatttggatcatgtttgccgtcaaactcaaaagctgtgcgggacctctctttgattggagctaatcggctttttatgaagtgccaagtgatctgttctccctgcaaaccttgctctttcagctttatcatgcgctccattagttctacagcctgggctgcctcatctcctgtaggcaatgaattccatgtatcttggtagactggagggagacaagagtactcgggaagggctggtttaggattttgaacatagaaccagttggcgtgccagcctttgtttgaggtcttgaagggcatggagaaatatttttggcttagtgttcccctgagttggaaaccagcacccccaacaacgcacagtttgctcttgtttggctagggtttgaggaagaagatgcggcgaaacaaggcgaaatgaggcctaatgcccagaaaagcttcgcaagcatgaacaaaattggcgatatgcactatggagtttggattcagatgatgcaagctaattccatagaagttcagaattccccggaagaatcttgaggttggaagagaaaatccgccatagaagaagtgagagaataccacaatctcgtgtgtgtcgggggtcgggaatgctttgccgaacgctggtcgccacccgatgatttccttcgtcggaagaacgccgtgcaccaccatttctttcagattctcttccgttacatcggagggagcccactgactctcgaaactttctctctcctccgccatggatgcgagttgcatggttagatttggtccaagatatagctggaggggaatgaggaattggtgcggtggacacgcggagaagtttcgtgggattttttgagaatggattgggacggattgatgaaccctagtttcgacggtgcggtttgctactgtagcaaggagtggggaaatggcgagagtctcggtggggaagacgaagcgatgcttggacttcggtgctttgttagggtatcgggagtactaatgggcctgggtctgtacagtacttcagcccaatattataatcagcgtggcccgttgtgatccctagggacttaggtgctttttgctttggcaatttgtgctcacaatgatgtggcccgatgctgctaaaatcctttttaacgcggttcgataattctttggaattattatgctgcaaataaaaaggtgcccgacagaaaggtgttataccatttttgtcagctttattaggctgcaaaagttgtttgggttgatttgagatgactggtttattaatagtcattctcttagcatgttatatgcacattttggttatgatgagggccatagcctaggctattagactcgttgattaccatgattttttatcatatttgatgggttgtctttagagtttttactcggattcctgtcaaatatgtctatttgaggaccttttgagtgtttatcactcgggccttttcatatttttttctcgatgtattgcagctaagaagcagacggctgggtgttttactgactaccacacatgctttgctatataatgtttggttgtaaaaccactcggttcttgactacatgtttagtttttcaactaaccacatagtcgggggctacacctaattaggtgcatctactcgatgcaccatgttttcttttcgcccttcacagtctttgattttagcactcggcaggctggagcaggttgaattgaagcactcggattattgttttttgttctgagatggctatttcgtcgactgcaaaggtctcgggggttactgtagagattatggataccctatatctacatggcggtcatattccagctgggtacatgataccgaataaagacagaataccttcatgaggactcgggttagattctaaacttgtatgtcaaggaaatacccgagatcctagtcggttacgattgtattttatctgtaattccatgttcttttaggatatggactgtattttgtaaagcggaccccctcccctatataaggaggggtccggatgcctctcggggcacggttttttgacctagattatacaatcaataatatactcggcggaatcatccccggacaggagtagggtattacttcttgaataaaaaggcctgaacctgtataaaattcttcgtctccaaacccatccacttttctagcttgatagccacctctttttagtatagccgaaatcttgtttcgacaaaacaaaacacttagggcccctttgaatcacagggtagaaaaaacggaggaataggaaaaacataggattctgacaggaattgaagtgtaaaatagaggattgcaaaacacaggaaaaacataggaatggtcgtttgattggagcgcaggaaaaacacaggaatcgaatgagagagatagactaaaaggaaattttccaagaggttggagctcttgctaaatttcctccaaaatccacatgcaatgtgccattccataggaatttcataggatttggaaagcttcaatcctttgaatcaaagggccaaataggaaaatttcctataggatttaaatcctataaaattcctacataaattctttgattcaaagaggcccttaataacatcatccctttaaattcccaatctctcctaaaaactccctccaaccaaacgagccgtatgagaatcaagggagtacttaacaagacagaggtggaccacgacggtgcagaggttcgtctaggcaggcaaacccaaaccaaagagcagcagccagccactgccagtgccacagctgctctccctgctgcagtgcactgcatcagctgcgcgcaaatataatctttaggggaagaaagaaaaaagaaaaggtggtgatcgatgaagaagaggaagagaggggccgggggaccaacaaaggcgttgaacgaaaaaggaggttggagaccaggccattcggacgacgaccaacaggcgcacgcacgctcacgttagacgtagaccaacgccaagcagacgcagaagctttgctcctttcaccgcagtaaaaagcagtactacctgtactacctggaattcttcgccacttgacccgggtaaaaatcgaacctcctgtttcattctcaggcctggtttagataaaaaaaaatttaactaaaaacatcacatcaaatgtctggatatatgtataaagcattaaatgtgataaaaaaatcaattacacagtttgcatgtaaattgcgagacgaatcttttaagcctaattacaccatgatttgccaatgtggtgatatagtaaacatttgctaatgacggattaattagacttaatagattcgtcttgcagttcacaagcggaatctgtaatttgttttgttattagtctatgtttaatacttcaaatgtgtgtccgtatatgtcaatttttttttgccaaaacaactaaacacggcctcactccatctttaaatagctcatattagataaatgtgtgtccacgttcatagataatactagttgttatattttagaacggaaataataatagagttaacatgtatagtagataagttataaagttatctctatttttcttctcctctctatatctctcgcctatacatttaatatattcatgttgaagtatgtgaatagtcagctcttccatcaaagccaagtacaagttaaataatagagccttcaatttttcttctcctctctccttttctcacttatgtatttagtgtatttatccaggagcacgtgttaagtgaactctcatttatttttttaactctctcctccacataagtatagttgacttatactcactattatccttactctaacccttttcaatttttgacttatgcttgctattatccttactctaaccctttttcaatttttaaattccttcttctccacataattttacagttggcttatagctacgctactatatactcctttcatcttattttaagtacagtcgtgggttttcatgtctaacgtttgaccgtccatcttatttaaatatttatgatttgttttttttaaagtcacacataaaatactatttatgttttatcatatgtcataataaaaatattaatcataaatatatttaaataaggtggacgatcaacattacatagaaacccacaactatacttaaaatgggacggagggagtgttaaactcggagcaagtttaatagtatagccaactactaactctaaattatctatagtcaatttaatagtcaattcatataatagttacctataaataaaaactacactattaatatctggtcacatctgtcatacacacattgtgtcttaaagtccgtactacagttggctataaatctgtagccacatgcttctctctctttttttatcatctcgatatacttttaaagctgatttataggctgctagtttacctgctcttggctctgttcgcaagagggtgttcccaactctcccctctcgttttttacgcgcacgctttttaaattgttaaacgatgtgttttttttaaaaaaaacaatctatacgaaagttgattaaaaaatcatattgatctattttttaaaaaaacactaaaacttaattaattacgtgataatgaaccgcttgttttcggtatggagggaatgagttccaaagcaccggaaacgaacgcaccctactctgtgtgagagagagagatggcatcatggtcttctcatctgggtattactcggcagccttgtgctacgcgcacgtacgttaaaaaacacacacacagacacagataccgtagctctcgtgggtctccgggtctcgatgcactgctcccagctgctgcaaaaggagcgccatggccggcccagctagctcctaccctactcctgctcctacgtagcatctacgcctcgccgtggccgggcagtgtgggtcaaagcgccgcccggccggccaccgcgccggaggagagggagagaaggaggtctcgaggcaggcgtgcagttgcagcgaaagagtaggtagcgtaatagttgccgtcacctgagtagcattttgaaattttaagtttaaatttttatgaaagtaaattttacattgggttgtttgaaaggtcaagttctcaattttaagagcccctttgaaacaaaggaaaaactataggaattctatagaattttatcctatagagtcttttgaatctaaggattatttcctactaatccctttaaaattactatggaattaaccttgctagaacaattttagaggaaaataacatgaggtctcacctcatgattttctctacgtgtgtctaaaattccagtatttttcctgtatgttaatcaaacgatggtttgaagactttcccgtgtttgaaaatcccataggaatccaataatcatgacattctattcctatgttttgttctattcctgtgttttctcaatcctgtattttaaaggggtcctaaaagcttacatatattcaattggatgtaaatgataggcaaaaaaaaatactccatccgtttcgaaatatttgacgccattgactttttagcaaatgtttgaccgttcgtcttattcaaaaaatttaagtaattattaattcttttcctatcatttgattcattgttaaatatattttcatgtagacatataattttacatattttacaaaagtttttgaataagacgaacggtcaaacatgtgctaaaaagtcaacggtgtcaaacattacggagggagtatatcattctctaataaagatcatggaaaagagtactgccactactatactccagtgttgtcacccgtgcatttcgataggacgacactgcgtgcgttcgctttttggtttggttaatttgctttttgactcgaattatgttcattcaattcgttccgaaaaaaggaatcactcgagtagtgcacatgaagtaaagggccttctgtttttcgtacgtccacaggtcgatcggttgaagcaaaaaggagggtttgaaacttagattaaaggtgtggagtcatgatccgagatctgtttgggtggacgaaattcagatatcacggcaacctttaggaatgcgaacgaaaccggatgaaaactttaatactctagacaattttgctgcttctattttgtaattgctactagagttttatcgtcaaaatacttgtgacataacactattcctacgtacttcctccatctcatattataaatcatttgactttttataattaaacttttaaagtttgactaagtttatagaaaaatatagtagtattttcaacacaaaacaaacatattatcaaaatatattactttaatattttatatattgttaatttttttgtaaatctagtcaaatttaacaaagtttgattaggaaaaaaatcaaacgacttataatatgaaatggggatgtattaattaccagggaaagaacaaaagtatgatggtggacccaaccaggattaaacccctgtgatagtaagtgtatgtgcactttttgttaggatttctatgagaggatttacgactgtggtctccatgtcttaaaacttgtgttggggcatgtacaaacgtgtgatgtttggtgtatggccgctaaatggtggtgggttgtggttggtattaatggcgaggacaattgaccataaaagttttattcataaattatttttcgtttgcaactatgccgtttgacttattccacacataaattatttttcgtttgcaaatatgccgtttgccttattccacaaataagcgaaacaatagggtgggaagaagggagaggatggcgataaggcgcggcaatggcggccagggaaggagggataaataattagaacaattactccaagtctaaaagagctatagaaatctcagagcaaatcactgttcccccctgaaaaccactgttccacccattggataaacaggcgaaatagcggacaaaatcactactagctgttccaaaatgactgaacctgtggctaaaaactgcacccaaattaagacaatgtagtttccatgggaccaactagctgacaacagcaagtgttaagcctagagacagtgggtttggttggaactttcaacacttgtgtggttgatcgatagcagcagcagcagtctctggtccatgcaaacgctagcttggactcgatcctttgacagatagtaccgaacctaacgacacacatgattgttgctgctgtgtttgctgctggctttgttgttgttgttgttgttggtccaacgccacaacaccaaacctaacaaacaaattaacttttaggaggagtagtagtcttttactgttgatgatgaatgcatgttttggaaggagggtgatcgatctgatgatatgataatatgcatgcatgatgatgatcagagaaattcagagctggctagctgcagaagatgcatgcatgcggccggactgcagaggagtgtagtagtgacgatcggactacggttgaacatcatgcgtcgacaaattcaaatccaaaaccaaattttgcaccgctttcttggacctttgtggtagtagttcttgcttgaattgtgcttctgttcgttctagaagagggtctgagttgttctagaaggcattgatcatttggtgatcaggttaactattggtagctttattattctaatgtaaaagtttggtatcatttagcgagtccaaactttcgatgtgactgggtgaaaaaattgatctaaacaagtccagaatcagtatgtcaaccgcctattgaattgcattgctatgctaaacaaaatgaaactttagcatttacatacgtacgtgcctccttagtttattatccatgttgatcgtccttttttttttatgtcactgtaattttgtaggggacttttccggcaaaaattttgtagggggctgattgttcatttgtatctatgcatatcataggagtgagaggttgttccaacaagaattgagaagagtaaacaaatggttatatttttttttgtctaaatattgtgagaaaacgagtatagttcatctttctggtcccttgatgaacagagaactctaatgttggcaaagtttaacttcaacatttcttgatcaatctagcgactttgcttgttggcaaagtttagtaggccataaaaagtttgttgatgatcatgtgctctacgacaatattactatggctagtggatataatcatttgtcgtactatagcgggttaagagctcgacaacaaaataactttaaccaaatattgaatcgctcgtcacattttcatttctagagctccacgacaataatactttaaccaaattccaaaaatgcttagcacaatttaggcaaactagctggacaattgacgaggatatatttttatcagaaacttgatttattggcgcaaatacaactttaatattttcttggccacacaccattgattttttttttggtaataaagtgccacatgaccttattactttgaacttgtcacacacttgagtcttccaaacattaaacgataataatactttgaaccgagcgctacagtttttaatttcatggaacaagtgttacttcaatattttcttgatcaaattaactagctagaggcgcctctctttggcaaagttcagtgtgccataaaaaatgtttcttagtgatccagtgttctattccaatataattttggcccgttgctaaaattatttcatgatcccacaacgaaattgccggtcgctaatttttttaatagtagatattaaaagctccacacaataatattgctttagccagtttctagaagtacatgatattatcagtctagctagaggcttaaatgatttatcgctctatagcaaatttcaagagctctatatataatattacttcagcgctttagccagaggctagaaccattggtcacattatggtagatttcaaggcctcaataacaatattactttagtcggtttctagaggtacatgtaaatattactctaacgagagactagaatcatttatcgcactattaaaaaatttcaagagctccacagcaatattattttagtcgatttttagagctacacaataatattactatagctagaggctagaatcatttgtcgcactataacaaatttcaagagctccacaacaatgttattttagtcattttttagagctacacaaaaatattactatagccagaggttagaatcatttttcacactatagcagacttcaagagctccacaataatataactttagtcagtttttagagctacacgacaatatcactctagccagaggctagattttttactatagcagatttcaaggcctccacaacaatattactttaatctgtttctataagtacatgataatatcactctagccggaggctagaatcatttatcgcacattagcatatttcaagatcacatccacaacaaaaattcatttgtcgccctacaacagaattcaagagctccatgacaaattactttaatcaaatgccaaaaatcgctcttcacagttcggtcggttcgtagagctccatgacaagatttactttaatctgacaccaaaaatgctcaccacatattaggtaggattaccgacaaacacattgtgttttcccaatgcatccatgacttaattccgtgacacaaatgcaactcaaatgtttttcttgaccacaaactatcaaaaaaaaaaggtttagagctgcacgacaatattactctagccaaaggctagaatcgtttgtcgcattatagcagatttcaagcgctcaacaacaatgtaactttggtcagtttttagtgctacacgatgatatcactactctagctagaggctagaatcatttatcgcactacagcagatttcaagacctccacaacaatatcactttaggatgtgttctggagaaggggttgggaacctctcccacgtgcatgaaaaatagatagcttattaacatatgattaattaaatgttaagtaaataatgttaaaaaagaataaataagatttttacacaactttctatagttttttgttcaagaaacacaatgtttagcagtttagaaagagtagcgcgcgtagaaaacgagggagtgggaaataagaacattgacttctgaatgcatcctttagtctatttctagaggtacgcgacaatatcactctagctgaaggccataatcatttgtcgtactatagcatatttcaatatctcctcaacaatatcactttaatcgactagaatcatttgtcgcactatagtagatttcaagagcttcacaacaatacgaacattagtcggtttctagagacacacgaaaatattactatgctctaacaggaggataaaaatcatttgtcgcactataccagatttcaagaactccatgcaaaatcactctaaccaaacgctagaaatcgctcgtcacacatcagtcccggttcctaaagctacgcaacattattactttaatccggtacaaaaatactccctcacactaaccaaacgtgctccaaacatccacgaactcacctcgattactaggcgcaatttgccaactcgatcgcgccattaaaatttgcacggtagaagaggagtagtagttgtcacgttggcacgcacgagtggatggatgcacgagcgtacgtcgcctcgaaatggatccacggtcacacacactggctggcaccgtcgcaggcacgtggactgaacaccgggccccacattctgacacacccgcatcttttgaatatctctatatgtattttttatatttatacagtagtatatataaaaagagaaaaaggaaaataaaaaaagtgggaaagccaagctggtagtgtgacgactgaggaactagctagatccaaacgccgcgcaaaaaaagaaaaaagaaaaaagaaaaaaaatgccggtcaaagtgtcaaacctgccacccccacgtgggccccacccccacctccccccttccctcttatacccacctccccccacaccacacgccattatctcccacctccacctccaccccaccac

SEQ ID NO: 3076 - DNA, 9970 bp, Oryza sativa
cagcacccgcggcacctggtgtgccgctccgacgcgctgctcatcggggagaagatcccggcggtggcgcccggcgaggtgctcgagccgggccacgcctacttcctcctccccgcccacctgttccactccgtcctctccttcgtctccctcgcctcctccctcctcctcctcctctccgcctcctccgcctccgccgccaagaagcagcagcagcggccgttcgagctcctccgcaccgcgtccggcacgctccagatcaagttctccgacgacttcctcctcgccgccgacgacaaggtcgccgacctcgccgccgccgccaccaacccccccgtgctgcgcggggacaagaagctggagaaggagtacgaggagctcgtcggctacagcaaggcgcggcggtggtcgcccaagctggacaccatccaagaagtcgtcgccgccgccgccggtgacaccgccaccgccgccgccaccgccaccaccaccagaagatcctccaaaggtcgaggcctccccttcctcggcaggctcggcagccgccgccggcgagaggccgccgccgccaccaccaccaccaccctcgtctgcggcaatggcggcgcggtggcgtgctccggctaggctaaaatcaattaattagtctccgggagggtaattaacgggggtgattaagattaagctcgatccgagttcagtttaggcgatgatgattcagctgcagcttcgactgcagctgtgtccgcatttgtaattacagaaaagttttggtgctaatttgtacatggtttttcgttgcattctgatcagaaaaaagaaaagaagaaaaaaaaaagcaaggctgcgtggtggcaggcaaaatttcaactcacttttgctttccccttttttcagtttctggtttgtttaaactttaaactgcttcctccccacatttcacatcctgtgtgcgcgcccatcgagtccagcaatacagtggtatccaaatttccaaaactgattacaaacaattttgtaggcatgaataccataattttcatagcaaattcaaattccacttggcataaaccattcaaaaatatttggatcgttcagtgcacacactcactcacaccgagatctctgcagctaaaccgcacgtagcacaagccttggtcaaactgcaaatgctgtgcataattcaaggcacgcacgcacgcacgaattttcaggtgccgttttacccaagcaaagtcagacggaataaatcgaattcgaatacaaatccagtcaaaaatgctcatcatgacggtcgttaggccaaaaagaaaagaaaaaagtacgtagaaaaaaaaaagtccaaatcactatggcgtatattacgcgttatgccgttattaaccggtgttccaagcggatcaaaacagtgaaagattcgaatatgcctctacgcattacgtcatcttgttcctgattagtgctaagtatctttgttagctaaggtaattagtagtaacttttgacagttgttgttaagtcagtaattatttcggtcagttactgtacactgaaacgcatgtgtggcatgtgacgcgtgcgtttgtttccatgagagatgtcgagatgggagcagtttgaccggggtcaaaattaaaaggcaagattgaattgaaaagagaaaaagaaaattaaaagaaagaggagagcacgttctccgaggttaaaaaaagattgagaaattgggggcattatacttccagctcactgatcctagctcccggctccgattcagatccaaatccggcgcgctaatcacacactctaattaagcactaatccactttgattagggcttatctaatggcagtagccggtcaaagccgtgacactatcatgatcccctttgcttttattttgattagaatttggtgtgtgtgtgtgagagagatgagaatgccggcaggtgggtcccagtccacagcctgtcaatgttgagactaatggagtaagtgtgagctagagagggcctattgctatattttgttatgcaatgacaattggatctagggcccaccgccggtgagttttgatatgaaactttgtgaaattagaggaggtgctatatattaatattggtatagtattagtttttattttcgtcggagctggttaacattgtgggtagtctcatgcgatcgtattaatttcatgtgaattttcaagacgccgaggctctttgctctattttgatattctttttatctgtttattatgatggcagagttgtaatctcccgtgtcatttaatataatatgtccggtttcaataacgagtattgactaatatttacacgtggcgacttgagtgtggtggtgtttgtttgacgggaaaaaaccgggaatcatgtgcactaattgagtgtgctaataagctggtcaaagttggtactctagatgcagggtaagacttctcctttgcttgccttgaactccttcattattatcagtaggaaattgagcaagtagctactattgctagcggtgggacattagctaagttatgagctagccatcgatggcaggtgggctcagggtgtaaaatgtaattaaggtcttgtttaaaggaattgtagatcacacgaagtagatggtaagtagccaactgataagaaaaaaaaaagggttttgaagaacttatggttttttttcttctatataatcgttcatttctagatttttcaaccattagattttacgacctaaagtaaaatttaggcaatatgagagaattgggattcaatggatgtagctattaaaaactcctaaacatgtcctatataaggatcagattgaaaaaaaattgacatttttcataaaaaaatatgagcatgttgaaaattgaatacgaaactttaggattaaaaccacaccccctttatcactgtactatcgggcatcttctcatagcacttcctatatatgtcggtgtgagagtgttaatcaattaacacaagcatcacaaatttcgtttgaacacagtacctaactgtacacgtggcagtatcactactcaaaattaagatgggaattaaaataaaacaattaagcatgtgggctctagactatataatggcctgtttttgcttagaaaggtagcaatgcaagcagtgctactcgcttagatgtcagcacacacacagttttgacctgatggtcaaagatggggccttggatccgggcttccagccaccattatctgctccatcacccacatttttttaattttaattaattaattaattaagtgtaggttatagtgtactcctactaacgtcagaggagagtatcaacttgtgcaatatacaacagctagcacatcgtctaattagctgtactatccgcatagtcaatcagtagaaaggccatgctggagtattatatacagatctgtgatattatcttggtagccagtatgtaattatatgagatctctatgtatatatagactaaagagacactcatatgcatgatttcttacatgatgtgcaaacaaaaaaccaggtgaagcttatatgattaagctagctaggtagatctactttgcttggattttttatttaggagtattgcttgttgagttgtggagtataaaactacaccaattttgaaatttaatatataacttcaaaattactaacttggttttctttccttaatttataatcactcaggtttgctttggagtttggaccactaattaaaggtagaaatgtaaagaccttatcctgaaattatttttcgttgcattggttacgtatactccctccttttctttctataaggtgtattataaaatcgaaatatcattaaaaatataattctattggaacaatttttacataccaaatatatatattcatagtttgagtaattagttttgaatttgtaactttataatattccttatataaaaatagttggagtatataacttgtacttacagtaattaatgccagcggaatagtaagaaaaatatgctcctacagtgtatgctagtcatcatatcagaacaggataagataaaatgccagctgacaagattttgctggtatatccatccttcacaggagtattttactacacacgtactgtgatgttactctcaggttaaggtaattaatccagtgccagggtaattaaccaaggatgaaggggacaatgcaaggtgtggattgcttgccacgtgtaccgcattcatggtcaatggtgggaaagggtttaactggggacaaggtagcggtcagaacggggtttgtcccagagaggataggcgaccaatcagcgagcaacacgtatacgtttatctctctacctttcccttcttggtttcgggctaattaacggaagaggaatgcaggatttaacatgtgcacgttcagatagtcaaagtcaattactcccttcattctaaaggcacgactgctttttctttttaggttgttttataatacaagatgtatagatacatgtaattaactaacgcatctctctcctaaattcgttatttagagtcttgatccttaagatctataatcagggccgttggtaagtgtgtccaccgaatatagcccctacaaattaagaccttatttttattctttttaatatattgtaatgtgttccaaagagatatcccgtattatagtagtcattaattcattcattcgtaccacccttgagaaaattatgataaactatttggttcatttctgcacccttgagaaacttatgataaaccatttggttcatttctgcaccagagaaaccatcctgatttggtttagactcgtgacgacgatgtttaaaatgccccctgtgaggttgaaagttgaaactctggtctctgcctctctggagaagagacaaccagcggtaagccggaggagcgcactgctgatgctgcgagattagacaacagattgatggatatgcatccatccattcatccatcggtggagtttgtgcgcgtgcgcttacacgaatagactggatattagtacgacacgacacatggaccgtgccattgttttgcactccatggataggtacgatacttctcgattactgccccgtcataaaatagttgtttgaatttttttagtcaaaattcttttaagtttgatctaatttatagagaaaattatacgacaccgtcaaactagttttattaaatttaatattaaatatattttgatataatgtttgttttgtatttaaagtattactatagctataaacttgctcaaacttataaaaaatttaacaaagaaaaaaaaatcaaacaacttaggacataaaacaaaaaacaaagaaagtagcaataaaagatcatatatgatatattttagtcatggaaatctgaacaggaatcgctcgcgcgcgtgtgcgtacaatgctatgatagtgataggcgtgcgtgctctccttcagctcctgctccccacatggccatggtggtggatgatgctccttcagctccagcaaccactactcaccaccagtggcctagatgcagctacaaactgcgcccgtgctgtgccatcgtttgaccgagaccgaccaaattttttgtcaactagtaaaaagcataaccacgagctccagttaattaactggtctactcctcctgcacttcctaccgatcgagtaattgtcgattactagtgctgtcatcccttaactgatgactaactaagcaagatgattaaacaacgtgtacgtggtgacttcgttaatatcaagatatgtcggtctaatcttctggagatgtttataggggtaggatttacgtgtttgtgttcacaaggacgatgagtgtgaccgtgttattagcgtctacatttacactgtgtttttttttttaaaaaagtcaatgtgtctgttgctcacgccattgcaccgttttgggctgctccatggcctcggttggattctacattgaaggaggaggaggaggccttcaagtgttgagcccaaaggcagcaagggccagaaattttgggcctatattgggcctaatttaccagataaggtcgtcactcccttagttgataaagtccgcttgagatacctcgctgtgggtcaactttcattagcatcaatcgtaaaatatggtacaaagccacccactactctcaaaaccagtgttaatcatgtccctcgataatttggacagtgattttgttctttatcctacgtgacatactccatccgtctttaaaatatttgacgccgttaacttttttaaacatgttataccattcgttttattcaaaaacttttgtgaaatatgtaaaactgtatgtacagaaaaaagtcaacgagtattaactaggggtgtgtttggttcacggtcatgtatggataggatatggccatccatattttgttggatatagcgatccaattttttgtttggtttgtatggatatgacaatccaattttttgtttggtttgtatggatatgacgatccaatttcttatttgattggagggatatagcatggatgggaaaagccaaaagttaatgggacccatttgtcatatatatattttttaacaaaatataatcatccgagatcttattttaaagatttaattataaaaaatataatggtgtaatcaaatcataaattagataaacggtttaggagaaaaaattatttggagcttgcttaacaggaaatcaaaccaaccacagccaatcggaatagaacacatcacccaatccaaaactggatggcttcatccagccaaatcagccggatgcactcatccagcatattgagagaatattccctattccaggctaccccatctacccggccctccaaccaaacactacaaaaactcgagcggccatctcccatccacatccaggctcatctatccaaccaaacacaccctaggtctttgtggctacctggtgcttacagagctactgtcaaggaaaaaaaagggtgggacctatgtagggccttgaccaattcaacccagggcagcaaggccaggagttttgggcctctaatgggccacttggttccatcctctgccgaggttcacctagtcagacatagcggcctaatatagaggagtaattttcaggttcctctgctggttagggtgtgttcggagagaagattgtagaaataagttcaccggaggtcccttgacttaagggcgagatttttctaaaaggccttgtttggttacacccggatttaatccgggctagtaatgataagtgtagtaagaaatttatgatagatacaatgatagaccgggatttattccgagctgggaaccaatttactcatgatagggacaataagagaccaggaatcaacccactagtcaagagttgtggaactaattcggatgttttgttgtatctatcatgagtaaattggttcccggtctggaataaatcctagtctcttattgtatctatcataaatttcttactatacttgtcattcccggcccggattgaatctgggcgtaaccgaacaaagccgaaatatgtacccctaaactcatacaaactgtgtacttaaggtcctaaggcagtatatatgggtggtttcgctcacgtggcatcctagtcagaaaaaaaaaagtacgtgggggcccacatgtcagctgcacatcttttttcttcttctccttcttttctctcttctctcttctcttttctatcttctctcttctcttcttacactgagggaggccaacggccgacgggcggagcaatgatgggcgggcggcgtgagagcacggcgccgggcctgcaaggaaccggagcggcggcgggcaagcgcggtgggggagtggggagagacaaagcgagaccggaggagggagagagagagagaggaggccgactggcaccggcgttatcgcccggttgcgcgacgacgatcctggccaggtcgaggtgcgggtagcggtggagcacggcgcactgtgcacctcatgtcctccctgtcacgctcgtacgcatctcgcgccttctccgccagcgcgcccgccgccaccgccttcgtctcggcgagctcgagcttggccttcacgttccacagctcctctagcaacgcgtccgcctctgcgccggcgtcgcgctcccacgctctcatgtagtaggttgaggcgatgacgtcgcctgttttggcaatgacgagctcgctctcctgcgatggtgtcacgatgccctgcacagctgcgtcaccaccttccactcgccttccgccgtggcggcactatctggcagcaaaccaccagttcgccgcctgcggccgtgctcgccttttgccagccgccccgctatcgcgctcgcccgtcgctgctctgccgctgtcgcctacctgcttcgccttccgctcgcttccgacgaagggaagaagcacgacaaggacgggggttgctctgaccgccgcctcgtagtggtagacagtgtgggtggcggagacgcaggagccggcgggaggcacgacggcgaactcatccgccgcgctccgctcgccgcccgccgccgctccgctgccacacaggcccgccgccgtgctcgcccgccagccgtcggcctccctcgctgaagaagagaagagagaaaagagaagaggagaagaaaaaaaaattacagctgacatatgggtcccacgtacttttttaatttttttgttgattaggatgccacgtcagcgaaaccactcatatatattgccacatgaccttgagtgcacggtttgtataagtttaggggtatacatttctcgctatcaagttgagagtcctccgttgaacttattccaagatcatgtagtaagcaacacaactggttagggaataaacacacgtgaaaaaagagagagtagaagttaggtcatctaattgtcttaaacagtttagcaacgaggacgcacagtctagtagtttgaatagaaattaagactataaccttaaaaactagatttatttggcttttttacagaaaattttatataataatcttgtttttgaaaaaaaaaaatcatctacccatacacagcattacaataagcccatatgcagcagctccgtcgaaaggatgatgacttttcctttacacaagaagagatttttacagcttaacatggagaagaagaaaaaaatccagaaacaaactaaacattcacaattgatcttgctcaaaacaacccgacatgctcacaaatccacaagatcaattcattgttcccgtcctggcgattaaagcattcacagttaatttacagatcgaatccaactctttccttttcttttgatgaaaagcagaattcaattcaacttgtgaatttgtgatatacgcaaagctcaaatcaatttagcagaattcatcatctacaagtagcgagtcccgggttgggggtacaagctgtacggcgctcccgccgcttcttgatccggcaaccacgccgccggcggggggtagcacggcgcgccgggcggcggcggacgcggcgacatgtacgacggcagcgcacggtccaccgagcgatcgcagcatggcgccgatcttggcagtggtggtggatactgcgatgaggctgactccggcggcggcggtggcgggtaggtgctcgtcggagaggggaaactgggcgccgggtagcctgccggcggtggcgggtagaagttgctcggtggtggcggcgggtagccggcgatgtactgcgacggaggaggcggcggcgggtagctgctgtttggtgcgaagctttgcgtcacgtgaggcggcggcggcggcggcggtggaggaggagggtagctgctcggcggcggcggtgggtacagtgaagctgacggtgtcgcggacagcgatggcagcggcgggtagcttgccatcgccggaggcggatacggcgcacccgacgtcgtcgtcgtcgtcgac

SEQ ID NO: 3077 - DNA, 15031 bp, Oryza sativa
gtagctcacgtgcctcggcgccgccgccgcgccgtcgccgccggcgacggcgaggtctgccagcggcacggacaccttgccgacgagcttgctcccgagcagcggcacctgcgccttcacctcgaactgcagcataccatccgcggcggcggggaggtcgaaggcgaagacggcggcgtcccagtccgggttctccccgccgtcggggtcgccgctcgtcttctcccggcggccggcgagcgacacggcggcgtagagcggcggcttctggaaggggacgaacgccttgacgcccctgcaggagatggacctgatggtgacccgccggccgccgccgccgccgccggcggtcgacatggcctccgagaaaaatctttcttggaaagaattgggattttgagcttggagatggatcgatttgtggctgatgggatcttggtggctaaagatttgaccttgtgctcttttgtttatttggatgatattggatctaggtgcaatcaatcaattggggagcagatagtatatgctgttactgtgttctttggctgcctgatttttaactgttcctaatatttttttttactttcatttctggatgcaataaacaggaggcaagtgtgtttgtgtgtgtgatatatatttgcatttgtaattatataaaaaagcactcaaaatgctgcagtctctctcaaagaaatcaagttcgttcagtactattttagaccccacaaagcaagaaaaattgtctgataatgcagttggttgtctaattttcttcttgctttagtcattgcaccacctgtctctttcttcttttccccaattccacactcatttgatatttggtagccgtactatgttgtgactgtgagaggccaccatacatacactatattaaagcaacatttgccaataagagtagaagctgttttaccaggaaattggataagctgaaacccatctaaccatttgtgatagcacaaagccataaactgatgtgtacaggcccatagatcacaaaacccaatgtagcacaaacccaatccaacacaagaaaaaaaaaacaacgaaaaatttcgtaccaatgcttaacgctttggagcacatggacaaaatattcataatcaagagatgaacacgtccaaccatgctgttgcatcctatgaattagtacaatggcaaactaagtgaaagacattacactacttgattatgagagcactgaagggatatcttcaaggacaaggttatttcatctatcttaccaaactttatatatatatatatatatatatatatatatatatatatatatatatatatatatatatatatatgaaaatggttctatacacctggaagtatacacctggaagtatgtacacctgctcttatccaccgtcgatctgtgattagcttcgatggatcctgatatcggattaacgagcggacccgtttaactttttaactagaaaaaaaattacgtaccccttaatcacagaaaccggaatgacatgagctcgcataattcctcggtcccaccagtgcatcggatacgaaaatcaggtcactgggagagaccgcgatataccagaactcggagaaggcggcggcgattcatcgtcgattccgcgacagcagcgagattcatcgtcgatccatggctgcgttgcaggtgacggcgtgatccatcggcgtggcgacctgcacgcgcggcgcggcggcggtgtcgaccgatcggcaacatcgtgcggcggaattgcaggtcatcgtcctccaaggcaacggcgcgacgggacgggactagtcgacggtgcgatgcagcaatagttgaactaacccaggcggcatcaatcactcgtcgatctcccgcaaagccttttcgaaagcgacaatgcatgtggttagtactacttaattatttcttatgtcgtgtatatcatatcaatcttatcttctttgcccaggcagtcgtatggtgcatatgcacacctcggagaggctagtgacgctagtcgtcgctagagtccgcaatatggtgtgcttgcacttgctccgatcgaacaatcgggatcccagacgatggctgtgccgatctcctgaaatccatgacgattggttcttgctttttagtacatatatatgtttttgatgcgaacggccgactgaggaaatgatgctgaaatcctgacagtaatgaaaccatcttcgttttctttcgtttttgaaacattcagttcatcctctttattggcagaatagatcgatcgaggatatttgcagtatatgcaatgcaatgaccatatcgtgcatgtatgtagctccataataattaattatgcacccacgcatttcaggtttagatatatactactggtctatttcagtatatagcttatgaaaaaaaaagaatcggtattcggaagatcagtgcctactaattatagttcaatgtgatatgtgtgtttttctgccatgacaagtacatactgctagtaaataaaaaaaagacactcactagaacggataccctcatctcaatcgggcacagcgtccgtcacaggctagaagtcactgatgtgaagagttatctcaatcgggcaaacagccgtcacgaatgaatatatctcaatcgggccctaagtaaagcccgtcaccgatagctttgacccagacgaccagtcaaactatagcccgttacagatgacctatctctatcaggccacaactagcgcccgtcacagatgactactaacctttatcgggcctaaactagagcccatcacagatgatactcatctcaatcgagcctaaactatagcccgtcatagatgactgatgacctcaatcgggcctaaattagagcccgtcacagatgactgctgacctcaatcgggcctaaactagagcccgtcacagatgactagtgacctcaatcgggcctaaactagagcccgtcacagatgatctcatctcaatcgggcatttagttatggcccgtcacagatgactataatccacaaaaaaaataaattttgttttttggctagcctcaggcctttgctagccatgcccgctgcaaagatgacagaaacaaacgcagatatccaatatccccaactccccagcatcacccattcatacatatgcattcacatacacagacatcaacatatttcacacaaccacacattcacagccatctcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcaccacagttgcataataagtgttcatcattgcctaaacatagaagttcaacattattcatcattttagtttaagcctaaacattcctttgggattaattatttcgcggaggatgaagctggctatctcctcgcgaacctcctcaaagctggtagtcagagacttggttattgtgccctacattgtcataattccagattagttgatcgatcatatataagtactaaaatgtagttagtctatcacaattgagaccaccgacctcaaactcagccaaagtcttcaccttttctctatacagaagtcgcatattgtggcacacatggaatccgcactggtcacctatttgttgcttcaccgagaagtcttttttgtggatgagggtgtcatgtcctgtcttcctgaggcctcctctttgcacgtattgggcccacgcttcatctatcgctagttgaattggggtccaatcatatgcgttcttatcaattctggagttcaggtaatgacatgtactccatttaggtgttatgaccagaatgatccaatgggcactgcggcattaatatagtgaaagttaattaagtactcaaggaatgtgtcatgctgttgtgtatatttagttaacacacttactattgattataggcacacataatgtacttcttgtctcggcgggaccacaaggtgtcgtagatgtagttgaccattccttgacggttattctggagatttgtgatagtgaccacttgtggatcaaggaaggcaacttccggtgcatgcttctgacaccattgccaacttaacctacacacaggatcaacgatcttgtaagcaagttaaaccgattgttattaccagaatgagttgggcgacaatacttacaaggagtagcacttaaggaggcttgtgtccaccactcagagcctgtagaggtcgaaaagatccttgaagtcgaccacgatataatttgttggaccaaggaaaggctttccatcgtgctgtccaaggatattggtagctttacttggcttcctggcgttagatttctccatgtagtataagtgaaggtccttgcaagcggtgcccattgcggcaagcacgtcatctccaaccaatggcatgcctagttggaactcctgtggagtgacgtatttcttcttgacctctttgcccttagtctcttcctggcccttgcccagatctagctttcttggagctagaagcgaggcctgcacctttcctccccttcctctcccctttgcttcgggtttatcgagagtaattctctgaggggaagagtgtgccttcctgctcttcttcatcggtgggggttcatgaatcgccttgctgtcggcctccgttcggtcctccccgaaatccgtgtcgtactgcaactgcacatcgtaagattgtgcatgacgatcttgagcaggaggggctgaaggagcagaggcgggtctctttggtggacgaccgcctggtgcagtggttggcctcgctgtaaccctgatctcaatgaggtccttaggccattggatgaaggtaccacgggcatttcctagtgagaggacctcgtcgttcggtggatacttcagagggaacagctcgtattcaggcttcaccgagtcgacttgaacttttgcacagtcggccctgagttgcgctccatgcactcttgtctctggggtcggcttgtacgcaagtccctcggctgctggaacagtgaagatcggcatcaccctaactgtgagggtgcagctcgttggttcctgcgatagattaatcaatttttttagaatattatatatcatatggattcgttacgtctttcatgtattgagtaagttcacggttaccgttatgtggtcgatggcgctgtcgaccgatgttggattttccgccaactcagttgatgcgcaactgctgcgtttttcggtgggacttcctaactctttgtgcgcagcagtagcggcagcctgggggatctgttgctcttctcggatctcttacctaatcttggccctcatcgactcgagcttttcgtcgaattcagatgtcagctcagctcgtatcgactcccggatcttggcttcaaggcgtgcatctttcttcgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgattagacacttactatagcttcgtatactcgttgatcttctacatttggcatgaagattgtgccatcatcatgtttctggtacctagccctggcccagttcctagcccgagggtgtgggatatcgccaaacacgagcggtgtaccacgattccttcgcttcttcatcctcacgctgccattcctcttccttaccggcatatccggcggtaccaagccggtgcggatgctggttcctagtctggagcaagcgatatgcctcgcttctagctctggactcgggggtcgacttcttcgcatggaattccgaccagacctgttccgtgatccaaggaaatttctctcttggatctggatttgccgggttgtagacgaactcgccgactagcttagtcttgaagttcttccaagcagtgcccataaccttgaaagcagcccgcctgagacggtcctcatgctccgcaggataatcaaagctctccttgaacgttagccaagcaatgtccttctctacggccggcacgagcttgaagtcgtcttgcagaataatgaatttctgcctccctatgaccccgcagatagacctaaatcggctcaatattttccttggagatgtcggcaaccctacggcgtctaccgctgttatgcggaaccgttccttaggaattttgttccctgtcctaggagtacgtgcccttgaggacccactagttgtcgtcgacattggttcgccttgctgagacattgtctacttttttccaaaaaaacaaaaaaaaacacaattgagtgctacaatctattacaatgaattgaatgtcacttataaaaataaatgaaatatataaataaactaaattgcgcatatcacaacgatagaatgaattgaatggcacatataaataaattaaacatatcatcaaatcctaaaatcataaattcacctcataccatctattcatccacatatcatgcatctatcactaaattgattaatgcaccacattccatctattcatcatcatgtcatcaatcaaaaaatcatccgtttaccatatatcatcaatccctaaaatcatctatcactaaaatcatctatcactaaattcattaatgaaccacattccatctattcatcatcatgtcatcaatcactaaaatcattcgttcaccacatatcatcaatccctaaaatcatctatcactaaaatcatctatcactaaattcattaatgcaccacattccatctattcatcatcaagtcatcaatcactaaaatcatctatcactaaattcatcccaacatccacatttcatcccaacatccacattttcattatcaaacacatgcaggtagcagagggaggcgcgatggaggactcacatgaggtcggccggggggggggggctcggtggtggcggcggcgggctcggtggagggcgtcgccggtcggtggaggtggcggcgggctcggtgcaggcggcgggctcggtgaaggaggagttcacggcggcggcgccggtcggtgtagacgccgatcggggaggtcggcgtcgggcgggcggcgtcgggcgtcggtgaggagtaggtgacgacgatgaggaaggacgtcgccggcctcggtgggggctgctgttcgtgtcggtgaagaggcaagcggcgacgacgaggaaggccgacgtcggtcggtgtagaggctcggtggcggtggcggcgggctcggtggaggcagcgggctcggtggcggtggtggcgggctcggtggaggcggcgggctcggtggcggtggcggcgggctcggcggcggtggcggcgggctcggtggcggtggcggcggtctcggtggtggtggcggcgagggaggacgacggcggtgaaggaggagttggcggcggcgctagggttctaaggaggcgggaaactgtagcgggacttagaaaaattttcgatccgatctgagaaaccctagttatattagagtgatgagtcatctcaatcgggctttagtatggagcccgtcaccgatgactcattttccatctttcatttgttgtgagtgtaaaatatatagcaactgtgtaataattcattttattagtcataatacattttcggatagtaaaagatttcaaatggaaatatggtcaacaacaaagttgtagagcctttcaagatctaataattttattttggtcattattctatataatttttttcccaacagcttgaaattgatttcgacaatatgacaaatctaattaatagcatttgtaaatactaaatgatttcaaattgaaatatggttaacaacaaagttgatcctctcatcacgatctacaacttttattttggtcatttgtaataaaacaaaattagccatattaatgactacacatatcaagtctttgcaataaaacaaaatacttcattcattacaatagataagtacaaatgcatcagtcacaaggttatgccttcggtatgatctgaacgagcatatgccacaggctcttggggatcatcgtcaaggtcaatgtgaggtcttacatgaagattatggttgtattcttcttcatcgacggcgttgtcaactcctacaattcggcgctttccatccctcacgatgtgcatcttcttgtttgaagggtcttttatgtagaatatctgctcgacctgtttcgcaagtacaaatggttcatcggcgtatcccaccttagatagatctactaaagtgaaaccttccttgtcggctttgacaccagtgcgtagattcacctaacggcagcggaacaaaggaaccgtgaacttgacgtagtttagctcccagatctcctcaatgcggccgtagtatgtgtttgacccaacttgatcctggaatgcatctatacggacgccgctgttttgcactgtgcttttgtcatcttgtttgacggtataaaatgtgtatccatttatatcgtatccttgccatgtgtctatggtccaagacggtcccatccccaacaactgtactatctcatttgggacatccgtggacattgtcacacgattcttgaatcattcgttgaaccgagaattatgttctctgttaatccatgcatcagatcgccccaagttctcatctcggattttcgctaagtgctcctcaaagtatgggccaacttctgccatatgttggagcacagcgtaatgagcctgcgcgtacgacgcttgatcgggcctaattcttttccttccgattgtgccaacacctgacaaccttccctcgtgacgagacgctggaactccgataggatcggcatcgaacatgtaattgacacagaactcaatagcctccttggtcgtgtaaccttcaatgatgctcccctcgggtttagctctgttacgaacgtacgactttagaactcccatgtacctttcaaacggccacatttcccttagaaaagccgggccacatagttttgtttgcttcaccagatgaacagggagatgaaccattatatcaaagaaagacagtgggaaaaacatctccaggtgacagagggtattcacaatatcggtctgcagcccatctagatcttctggatctataaccttctgtccaattgcattgaagaaggcgcacagacattggatcgtgtgacgcactttcggtggtagagtgcctctgatagcaactggcaagatttgtgtgattagcatgtggcaatcgtgagacttcattccaacaagttttagatcgttcaatttaacatacttacttatcctcgctgaatagcccgatggaactttaatatccttcaagcatgataacattgcgatcttctcatccttcgacagtgtgtggcaggctggagggaggtacactttacctgtctctgcatctcgtatgggctggagttcgctacgaatattcatgtcctgtagatcaaggcgcgcgttcaacccgtcctttgtcttcccgggaatattcaacatcaggccaaccaaactctcacacacattcttttctacatgcatgagatcaatgcaatgacggacatcaagatctttccagtaaggtagccgccaaaatatggattttttcttccacatacccttctcctttgtcttgctacgttttcttttcttcccaaactcattgcttatgtccttgaccatattgtggacctcatctccggacaaatctttgggagcaggctgaagttctctcttaccattaaaaattttcttctttcttctaaatgtgtgacgtagcgggagccacctccggtgactcatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatcgtgggaggttatagttcgcaataagaactggccaagtgctgtgagtactactcatgtcattgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgcttcgttcgggttggcaaagattctcttgaaatgatcaataataggtagataccacacaacctttgcaggaccacccctctttgacttatttccttcgtcagcacttttctttcgcttgtaacgagaagccttgcagacaggacaagcatccaagtccgcatattgcttgtggtacaatatgcagtcgttgggacaagcgtgaattctacgaacctctaaccccagtggacacagaacctgctttgcttcgtatgtcgtctcgggcaatgtgttctcaacaggaagcatagccttcaaaattcctaaaagatctgtgaaactcttgtctgtccatccactacttgccttcagcttcattaggtccaaggtaactgacaacttagtgtgttttgctttgcatccagcgtacaaaggcgtctcggaatcacttaccaacctgctgaatttcattccatctctctcattttgggctaggtcctcaacgtcacgtaacatgtcttgtagtagatcgtgatccacatcaaccatttcaccgcccaatggagaaggtataaacatgtcatgctcattttcatcttcctaattatgcgcaccacttctgtctgctgctgctccacttcctgattcttgctctccatgcttcacccaacatgtatagccctccatgaatcctcgttgtatcagatgaccgtgtacgtcctctccgctatcaaacatattctcgttcttgcaatctgcacatggacaacacatgtaatcactgtttcttcttatccgatcctcctccgcggcgttcataaaatttattacgccctttcggtactccgtagaatgacgtttcaaatttttggcatacatccaacttcgatcaattgctacaaaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagttatctctatcgggccttaataaaagaccgtcaaaaaagagtgtcatctgtgacgggcaataaacttatctcaatcgggcctctagttggagcccgtcacagatgaccctcatctgtgacgggcttcttttagggcccgattgagatatggaaccctcatctcaatcgggcctcaactatagcccgtcacagataagtgtcatccgtgacgggctttagttttgtgccgatataccatggctgtgcgaccatatctcaatcgggcgaaactttggcccgattgagattacttccttgtgacggcccgcaaattccagtcttgttatgggccgtcacagatggaaggatctgtattagtgactcctatatactactgctactatactaaacagtatatacctattgactaaataaaaaacggtatatactccctagccgatcaatttattatatattggatacttggaaaaacagttcataatccttaaccgatcgatttaatacaataatagatacttgaaaaatatagtatatactggataaaaaaatcagtatatacagataaaaacagtacatactgctagtaaattaaaaaacagttcatacctagtaaataaaaagaggtatatactactgttactatactaaacagtatatacctactgactaaataaaaaacggtacatacttcctaacctatcaatatattatatattagatacttgaaaaaacagtacataatccttaactaattgatttaatataatattggatacttgaaaattttagtatatactggattaaaaaatcagtatatactggaaaaacaatcagtacatgcatactccttataccagtatatataccattcttaagaaaaagtagtacatacttctacaagaaagtatatacttctaaaaaaagaaaaataataaaagtagtataaacttctacaagaaaaagtatatcattccctagctaaagatattatacatatagtggttacaaagcagtatttatacgtactactactatgtaaacacaactactggagtacgtagtatacaatgctactgctattaaaaaattagtacgtatacactagtactaatccacgtgtttggatcagttctgtgcatttaaaatttgtaatgcatgcactcgatcagttagttgtgcattaaaactaaagaaaagaaaatgcattgttttaaaacagatcagattcaccatggccctattagatgctattggatcatccattaacaaaggggagtatatacacttgggtgtacagaagagtcgtcctatatatatatatatatatatatatatatatatatatatatatatatatatataaaacacaactcttctctttccatctgtgtttccaactcttatcttcacaaacctccaccacttattatcaattatgccagaagtaccccccccaaaaaatgccagaagtacactattaccacttatcacccatacgttttgaaacaaccacaacgttaatcaaatagggatatgttaatgagacatctctgggggaacagggaatttaagatcaacatgggagcgtggagtaggttgggtccaaaagggggaactccaacatattcagcatggctttcaagggggacatgattagaaatccaaatacccaatagttgcaagtctgaaattgattgatactttattcaatggttcttatttctagtgtttgcacacgatagtatgcaacaccttattactagagtacatgtaaccaacgtttgatcaacaacaaccacaagaagagagttggaagttgacaggggccatgttgcacatgtatggcatctgcatcgccatgttcatcatcatctgctgctgcccgagtccagcacaaataacttgttgcatgctctgcatcatctggtaactggtgtcacagttgcactgaggcatcatgccttgcagctgcatgcaacattgctgctgcaggggagccattggctgtgatatgaacatggctgtggagctacccatgcccaacgtttgcatcatgtactgcctatacggatccgtggtgcccatggctaatgttgctgggaaatactgcatagtggtgattgcagtagtggcacttgcagaaagagcaattaaggcaaacagggcaaatatcttggtggtgtatgctgccattgctgattctacagtactagtgttaaacaagatcctagatggtgtagacaatattgttgagggtgatggaatgatggttgcctttgcctaggggcctatttatacatgctagtagctatagctgtgtaagcttggaaaaaaattggcctttgcaaaaccacctagtggaggccacataagctagaaatcatgaaacatgagaattatttggacatttatccaaccaatactttggaatatctaaacaaagatagttttgccaatgctttggtgcatggaaagaaaatatgttgataaggctgtgccagattgctttggcattttgcaaagttaagttagcagttttgtaaattatgagctaggtaaagaatcttttagaactgaatttgtatgggacttgtagaatgtgttacacaagtcacaacttacacagataacaattaagagtatgagtcattgccatatgtgaatgattgagaaggtaaacttggatatttgtaaatgtactttaatagcatacatacatatgcagtttggcatgtatttggagttttgttaacaagaattggaagtaacgaacattgctataaagggaaagaagtaaaggagaaacaaattttgggtccatcccaaaaaataaagcaatgattagagtttggccatactctttgctatcctactttccatgtatctagtcctttatcttacaaataaagagaaatgaggaagtaaacatatttcatgtattcatattatgacgagacccattttttaggcagaccctactgacactatgcaagtattaagttgcattattttcaaatttaactatgtcataattatccagttcagaatcttcatgcttttagttgcattataaattgggatggagaactatacaatgtccatgttcataatcttcatgcttttagtgctatagtaatagagttgttccaaatatgatgtatagatcccgaaatttccatcctggattgaagaaacactactaaaaaacgaatttcctgtacgagcccctcgttagattccagacggtccataaatgaccgcgtctggaaaaatcatcctcccatttttgcgtgcggacccttaagaggaccg

SEQ ID NO: 3078 - DNA, 31980 bp, Oryza sativa
gcacgcaaaaataagcttatttttacaggcagacctctcaagagaccgcatgcaaaaatagattttcgcatgcaggcatcttaagagcaccgcacgcaaaaataccctcccccctcaggcatttttccctctcaaccacttcaaaaatttctatcttatcctctccaactactcatccttatcctcatttcttctatctctctcatctctcatgggcggcagcggagcggcctcgcactcccccggtggcggccgggagcggtggcgggcggcggaagcgcaacctcgcgtgcaagctgcgaccgggaccggcagcagcgcggcctctcacacgctccctggtggcagcgcccctcgctcgcccggatctagaggcggcgcccctctcctgcccggatccggctgtgggcgccggcggcgacgcagccgggagcggcggtgggctcgggagccggccgcggcggccgatcgcggcggaagtgtggcgacgctgacaacgacgatgacggatgacggcgatgacgatgacggcggatgacgacggcgacgatgacgacaaccacgaggagggcgtcagcttgggttagggtttgaatattatttttttggggttttttttcgtgcgggtgacataagccaccctgattttcgcgtgcgggtgcatcgcccgcacgaaaaaaaatcagatttttgcagacactttggtgcagacaggcaggagatccgcatgcgaaaacccttttcgactgcacggaaaaattgttttcgtagtagtgaaaaattcaaccccactccgaagccatacaacaactcacaaattgcaatcgggttcaatgtggtctgccaatccagatgactagattgtgataaatctagggttaaggcttcatagaagatagaactgattcatatgctcaagtgaagtattgttcattgcttgagtagataaaagttccaaggacatgattttcagtgaactggatggagaaaactattgcacatgtaagatcaatatattgctgaaacagaaaagatctatcggacatgctggcaggtaccaatgtactatgaataaaccatcctagcgagtacttatcttgttaacatgttatatgtatactaatatatgtatagtgccagctcattgaactcaaatacaacaactatcgtttgacatttatcatgaataccttcaatgtgatcttccctcagctagaatgaagttttctttcgctctcatgaagttactctactaatgagatgtatatggttgacaacttggcatgcattttccagtttcacaacaatatgttcattatttaaggtccgcttgcaaccttataagggctctcgtatagaaaaaaagtcatttttatagtagtgtcataaccggggagaaatatatactactaacactataccaaaatataacaacttttagccgtgaatctatagataagtatttgtacggatttgtagctaagacttatttaattttagaatggagaaagtacctctgtatttaaatatacaatgtcctaggtattatttgtctttggcatacaattttaaccactacatgtattattagaacatggcgataatatccaacaaaactatatattatagaagtatttataaaaaaaattgaccaaaaatgacttatatgtttgcaagctaaagattttgagagctattgaaggtaaaaattgtaaaattttgaccaaataaagttaatagtgttatattttaaatatggaggggtactttcttttatatcgttaatttttcacaacgatgatcatgaactcttctattttgatctttggaccataaggaataattactccttccaatttggagatatttaaccatttgccatatttagatgtgacaattaactttttgccattggacccacatgtcatagacacatgtggatccacatgtcattgagataggggtggcaaatagttatttgctaaatctaaaagtggcaaatagttaaaagcccctctaatttgtcctctccagggattatatcagatcatgagagcctcttaacgtctgtttttttccctcaaacacacagtaaagttaagcttcatttcgttaagaaaataagagaaagtaaagaggaaaggtcaaactcaaagaaacctctaaaaaaacaaccataacacttctacaaacacgccagaccagtagaactagaccactatgatcagcacattaccaactagattaagcatctagggcgagcgactgaagaaagagctcatgcagtacatcatgtacagaagctccagcccaataccataagctacactcataagagctcctccactgcaatgataacacaatcacacccatcaacaatttcttaaaaggtaaggcacacacataagaaaaagcatgaactagaacatgaaattaccttccagactaagggaggaagagaaaaccaacctaggatacaatgttaatgtggcacctctgcatttcttgatgtgtcccagtcctagtcctgtatgtctatcagttctctttctcattgcaagttaatccaatttttaggtatcacaaaaaataagcttggaaggtgcacactagctattaagccaacatatatatgcacaaaatttccatctcttccttccctcaagtaagctgatttcttttttttttctgaaatcctaagcaagcatctcctttcttcttccttataaagagtgagcactgaattaatttggttgcatctattaggtcaagcagtagaaaagatgcagcacatggtttgtaattgagtgcagactacactgagccaagataagcatttagtgtcagaaaactccatatgaggtctacaacgattccaacattttgatcatactataaaccatttacatttgttaaattgtgacaacgaaaagggaaaaaaaagagaagaacgtggccatgcatgcacggtaacaaactgggaagcattatcggagaactgacacacatatgacttggtgagactattggtattagtttttattataaatcaacaccaatgagtgcgttagatgccgattcttaatttgatcccgtcaaaagggatcatctgtgtgagaaacctttcataggtgtcggttttaagtaaactggcacatatgagggcgttacagatgtggtgttcaggctatcacaatgcttgcacctatttcttgatgtgtcccactcccactcctacttctccatatttatctctactatatttgtactgcaaaataaaccaacatatatgtgccaggaatcacgactgttctattcatcaattacccaaagtggtaagttagacactgtcacattgcaaagttcacatgtaaaggtatggcttataagggagacgaggtgcttgctatggattccagagcttacatgagggaaggtagagatgggacagaatggcatatatgaacatgtgtaatcttaatatctagtgtgcacaagttaacctccaagttcattttgtgatcgctcaaaaaaatggtttattttgcaatgccaaagagaaccgatggagatggtattaggattgggacgcatcgagaaatgccgaggtgcaaatattaatattgtagtctaatgtggtttcctcttccttaatttgacaatctggaaggttatttttcctattctaattcaatgtgtttcttatttataccatttttgaagtagctgatggacttgtgtttgtattttagttaacaggaacggaatgatcctgttgtgaagttctacaattccggaatccagggcgtgaatgaagttcttcgctttcacttcaacgtgaatgaagagatcggtttattaaggataggggaaatgatacgtttttttccattaatcctcaaattaaatgtggactatttagtacaatatttttctcaaaatgaagaaaaataaagagcaaatattgaaacttgagctgataaactgaaaaaaaaacatcaattaagtaaaaagccatcttattcagcttgaaaaatatcgcgattatctgaagatcacataaatgaatagccgaatcaatccgtgaatacttttttaggtgaaatgcatatcataatttatgtttcatttagggaaaaaaactgattaaagagtagtcaaacagaaaaaacctctcagattaattaagttatgcagtcaatgaaccattttaagtaatcaagtcccgagtatttgttgccttcatccaactattctgctcattgacatgaaagggcaatagctcagtaattagcaagcacatgtccagccatcagctgttgcaacctaaataatacagctggtgactaatcaagtgaaatacattccactaattccacctgaagaaaattctcaactgggggatctgccatgtgactatggaaaaggaggaggggagaggaaaagggaagatgagatacaatagctgatttcacatcatccggtctaattgagtaactgattttaaggagagggaagacttgaactcacaactttaaccacacaatcttgctcacctttgacaatccttagttccttacaaggactttgcaatcatcatatggtagtgatatagtactaagcattgcaagacttggaacatgaggtgttgctgtatttacaagggatcagggattcgaactcgagacctatagatacttttgcgagattttagacaatgcttgctgcttccaattgcctgcacattgtttcctcaaatttcagaattcgatgcgatgttttgttgcctgacgcgtcctcagtctgtcatgcaattgaacgaccgctcctgctgctctactgttaaataaaactcgtccaaggaccaaacccatgaatgaatctgaatacctgatgctaatcttttttatatcactatggtctttttcttttgtcgtcaccatttaacagatgtagtaatatatagtttccacagtacgattaaattaaatggagtcgctgtagacttcactatgaacttattctgatactaaatgtagatcttggctcagtgcacggtcaactgaattcccagctctttctaaggagaaaggagatgctaaggatttcagaggaaaaaaaaccagcttacttgagagaaggtaaagataggagggttcaaaattttggaccggaatttcagaaatttttgaaatttcagatctatcagacccacctgatacgaaattattttggccaatgttttgggttttctcaaacttttgtgaatttggcaaaagttagtcgaatttggacaaatcttgttaaaaaaatttaaattattttggatcgagatttctaaatttcggctatatcagtacctccgatagaactactgaattgaaaaattgaaccctgatgggacaaaatgacacatatgagtatatgttagcttaatatatatagccagtgggcacaaacttcccagttatattccgcacgaagaaaaacttccctgttcattttgtgatccctcgaaaattgggtttagttcttcaattcaaaagagaagaggtggacgtagaacgaataggattgggatgcatcgagaaatgcagagttgcaaacatggacattgcggcatggaaatttcctgttctaattattgcatgttatttcttatgtgcgctagaagcaccatttcgcgaagtagatgacgcattactttggatgtctttgtgcttatgttgcagaaaaggtgctggtctggtctggttacaaagttctattataccagaaaaacgttcaggacaggaatgaagttcttcacttcagctttaccatgctgttttccagtatgatctttacatccattcatcaagcatactgtgttggacttttcatgtatcttttctcaaaattaagaagaattaacagtagacatgaaatctgagctgatgaataggctttgtagaagtaaacattttctcattccacctgaaaaatgttttaagatagcaaaaatgtgtaacccaaagaatcaatttaatgcattttcctaagcgatgcacatgataatttatgtttctccttcatccaattattctgtttattagcaatatgacacgattagattggctcattagtaagcaccatgctgttgcaaccaaaatacagttggtgactaatcaagtgaaacactacacttcttaatcgtgataactgaaggatactctctccatttcatatcatgtcgtttgatttttcttagtcaagtttgaccaaatttatagaaaaatatattagtattttcaacacaataaaatatattatcaaaaatatattcaatattagattttatgaaactagtttgatattttagatggtgctaaatttttccataaaattagtcaaacttgattagaaaaaagtcaaacgacttgtaatatgaaacagaggaggtattctttgagagatctccaaggactgaactcattggagggtaggtagacggaagacgaaaatatataccaatagttttattatagtatctgcgtaaataagttattccgtagcagctgattttaaggagaatgacatgaacccctaatatttaaacattatagtcttgcgcctctatggctatatgcctcccaaaactttgaaatcatcatacggtatagtgatggagcgatcgacgagccgacgagcattgcaaggttaggaacaggaggcgtttgggaacgtaccaaagcatgaaagtgaggatcttgaactggttgtgacaacacaagaggttctatcctgctagtccgtaatcatcatatgctagtttttgcttttcgatgtcccatttttcttcttttccacagtccctgcacatatttgatcctttgcgtgagttgtgaatgtgagaggcatccagtaaaacaacatctgccgaaaacacaagttctttcctctttttttttttaggaaattggagcggttgaaacacatttaaccattgtaatagcatattatgaacagatatctactggcccgtagataaaacccaatccaacactgaaatcaaccaaaatcttcatgctaatcacagttcccctgaacaccggaagtggggatttatgcacaatgctctggagcacatgaacaaaatattcagaattaagacatgaatgggaaaaaaaaagagatcaagatcatgatcatggacaattgtgctacatacatcatacatcatgttttgtttatcttagatggcctacaaaaatatgtaatacgattcctaggatattgccctgatttcacatactatgtgggatcagcttaagcaaacacatgctgtgatttctgtgcaactcttttagcatgctctctgaaaatatgaattctggtttttactgttggtggaagaattcagtaatcctatgaatgaatactatagtgagatacacatcatctaatcgcatcccgtaaattgattttttttttaaaaaaaagaaatttggaggctcaaaccggcccacaaaagtttgcacacaacaagagcccacactaggacagagagaaccacataaagtatggccgaagaaaaagttttaaacgtttcagaaaaaagaggtaagtttttaaggaaaagtatgaccaatagaattgatggaatttctcaatctgagtcctagatagattcatgtttaccaccaaaaagcacatggtggcaacatgttgcttttctctggggatgcagtttcatcattcaaatcataggccattgttttatttttctcgacgtaagaaaaattaataaaagaagaaacataatctccaaacaattgtgaaaggtactatatattcaaacaatataaatcatccaattgctctagacacagtgatcacaatagaagattaattattcttcccctactacaccactcttgacaatcttcctaccctattgcagaaacaagcatcctcgcattttgcacaaacaaattaaggggatggctacacacagatgaaaatgtactgcttttgagaaattaatatatttcgtggaataatcaacaattccacacaggatattaaaactggatcagatgcatgtatgttaatcttagaagatatcaatacagaagcatgtgcatctctatgaaaaacatttttttaataaaaggtaaataataaatatatgataaatcgacaaaataaatttctgggctagtcatgaattggcttagcccattactctctaatccacctataaaatggctttgcaatcgataaataacgtagccctcacgccgccgccatcgccggagtccgccgccgccgccgtacacttccgccggcggcaagggcaaccatgaagtttttgattccgccgccgctggttcggccgcctcctcctgacctctcctacatcaaccgatcgtaccgatctgtccgtcgacgagaagatcgagatgataatctaaggtgcgttaattcgttcattccttcgtttcaacgagatcgtacttacgtgccaatgcaagctgagatcgatcgatcgatctcagattcagttgccctcctaattaaaattaactagtagtaataactagtggggattttcttcttgctgttcttcagaaacatagtggtgcacctataccattcgaggagtcgcaaatccttgaatattacaagaaatttttggcccagtactctgactacgaggatgaggattcagaggaggattcagatgaggaggattcagaggagggggagaaaggcaagaagaatgtatgttaaaaggggggagatgtgattttatcacaactgtctgtctgagtgacagtttagaagaaatcagacgattggagtttagcgtctcccatttatctatcatttatcagttaatcggcgtatataagatgctatcaaattcatgagtaaatttcagaaaatctcaattattatggtcaaagtttcagaaaaccacgtgaactttgacatatggcacataacctcaggtattatggtcctaacatttcacaaagccacatcactaattgttttgacttgatttactaccttttaagttctacaatcacatcttaaatttatgagcattttattcctaactagaaaggtagcccgcgcacatgcgcgtgcaactaatttaatatgtgtgaaattttattacgaatatctatgtatgtgactttgtattaaaatattactttactatatataaattattatttaacttatttaatgtgctttcaacgtgggttatgattttcttctaattacccttgcagcacataaattctaaactaaaattacttaaaatcgtacagttttcactttatgagataatattatgtcgagacaatagatgtagttcctatgaaaaatttttgggtatttcaactacccatggggatatctttccccaaacatttgctcaaaaagtccaaatttttatcagattctattcgaaattttagatattttcgttctattagtcctgctaaaatatttgaatatttccatttagaatgggttttaaacccaacaattttttaaaacatttacataaattttgaattcttatcatgtccatttttaataaattggagaattccattctaccaagcatctttgaaatgatttgatctctgcaatttgggttataaatatatgtgggttaagcctacaacctgacatggggtaaaatcatctattctaattatctctctggaattgagtaagaatatgaaaatagaggtcatataataaatgcacatttctatattattctacagtaaatattatgaatttacgatgtagcatagcaagttttaccaaaaagaaataaatgaacatggtctttaattccatatggaattaactcactatattggtaatgccacctcagagttgtttcactgctaagatttcttggtgcatttcctcaaaaaaaaaaagatttcttggtgcaatccacatgtttggtactatcagttggatgttcaactgagcatgtttttttacttttaaaatgttgtctataaaaaattaacgctagatggagtacacattatgacataaaaattgttatcatttaaagatttttttctctaatttattagtgacttcatagattatatataattttatctcctaaaaatatcatttattgataaaagcaccaaaatcaaattgtataggcaaattaccccatatacatgttgagagaaattaattaagttgatagaaagttgttatgtgtctaatgggatacaagtaataggtctacaggctttattaaaaattaagatgtgatattttgatttataatgatgaattttcatttttgttttactaagtggatgcctcaagatggatgtgggtccggaatgtaatttttatgttaacatttaaatatactcaatatggatattaaagttgatttcactaagaaaatacaatagttcaaacaaatcataagttgaatatatgatttaaaagattatattattttatttatattgttcccataaatgttagtaagatgagaaagagaagaaaagggatcatgggagagctagctagacctgttatgtggaggtccatttgtggttttttcccatgaagataattttaatttcaattattataagaataaaaataagagaaaaggatgaacgatgcacaccatatagggataaggtgggcgagatgtttttcttaaataaattattgatatatttttttcaaaaaaataaaagattgatataatgactaaaataatgtgttggatgtttaatgtataaggctttaacattgttgggtgggggagagaggaaaggaggtttgtttctttttttaaataaaaatctcataacaacctaaattctatgcccatcgatttaagtcgaaaccaatgattagatgttttattcttaaatttttattatttactctatttacgaagtgttacagagtggtttacaaacatttataaggatggttaatgggttttaacgccacatatgaacgcgaggggagtttgggatgttttacgtaagaaaaagatatatataataacctaaaataatgtaaatcgatgaacgaatgttttatatctttttagattttctctaatttaggtgtcaaatagatgttcggtaatatttatatgatgtttaatagacttattaggatgggctagaggaagaatagatctagtagattgatggattttttaggcatgcatttttctaatttaattattatggaaataaaaaaacgaaaaaaaaatggaaacggagggatcgtacgtacgtacgttgctgatggattgatggaaagtacgtacattgcggaggcgtcggagggggattttattttaatgtaaaaataaatctaacggtcaaaattaatgagtccaccaatttaaatgaaaatcgatggttagatttttctattttattagagtgacatgtggcgtctcgagagcgtttataggatgccacatggcggcttaggagtgtttatagaacgtttaatggacttttagtatataatagatagaagatataaatattacatccgttttttctattttgatatagcagtatgttaaaatggttaacaatatgattttgtgaaactttaggatcataatacatggggttatggtgtcacgtgttaaaatacatgtggttttatgcaatttggatcataatagttagggtttaagaaaatttactccaaattcattcgtttgttcgttcattcattcaatgtgtattaattcaagtgttgggtgatgaaaaggaaccgggtatcgtgaagcgcccgccggaggcggctcctcttgaaggcgagcacgagtgcaagatggcaagaacagcaccaccgcaaggaggagaacataactcgtagtcccctctgtaggtaaaccctacctccgttttcccaatctgcaacgtgtatagatgcaatttatttaaatgatctacactaaatggttaaacaagcgtgtgtcttctctattggcttggcttgttcatcctaaaataacccctcaaatctagttttaaaattatcctgcctatgcctttgtttatggacaaataatagagcagtactgttgggttcttatttgaatgtactttgatatggccatggttgtgtggttgttagcattgtaccatctcaaataattagcagtactccgaactgtctgaataaaaggtcccagaactcgagttagctgaatagtagattttttacatgttggactctttaacagaaacaatggtgcagtttcatggtctttaaccaagaaattaggtgagggcaggaatgtagttaaagaggggaaaaacataaagtacgtgtttagtgtcaaatcgtttggttgcggacattttcttaacctgcaatgctcaattgcacaacttttgcaagtcattgcatcacttaagagtttatgcagtagtagaatattttttctgtgtgtttccaagttaagagtacatgctctataagtataaataaatgaatcaaatcatcattgtaatacagacaacaaacataaaaggccaccaaatgcattattgttccggtgatttctcctgagggagagggaagaaccattttttttttcgctcagaatcaagttcatagctgcagttctttgttaaatatgacctatatttatcttcatcgcatgatatggtgtttttgtttagagcaaatttcacaaaaccccatgtttagaggcaaatatatcaccaagccctagcatttttttgcccccacttaacggcaggcacacaaccaatatactgtaacagctaatccagttttttgacattacacatagacacatgggcactgagctggcagcacaatccttgcaggcttgaggcaatcttgtcctctaaacatggggctttgtaaaatttactcttgttaatcttttcatccatcgacttcaaaatgtttctatccaagcttcgtgcagttcctttttaacccagccttgaggtttcgaactgttgcttacatagatttggtttggtttgacaggatttgatgaagacaggagaatgcaacaggagacgaacttgtgacaattttctgcattacttgtgctccgttacgtttcagtggcaactgaataccgaaactcctattgggcgattgatcgccaggggccgccaggagcgatcggatcgggtctccccctccctctacctagttttcttttttggcaccacattactttcctattttagtaaatttatgcatctaaagtttatacacctcaagtttacacatctaaagtttaaagaccaaaagtttataagtcaaaagtttatatatccgattcaaatttgaatttgaattcaattttttttatatatagtatttctatatatctaaagtttatacacctaaagtttatagatccaaagtttataaatcaaaagtttacatacccgtttcaaatttgaatttaaattatatctgattcaaatttgaatttgaattcaaatattttctatatatagtatttttatgcatctaaagtttatacacctaaagtttatagacctaaagtttataagtcaaaagtttatatacccgattcaaatttgaatttgaattatatctgattcaaatttgaatttaaattcaaatagtttctatatatagtatttctatgcatctaaagtttatacacctaaagtttatagacccaaagtttataagtcaaaagtttacatacccgattcaaatttgaatttgaattcaaatatttttatatatatatagtgtttctatacataaattttttcaactttatttttttatttttttttaatttatagtgtagtaggaagagaagaaggggaggaggaaggaaggagaggtgtgtacagggggcgtggggatcgatcgcttgatcgatcgcccattagccacactgtaatcgtaatgttgggtaatagcaattgtgaatcttattaggtaaaccttttattaggtggatcttgaaccatatgctactgatgtcgtcgtttggttttcagttctcatgcaacttaattatggcacttgtaataatgtgttcatcaagcattattgtagctttattgctagcgttgcaaaaaagttctcatgaaacaaagagcgagcagatctgttcacgagtgtatgattggtgctgtagccagatggctaatataatcttaacaaatttcacttaaaattttccggtatttcagatgtcggtacgtacggatccttataatcgtattccttcgggttatcgagttactgaagacggccacagtttgaacccgagtgatttctgtgtgagctttctccgtcttttttttaaggaaaaacaacactagattgtactttttcgtgggagaaaaaatacaacccctatcgtgccaaaaaaaaaaaagctctttctccgtctattgtctcaaccaaatgttagttttgatttatatttaagtaaggagcttaagcttactgtgcatggtaattaacaaattttaccaacaatctattattatatacttaaaaattcattaaactttttacaaacttttctaagacatcatgtgatgtttctacatacatcctaaaccgccacgtaacattgtctaatcccactattgattttcacttaaattggtggacctattatttgacattattagattagatctatacatattatcaattttcacttatattactatcggtggacccatagatcattagattatgtaataccttcctcatatataagagaatatataccgctgaagggagaaaaaaaaacatatatacatacagtatgtatgatttggaaaaaaaacaataaagattaagtacagttcggtggaaaaaaaaacatgtccacatacataagataaaaaaaaagataaagccacgtgtaaaaaataaaaaaaataaagccaacggaaaaaaaatcgaaaatagaattttcgaccatatacgataaagtaaaagaacatataccataaaaaatgatgatatttataatataatttatatataaagataaatatattatttcataaatataggaagttaaactagatcgataatataaatatcaaatatcgaaccaatggtctataaacgttcacatttgaaaatatttttaaattatatatccaatttgtgatatttgttgtatacctttaattaaatgaactattgatgtattataaaatttatattattgatatttgtagtatgtcttatttgctagttccaaactactatgctcagtactattattaatgttaaaatattaaaaaatatataacatacgaaataaattgtttttcaaagtaatagcttatttttttaaaaaaaagggttcatttcaattagattgttaatattaattttagaaataaataaataaaattcttagttgagattttaatatggatataacttcatatttaaaattcattgtttttttaaaaagaaaaactaaagagctaatttacaatggcacaatatatttaacacgattagtatattctgtaggataaaagaatgatttaggatattatatttaacacgattttatattctttaggtataagggtttctatgttgcgataaatattcatgatcatatttgtttcagtttgtattcactctatgactatattcgataatatttgattatgtttcgaaatccaaaatagaaataaaaataaatatggtagataccttccatccgttacaaagccgttttcatccctaaccggggctccactgaccataggcctggatggcggttggtaggattgtggtggggtaactgaggcaccaacaagttaagttgcgagggacagaggatggcgacaaggaaggggactgtgcagcaagggaatgatagaagttcaggtaaccattatatatgggtctcatcgtgtgaaggaagatgaatattgggtcatcaggtaggcggccatgggactctcaagtcatggctcgagagtagaagagaatgaggaagggaaaaaggacaaaccgtgtgtgatcacgcgtttcacgcagcggcgcatgaattaaaatcccctggctcatgttgacatagtaactactactaactcaggaccaattttttaattaataataaataatattatttaaattaaattattagtaattagaggataacatttaccaaaataagatggacactaatagaaacagcgtccagatgtggacgctattaccattaacgtacagatgtggacgccaattggatcgacgtccaggttggtgcggtcataacctggcgctaatcatcgcgattagaaaaaagaaaaaagaaaaatcccccaacgctagggcagggtgcctctgccgccgtccaaatcgacgccgggagtctgccgccgccgccggcgtccgcctcaacctctggagtctgttcctccttctaactgagcgtagggactacccacgaggcaaatggcgcggcagcgctaaggcagggggctgccgccgccgccgccgccgtcgtccacctcgatgccgggagtccgccgtcgccgtccaccaccaccggaagaccacgccaccgcctgaatcgacttttgaagttctgagaggtggctgccgtcagccgcttccatccgtagcttgctgtcttccctggaggctgcagctgttgtctgcctcgactcctgccaagtgctgtcatctgttctcatcttggaagcttgcagccaccattgacgtccaagcccagaactcctacagtcaaggtgattcaactaacttattttgttgtagcctatttaataaacattttgggacacaatttatggatggtaattacaggagatggagaatcaagaaccggcttcacaacttctaaaaaaaaaagaaccggcttcaaaaatataacataggttcatcctgataagtctaatgtataatagagatctttataaaatatatgtcaactgcatcagagttgtcattggagttccaacttcggaactggaattacatttattcacacagtagaattgaaatactaatttagcttattgattgttaacattttgtgcagctaaaaaatggctgatagtgatcggttcagtgatttactatggatgcctcatgggcagcacaaagtatctaaaatttcagaaaatgtgagttgtctacttagtttggtttcttgtcgatttgtaaatatattcatctaggttcccatgagtaattgtttttatctttgatgtagcctagtagttcaatgaatatacggcaccatcgcgttggaatcccttaccacccattgtgccgatcggctcaacaaaatattagtttctatcaaattgcaaagatgaggagtatcaaaattgacaaatatttgatatctgctttggtagaacgttggcggcctgagacaaatagctttcatctaccgataggggagatgacaattactttgcaagatatcagttgcctttggggtttgccaatcagtggaaaactaattgtgggccaatctgatggaaattggaggatatgattgagaggtatcttgggattccaccagaagatcaagaaataaagaagaaaaagaggaaaaaggaagatgatacatttgcactgagttactcacgatactccataactctgagcaaattgcgtgatcactttcgtgtcatgcccagtaacccaacacaacgggagatcgattggcatagtcgagcacttgtcttagaaattcttggctccattatttttactgattcatctggagatagtgtgcctgcaatgtacctccaatttatggataatttagcgacccgcactgaatacaattggggaggagctgtacttgctatgttgtacaggcagttgaacaatggtgctgagaaggcaagatcaaaaatttttggccctctagtattgttacaattgtggtcatggtcacggttgccattaggtcgtccaaaaaatataattcaaaagacggatgaagtggaggagcaagaagaagaagaatcagatggctatcctatatttggggccaaatggtgtagttatcatgaattccccaccccacataattgtggtaatgttttacatatcttttgaattatgtctcattgtatattcttataacaaacaacatatatgtcaacatgcttatctttttatactaatattatacaggcactcaatactaccgaaaccaaattgacttgattcgagaaggtactgtacaatggcaacctatgaaggtctcatagagcagatgcctatccaaattcagaatgaccgtacttggtggtttgctagactacctctcatccatttttgggttgtagagttccattatccagaaagggtaatgagacagtttggaagaaaacaattaattccaccatcgcctccacatggtgaggttgagcttcggaagctacgcaaagtgaagcatgtaggaggaaaagtgtgcgattggaataaattccatgccaaatatgtgcaacaatatgatgggattgaagcaacaatcgttcaagaggattgtcctttcgacgtagctagcttaaaggagtatagatgttggttccaagcaaatggtatgttcactatgttttttgattctcaatgcttgggaggacttgaaaactctatcccataccctcgagataacatggagtggactgggtacatgcctagtggtccacccctagctcgcattgtaagttatagatttcttccaattactctttatattgcagtgacaacctagatctgattttaactcataattgcagggattgcgtgagattaaaaatgcagcatggggaatcaaatgttgtataactaatggatgcaagaagataggtaaatctatattgatcacatgtcaggggaatattagggatcttaacttggaatacaaattgcaaaacatgttatctgaggctggactaccaattaaggttgaagaaattccatctgatgacgatggcactactgcttgcacgccaagtcctccaaatgaaagttccgttgatatatttgatgagtggatgatctcaggaaaatgttttagtagatatattgatctaggtgtggaaactactaatagagttcccacaacacaagatgcaagccaagtgactcaatgtttggaaaatgaagatctggtaaaattctaacacttgtgtgtatgcaaattaactttgtaatgtatttaatatatgatatactattgggtgacatgacaggtggcttcaagagaagcatcagctccattgcatcctggtgaaagaacgtcaagtcattcagaaagttctatccaagtggttgattggactagtactgagaggactcctatgttcaaaaagaacactccaagttaggaagaccatatattctgttggatataattttgtagaacttttggagctatatgttctaaatatatgttaactagaaatcagccactccaagttaggaagaccatatattcctgttgacatatatgttcttttcgaccactgtcttatatgggtgctatactatgtaaaatatggtcatgctgtcagtggttgaatggcgtgttactttactttgtactgacttactatattaatggatttttatgttgccaacttacatcccatttgaatgagcgcatgctatttacttcagtttattgccacgatatgtgtgtgttgtagggaacaaatccctgtttaaacatgtgctcagatacatcctacaaatagcagtacagcagcaattctgttgtgtaaatcaaatcatatgaaaaattgataaggtaattcaaattgaactgtctgtactctcaaataaatacttcaaaaacaacgttcgttgagctccattcatgttcaaagccaaccagaagaatgtcctattcctggacaactataagctaaattgacactgtaatttatagatagactacacgatgcgtaaaactatatggtgccagagggtccatcaacatgtgttctgctcgacgttgcacctacaaaacaatcaaagagagtcatatatcaagtaaaagttaactaaccattataatgcatataattcccattgtttgctacctaaattgtcactatctcttgtggaacggtgtgcctggtgtccaagtcgtcttccttgcatttcatccatgtacattggtatcctgttatgctgacgacggcctagatttatctgtctaggatcaggaacaattattggaccagtaaatggtggccattcaatttgatttccataaggaagaaattgtatagcccaggtactagcaagtgcttgagaagagtagaatggattgatcaactgattttcattaagatttctatgtttgcaaactgccaagacatgagcacatggaacacctgtcaaatttggcttttgacagtcacaagatggtgtgttgttgggttgcaaaactaccttatacttgaagtccctccatgtgtaaacctcatggtttccttgttgcattgggactaactcattgtcgacctttacctcatatattccaacttcatctccatacgagattacattcatatgtccagccttatttcctcgcttcactaatagcttatcaaccctttgagaccattgcttgccattgttaagtaaattaacagcatttcgccttctctcaacaaaccattctaagcactttgaaaatgtttcctccacaatggctgccaccggtaacctccgagaaaacttaaacacattgttcaatgactcagatccattgcttgtcatgattccccaacgatatcctccatccttgcattgaaataccttctcgagcttttcttgctcatctttatcttcatgcaagtactttccaacatttttaatatatgttattgcctcaggacaaatatttgcaattgatcacattccttcatcaaattttctaggtttctttttcttcactgtccacttaaatgtcttgagcattatttcattgcgacaaaatttccatagattctcagctacatgctgtgagcaaaggcggtgcacacattcaccggcgctctcattccatccaatgtggggctgcttaaacaaccatttcatggctttatgtcgatcagatataacacacataaactttccatagcctattacctcacttcgtagccatctcataaaccacccctagtttgcactatcttccttctccacaatagcaaatgcaagagatagtagttgattgttagcatcatatccacaagcaatcaacaatctatccttgtacctccctgacaaaaagcatgcatcaacacttataactggccgtaggtagggaatgacatcgatacaaggtccaaatgcccaagcaacacttttaaatgctcgccgtccttcctgagtcattggctttgacaaaaggacatactttgtacctaggtttttagcttttatagcctgtaagaaagggatgaggaggccatatgaaccttcccaactaccaaaaagttgtgctattgccttctctctgcctcgccataatttactataagatggcttcacatttctatatctctgttggactagtgacctcacattttttatactcaattccagatcatcccttaatgcatcacgtatcacattagcaatcatagaagatgataactgagcatgatcaaatctatcagccggtgctcaacaggtgtgagcatatggacatttccttatcatccaacctgaacctatctttgtgggagttgcatagagcctccacatgcagctattatccgtgcattcagctacaagtttagattgactacttgtgttgtacttgatttctgaatttttacatatatgaaactcacctatagcaatttgtaggtgcttttttgaatcaaaagactttccttctgctagtgggttagaaaattgattcttacgtccaaagaaactctcgtctgctgttgtctccctcaatatagatatatcactaaatgcttttataggattttgtccagatgcacgcataaaaggaaatgcattgacagaatgaacaactcgtggttctggtggctcatcatctaaactattatcaagggcaccatcacaatcctgctcgttgtcatcgtccagtccaaatctatcctcaccaacatatgtgtcttctgcagtattgtcatcatctatagttggttgtgttttggaaaccacattatcctggttgataggttatcctggttgataggtgaagacaactgaactgttgttgaatgcagaccatctactaaagtgggtacaacctttgcttgtgaatgaactgtacctggctccaacaaaacacctgagccatccctttccgaatgcctagttgatgcaaccaaggttgtactattaacctgacttaatcttgcttccgtataggcgcattcaacataaagctcaacaacctacccacatgtcttctcaaatatcatcctccatcccctgtcttcataaataggaatcaattgaaaatattgtggtccaggatttccgatatcaaaccgagcttggatattcattgcacaatgatcctcagtgtatccaagggcctgaaaaatttcttttttgacttcctcaaaggttgtagcctccactgccggaaaagttatttttggaggaatattatattctgcacccttagctccatattgtattctcccatcaacatacactagaacaataatcattttttctcagtcaaatctgcaaaacaaactaaacaagttagcaaaacaagttatataattaactttaagttagataataatctgctgatatatcctttcaagttttaaaaaatgttgttttgcatattaaaaatgtcaatgaacaatagtcattttatttcctggctgtgtcttccaaacgaactcaacaattaacaaaggcatggtatatgtctactagttggataataatctatacatatattcaataaaacactcatgtcatatatcaagtatagatatgaacaatgtagtacatatcaattaatgctaattagatgagggtgagcaaagacatgctataagtgaaaagacatgcatgcgtgatataaattgcagggcaaacctgttgctcacgacgagagagctgccaatgcacacggcgccgtggctggattgcaggattggtggcgccgtaaaacacggacaaatcgaaggccccggcgtcgacgacgagagtggcttggacgacaaagcggatggatcaaagtcgtagagagggtgaactcgtatatgagttacgacgatgtgtggccggctgccggcatgcgcgatcgagcgctcatcgctagagttagggttttcttttgattgtcaaggttttcttttgattgttctcactctattcgtggcttggctgcaccagggaggtggacgttggttccaacagcgtccaagtatggacgttgtttacaacggcgtccaattctggatgctttctgtattagcgtccatcctactcctgtaaatccccccaacgatttactaattatttaatttaagggtaattgtttattataaataaaaaattcggaactcaggatggtggtgatcatgcgggtaagcattcgcaatctaagaagcaagcaagagaagttaggagcttatggttcttccacacttagaattgaactatcatcattactttcacccttattttgttgggattctcctgatctatttttagatgttctcattgccgcctcctttgtttgcacacaccccaacaacaaccacaacgcgctatggcgcctcctatggatagcgcaatgtctctcacgagctcccccattgccgcccctttctcttcctccttccttccacctcaccccaaccccaaccccaaccctggccccgtcccgcgcgtacggaggaggggcccatgcatgcatgcgggtgaggtgacaaggacgcggccacggggatcaccggcgcaccgaccgggatgttgaaggtgaggtggttgccgttcaagaagacccatctcgcccgcagcaacgcctccgacgcgtcctcccccacctccgccgccgccgccaccgccaccgccgtcaccacccaccgcctctaccaagtctggaggggcaggaacgtacgttttcaaaaacgaattcggacaaaattcgtgcgtttccacattaaaaggagcccatatattttgttgttgttgttgtgtgtagagattcctgtgcggcgggcggctcatcttcggcccggacgccagctccatcgtgctcaccgtgtcgctcatcatgacgccgctcgcgctctttgtcgccttcgtctccttccacctcgccgccctcatcgggaagccgctcggccaggccgtcccggccgtcgccatcgccgtcggcgtattcgtaagcccggccaccaccatttctgcgtcgctcgagcaaaatgaagcaattgaccgatcactttgcgtgcatgcgtgcgtgaaggacgtgatcgtgctggtgatgacgtcggggcgggacccggggatcatcccgcggaacgtgcggccgccggagcccgaggacatcggcgtgtcgtcgccggcgttcggcggcggcgggtcgctcccgccgacgcgcgacgtgtacgtgaacggcgtggtggtgaaggtgaaatactgccacacctgcctcctctaccgcccccctcgctgctcccactgctccgtctgcaacaactgcgtcgatcgcttcgaccaccactgcccctgggtcggccagtgcatcggcaaggtaggccgtcttctccgtctccggcggcgaccatctccgacgtgctgaccaactgttcgatccattgcctcgcagaggaactacaggttcttcttcatgttcatctcgtcgacgacgttcctgtgcctgtacgtgttcgtcttctgctgggtgaacctggcgatgaccgcgaggcagttcggctgcagcatggggcgcgcggtggtggagtcgccggtgtcggggatcctcatcgtgtacacgttcgtgacggcgtggttcgtcggcggcctcaccgcgttccactcctacctcgtctgcaccaaccagaccacgtacgagaacttccgctacaggtaccaatgttttaaatagcgggctaaaacatttagcggttacttcttaaacagctatagcaggctaaattgagctatagcggctaatttgtactctctccgtattttaatgtatgatgccattgactttttgataaacgcttaatctttcgttttattaaaaaaaattatgtaattataatttattttattgtgacttaatttatcatcaaatattctttaagcataacataagtattttttatttgcataaaatttttgaataagttgagtggctaaacgttggttaaaaaatcaacggcgtcatatattaaaatatggagggagtacacgagagcaaatagctcgaatccttctcaaacagttatagcgggagataagcagcagtttagcgagagattttaaaccttgacaggtacgagcggaaggcgaacccgcacaaccgcggcgtcgccaagaacgtcgccgagatcttcctctcgccgatcccgccgagccggaacgacttccggtcaagggtcgccgtcgagcactactacgccgccggcgccggggcggcgtcggggcagtacttctactcctactcgatcgggccgctctcgtcggagtccaaggcggccagcttcaacacgcgggggagcctcagcttcgacatggccacggcgagcttcgacctcggcggcgtcggcgtcggcggcggcgtcggaggatactccgccaagcgcaccagcgtcgacgtctgctccaactcctccgacttcggcgacatctacggcggcgagcagcagccgccgcggcactccatcttcggcggcgacggcggaggagggaggacgagcgtcaggaaggccgacgacgtcccgacggagttcgggcactacggcgccgccgctgccgccgccgccggcggcggcggcggccggcctcgcgggagggagttcgaggccgtgtgacgtcgccgccgccgtcgtctccaagtgcgttggcgccattttcttgggagctcgacgatgcaacgcagctaattaatcgatcaattaatgtagcgaatttttctctgtttttttttggtgatcttgtgcttccgctgctcgtgtgttgtgtagtagctttggttgatcagcttcctcatgcttgctaatggagtagtggtttccatagcattctagtactacttgcttaacttgatttagtgaaggtgatgtatacacacacaaatgcacacacacatgggtttaattttgtgtaattaggactgtgcatatatataaacggtgttcatgagttatccaaacattatcttttggcatgtactatgtttcatattataagtcgttttgacttttgtcaaattcaaattattttaaatttaacttaagtttgtagataaatatagaaatatttacaacacttaattagttccgttaaattgaaataaatcaatagttgaatatatttttataatatatttatcttagattgaaaatgttactttttctataaatttgatcgaatttgaagtagtttgactttgacaaaagtcaaaacgacttataatctgaaatggaggaagtaatgtttctttagaatacaagaatttggcctttctacatctgattcctataaaaaaaatcctacaaaatacataaaaaattatgtgtaatgaggcgttgtggatggatggaagaaaatgagaacaaagaaggtgttgcctgacaaaaaaaattattcaactgtttcagtgggagagagaaatgagacattatgagtatgtcagctcctaagaacataattttgacacttctgttgacctaattagttggtagagatacataatcctgctatgccacttcaacttacatttaatctttttacatatcatgaaagaacatatagccaaaacaaggaacagcatgaacccagaaagttgcttcgctggattatgggctaaaatgaacaactaagagagttgctgcttgttgccttcacaatttggtatctgactgaatccaacgatcagcttgtccctttcataccacttgccccagaatggctattttactagcatgcagttcaacaagcaccccatatgcataaagtaacctgaggtgagggactgattaatgcatttagcgagaaagctcggcgctaattagccaactaacactatgttattgtagtgcacctacaatttcatactgatcatgatcaaccttgtaacagaaggaagcagagtgctactatctttagagcaccttgatgcaatgcgtgcagatccatcagcagcaaaacttgggaacctattagtcctcttgtattccggctattttacctgcggacttgtaagggagatggttaaaagcacccattcaatatggccaagacaatagtataacatatatatatgcatgtctaaaatattctcggcagtttttatgtggttctatgtattcataaaatgattggatagaaatacttaggtaggcatttcttgactgcactccaaagaaattaatccatctgtctatgaagattaaacttaccatattacgagaaaacaatcaggtaatctatatttttgaaaaataaatcccaacacccaatgaacaaagtatgttgcttaactccagtagccatgcagcatttcttgttacttgagctaatgcaactatgcaagctgtaaatttagacactgtggcttgcttggcttctctcctcccccgaaggctttctcagtttcttaggcaacaatggtgtacatcaaacctccatgagatagccttcaagggagagagagatccaagaaaaccgtgccgtttaacatcactttgaatgtagtaagtagaagtactaaccaatgcttttgcagacacatgaatttgtatctgcaaagcacatggagtggaatgactggaatataagtttgtggcagtatatatagtgtccacaaagctactatacatacataaaacaaatgagaccaaactaaaagggacaacagaatcctgcactaaataaaggggagataattgtattgtggagtgataatgtaattaatgaagaatcgactcaactgcctagaaagcagaaagagatacaaggccatgaggataggagagctttgcctccattagttctagaaaacttacatttagtacaatggcacctttccttcatgatcttttggacaatggtatctgactatgccgaacaattggtccaactcatggttacaattgattcccacccttaacacataacagcagtgccaattaacaaatatcatctataaagaggttagaagacaacgtacatgtcaccacaggttcttaatgttgagtgaaatactagctaatcttatggtgatacaacattagaaaaaagtctatttaatactccctccgtttcaggttataagacgttttgactttggtcaaaatcaaactactttaagtttgaccaagtttgtagaaaaaagtagtaacattttcaacccaagaaaaatttattatgaaaatatattcgattattgatttgatgaaactaatttagtattatgaatattactacatttgtctataaacttagttaaatttgaaacagtttgactttgaccaaagtcaaaacgtcttgtaacctgaaaccagtggcggaactgagggggggctggcaggggccatggcccctcccaataaaaacaatttttttattacccccatatatcatagcagattcagtgaacaagcaatagagcttctcaatttgtgtacgtctttggatccaagtgattcattcagttcattcaacattgataaagtgtgctctctagcttcaaagttctatcctgctgattttttagaacaagagagccaatttgagatgtcaattacgtcactatgaacttgatgtacccaccaatcctaaatttcaaaatctgacatctgtagctgatctttgtcgtcgacttttgcaaactattcgcttttatgtattgccaatgcatgaaaaaaaagagaaattgctaattttttgaactgtcaaaagccggctggcccccctttgattttctgtccagctccgccactgcctgaaacggagggagtatcaaattgcttaggatagatgtcctccaaaatttagaaaagccataaaagaagcttgttaatggtcagactgaaatgttcagtacaagtagctatatgtatatagttctcaccagtcaccatacagaaaattctaagagacttgtgtacagatcatacacaggtgacactgttctaaaccaacaagttttgatcatattgtcagcaaaagtctaaccacaataccacaaacactcaccaagccgcattcagctgcagaagaactggatattctcatataacattgacaacggaatctgggagatcaatcgatcatcacattacaggtacaagtgaccctttggacactagagaagccaaaggcttgtccaccaatacaaagtagcactaagtaataggtccctaaagtgttagatttggaagataattggtaccataagtggttactcgtcagtgtcagacagtcgatcagtatgttccaggggtttcttttgctgcccaccgtatctctgaaaagtttatagcagatcaactgcagctaagaaaaggaaaaattccagctctataacctaggaaagaattagaaaaggccccaccactaacaggttttacttcatttctccaccaggtaaaagtgattgcacataactaaaaagttagaatgaaaaagaatgcatgaatggattttacaattctaaacagagagagtatatgatccagttatgtcatagaaatactgcagaaaagaaagagtcaactctacaaacaaatggaactctattccaaaaagaaggaataatttctttaggcaaaagtcacccagataaattctaggagaaagaatattatcatctgcagccagtatgaaggtttaaagaagagaatcaaataaaaatgaaccaaagatgcatgtagacaagtctagtctagaagaaacattcgcttgcattagttaaggtgtaaggtttgcagagaatcaaactgaatatggttcttgtcaatgctctaatgaattaattccacttagttggatcaccattttcttctcttttcaattctatatgagtatcataaaggtattgctgtcaagttaggaattaggcattaggcaaattgcctggataatgaataatcctcttgttcaaaaccattttaagtttctcttcttccagtcagtacaatagcctatattttgtagcacttgagttatgaaatgtaatatgtacaaacacctagtatcatcatggggccaccggcaaagttatttctcacttttgtagaaaatattccatccaagggtaaatccatgcaactgagtttcatccatatccacgatgtgacacattgtgtgtattggaccatagacccacatgacagtgagacatcattggcgcatcgtacacattggattaagaatctttcaaatcccaaatgatgaatctttggtaagtccgaatcacccaaaaacagatgcaaatataggtttaaaaaatgtctaaaggaattaaatggaggccccatattcaccagagatcgagaactggtatgcaattttttgcaaattacaacacgtatacacaaaatatatatatatcagaacctcaagaagattccatgaaatgaatatcaagcagtatggaagtaggagagcgataacgcagctcatatttggtttagcacaactaacagcatgcaatcatgatgaagttttacatctgtaacaaagactactgtcttaatgataaagagttgtgcctgcatgcaacagctgaatgcgcatgtgtatgaagttttattaaggaaatgggatgaatgtcggaaggttcgaagcaaagcacagattttaaacgaaatgtgaggacaattcgaaactgcaggtgatcccaatccggaatagttctttgggttttgcatgcttgcagccaagggggccaatagaaaagaaatactgcatagcagtaaattcaccatgatagagtatataaagctaccacaatagcataatgtgaacaaactacaaaactatgagatcattgaatgagttacaacaagtggcctatcctacatttggatccattgactgattcaataagataaaggttaccacagtgttcatcccaaaacccccataggccatacggctaaatatttcaggggatcagcatgtgaacatatcacattacttgagaatgatcaaaatgtacctacttaatcaagcacaattgaagcaacacaatcttattcctgcgcaatgctcttgccgacgacgcccttcatcggcaaatgttccatctccgcctcggcagacgccaccgtgggcattgcatcgtacgacccaccgacgccattatgcctcctccctgtccccatccccgccccggcgccgccgtccaccccgcaccaccaagccaccccgaggtgcactcccacggccaccgccgcgacgaccacgcagtgcacggacagcgcgaggtccatgagcgccacggcgcggagcctggcctcctcgactcgcaccgcgtggcgggcgtggccacggcggcgtccatgaggcggtggcacccggcggggacgcaggcgtcgacgtagaggacgaggccgctctgccccacccagaggccacccacggcgccggcgcaggcgagcgcggtctcggcgaggagcccgcggttcgggggggagatagcgg

SEQ ID NO: 3079 - DNA, 24469 bp, Oryza sativa
  unsure (1)..(24469): unsure at all n locations
aaaggggaaaggtgggtggtggcggcgaggaggaggtgggagagggaggcggcgaggagggcgagggagaggaggaggtggcaggcgaggaggaggagggagtccgccattggtgacctcaccgcgagtgggagctcggtttccggggtggtcgtcgtcgtctattcttcttggatagcgacggtggtcggtggcgacgaacgcggcggtggtggagggggaggaggctttctcaggtgtggacacgtgggcggtgaagattggagcggttgctcttttctcatttttattatttttcaagggaaggtgttactgactttttgctgtagttctacggtggtgtggtgtttggatcaggatttaactttagtcatgtatttaaacactaatttagagtattaaatataaattacttataaaactaattacataaataaaagctaattcgtgagacaaattttttaagcctaattaatccataattagataatgtttactatagcatcacataagctaatcatggattaattaggcttaatagattcgtctcgtgaattagtccaagattatggatgtgttttattaatagtctacgtttaatatttattattagtgtccaaatatccgatgtgatagagacttaaaagttttagtcccatctaaacagggcctacgaatggtaagagcaggtacaatatagcaggtatttcctccgtttcatattataagactttctagcattgtccacattcatatatatgttaacgaatctagacatatatgtgtgcctagattcattaacatctatatgaatgtgggcaatgatagatagtcttatattctgaaacggaggtagtacaatatagctggtgtaagccagcgataatctgtacagtatagctgtctttgttcgtttctccatcaaggaggagatgaaattttggattctcgtggcatgcttttcaaactactaaacagtgtgttttgtgcgaaaactttccaaatgaaagttgctctaaaatgtcagattgatacatttttcaagtttgtaataattaaaactcaattaatcaaacattattaccatctcgttttatgtggaacacttaatctttatctccatcttcattttcaggagattcaaacaccaaaaagtctaaaaaattgagattgacgaagccaccataggtgtctcgctgtcaacgggtacatcgcctatcattgaaagcacaatatttaattcgttcccacccatgagagtcgaacccagaacctaaggtgttatttagacttttgcaaccactagactatatgccatttcgcaacgataatctgtatatgatggtaaaagtggtgatctgtatgaggattgagtggagagatgtatgaggattgagtgaagagagagcaaaaacgggcgactaatttatcgacgtagactcatgggcttcaacgcgagtgaagcagcataagattctactggccaccctgatacacggctgctctattcagttttcacggcagaaaagaacgagtggataggactaacaataaaaatgttagaataaaatattaagaagtaaatatgggtagataagctaatagtaacatattactgtacatgctctctattattaagttaacaatatattattggcgtgaatatttttggagctaatagttggcatactatctcgctctaaacaggaattgggattctgcagtacaacagagtttagtgcagaggaagaacaattgtggctgcatttagatcatttttacatgcatctcactaaattttgtgaattggattgtactccttccatccgacgctaatgacttttcaaataacgtttgactatttattttattaaagagtagtaaattacattttagaccatattttattagcaatgttttattttggatcacccttaaaccaatattttcattttggacttagtaacttttccattttttttgggtttggactatcctccattatggtgaagatatggcttacatatatgatatatggatagagaaatttaatggtgtactgagactgatttgcttgatttttttgatggatgctaaaaaagttatttgctgtgatccaaaaaaaaagatttttttagggtagttcaaaataaaactttgacaataaaagtcttcaacaatattgtatgaatatcattttattttatttatcaagaaaactataatcttaatttacacttttacatatttattatgctaaatttttaaatatgatagtcaaatattataaaaaagtcaacacaatcaagatggaaggagtatattccattacatatgctacagtgcaaaatagttcataatgtgattttaacaagtgcattgtgcgctatcgctatcgttcataatattgtagccacagtgcacctctacagcatatttatatagcgttgtcgagccactggtcccacaaagcaaagaaacattccagtgttggagttgcaagagtttaaatctgatcaacccaaaacaagccatacacatttttctatatctaaagaaggttgaatcgaataaggagaatatgactcgatcctaacaaagatcaatgtcaacgacatatgactcgatgaaaagggtaatttgatctggatttcatcctcactctgatctctcctctcatgagaactgatagctcagctattaaccttaaattatgtaagatctttaaattatagaacgatatacttattagccagctctgatattcgtccacacttttacttagagatgtcaaatttcccagtgctcttgtccatatgattaccaaaaaaaaaagaatgtcaacaatacacagaaacatgattcgcccatcaaattgcctttgtggccattagtgtttcctacgagctagccaattacgtggcaaagccgcgtgtcttttctagttatttataatgtacgcgtagtagctattattcttaaataaaaattcatagaaccataaaaaatacataaattaaaattacatttataagaaactcatatatatatagaagcctgggaagtactccgtatgtcgctgaattgttagttgtattcaaagaaaagagcatgccgcatgccgttgaattggccgtatcgtaggcttttggtcttggtttgcaagtaccagtcgcacgtatgtatcagataatttaatacaccaaaacaaatgtttacttattataccacctgataagtatatcgtcaatataatttattaaaagaaaaaccataatcagcttaataatttgtacttttgcttaaagaaagaaaataatcaaacaagtttactcatcatatggatataaataggattaattagacacatgctattacaaatttgaaggtttggaaaaatatcattactattcaacaaattgtaaagatgtcattacaaatttggagaaactgaatcaatgccactctctacgccagaagcatcattgttgaccacgtttgactcaacggactacctatacatttgtcgacaaattttctcttaaaaatttgtcaaatgtaaatacaatataattgtactgtaattacactgtaacttacaataattacactgtaactgtactataacaacacggtaactataataattacactataatttacatgtaattacactgtaaatataataattacactgtaattacagtataactacactgtaactataatataacttgcatataagtgagatgtaactttagaaaacttatgtttggcactgcccacgtgaaagagggattacgaactcgcaatgtatgtttgtacgatacgtgcggaggtcatcattcatgcatgcatgttcggctatgccctgccgctttatctttgcccttcgtctgtcatctagacatctacgcgtgcatgagccacacctgtggccggcggccggcgaacgtcgaaagaaacaaattaaagcgtcgacataaaagcacgaatcccgagtttcatcaagcggttcaaaaatcgacaaattctgaggaagaaatttgtcaacagatttatagcaaaaccgccacgcattaggcggggttgggcggccggcccagctacggcccgtgccgccctaaccctccgtatccttcttgggccgcctaccaccacatccaattcacaattgggccataaataaccagcccaagtgtccaattttaatcctgcttatgtgatgctttcctgagtcaattcctcgacactgctcacccccgtcccctactatagttaggtgtctaatgtttctctctctcccttctacacaaaataataatcatcttattttggtaatgcgatatcttctcatatatttattttttaaaagatatctatcaaacattgactcatatttgcaaattaatatgtttactagtatctttttagagaatccattatatgtcactgactttgtcacccgtctacgattttaatatatatctttttatgtataatgaattatgtatggcgcaaaaattattactttattttaatatcattttttttgtttgccttaatttattaattatactatatgttcatatgattacaacataaatatggtattttttatgtttagttgttcttattgagacgagcatcttcgtcccatctttattttaatcctgcgtccgccactggagtcgggtcagcaggagcagcacacattttatcccctttctagttcgatttagacctaaccctaccagcgacgacggcgacgtcgtctacggcggccgcggcgacgacaacgtctacggcgatggcacgggctgcggcggctgcgtctacggcggcgacgtcttcggctcggcagcggcgacggcgtctatggagtcagctttagtgcaagagtcagctcttgctgcaaatacacaatatcagcttgtaccttgagctgccagacatatcctgaacagagcacctagagtgggaaattaaatccacataattaacgcaccgaaattgaatccacataattcatagacaatgattaacattacacaaaatggcactgatttacctacttgcaccaaatgtggctacaaaatttacagaacatatatagaaatacataattatgaccaacaagaataacatcacataaagttgtctactatgactacacttctcttctttcaacatcttctttagctgctcacactcattcttagaatcattcagctgctgatatatatatggattgcatctgtctaaggtttggctcaaccaaaccctgcatcctcgacttctcttccttatgctcttctgcctctccccgccattgccgccaaagtttgccgccgccgacgccgcctccaaatcccgccgccgccggagaagcctagggctaggtttatggttcactgggaatgcgccatgcaccgcggtcaaactgattccactcggtccctacatagtcatacataagggcattatggtccatacataaatacggtatgcacaaaaccgagtacaatcgcggatcaggcgtagaacgtggcatgtttctagttttatgcgatttgtaatggcaattttacaatttatcgaatagtaatggcatttttccaaaccttcgaatttataatggcatgtgtctaattaaccctgccatcatggccaaccgaaatgcgcatcctgctactggtcaccgccgcggcaattacagatttacaccggaagggaatagatggtctgggctcctccggatatgattggtagaatacattgcaatttggtcatagaggaaaaaagagaaggaagaggaagaaaaaggacaggggctaaaagaaaatatttactggtataatataaaaagtgacatcgcttatactccttccggttgataatacttgtcgttttggataaggacacggtctccaaaaaaaacaattttgaccattatgtttcattataatatgtataaaattgttagcaaatatatgatcttattaaagtacttttaagactaatctatacatgtagtcaccatatttgaaagacaaatattttaaaaatgattcataatcaaagattctaaagtttgacttcagccttgtccaaaacgacatgtattatcagcccggagggagtagctataaattatagttaccctgttaaaaaaaatatatgaactaaaatgatataccttaaagggttagttagatcatatcattataaatttgacagttttaaagaatactaccattattcgtataactgaaatggtaccactacaataatatgaaaattggattcataccatactgtacactaatttaaataggtaaatagtaatgatatattttcaagtaaatttcagaaaactacaaccaaattatcgtaaaacttcatatttataatcttgtattacaaaactacaaatttagcatggaaattttcatagaactagagatttaaaatataatatcccaaaaataaagattgattagcaaatttaataactacaagttttgcatcaatttaagtacaaaactacaacgcctaatagttccaacataataataaggggcaattacatatctgaccctcttttgaaagctaactaccaatttaaccatcttatatcaagtttgctcatttgacccttcatttcaaaactgaagatacggtaggaccctattctatcaaaggcatgtaacggtcttaaaaggagcataaaatttctcttctgcccttgctcttttgaccctattttaccaaagcatttagttagtttagcatagttttgtatggtggcaataatgagaatgatttgtgcacttagtgtaagtttcaccgatttgtgacaagtttgactcagactttggtcaaatttgacctatatttgttatattaaatttttcaaatttgacttcagtttgacaaaatggacttcaatttgatagatgtttgacaaatttaacatagatttgataaaaatatgaataaacttcaataaaattttagactccatcatcctcgccacgtcatgcatcgtcgcagaccgctgatttccgccaatgttgtgccaccatcactgacccgccacccgtacacctcagcaccgccggatttgcagcccgcatgcccagtcacctctacatccactgccaacgcaactctgctgccctggccctgccgccgccaacccgccgctaccagatccaccgcctatacacctcggcgccgccggcgcaaaattacagcctgagctgctaccgccgtgccactgtcgttgtcccgttgccaccggatccgcaaccggcacaccttgacaatgtcggatccgtagcccagatgcctaagcactgccggatccaccaccgtagccagagcttcgctgcctgggcctcgccaccactgctcgtccttgtcatcgtcgggcctctgccgcccctcctcgtctgattcgcccgcctgttaacaaccaaatttggtaatccaagtatcggagatgaagatagaatcgaagcggaattcaagatggagatcgttacggaaacatagcgagaatcggctaaagtccgaatcggctatgatcaggatcagcagagttcgagtcggactaggttggccgattgagccgataccgacaatatgacgtaatgcatgttgtcgggttgagttaatgtgcttcatatggattgccatgcacggatagagtcctgagaaggcaattgtatctattaattatgatatttcatgtaatttccttaaagatatgtttgggcaaaagtctgccgcaaagacttatggtatcttaaaagtttgttagaaataagagtcgtgtccgacacggacatattttgtaatctcaggtataaatagaccccgagccccatgtaatacaacaacacacgttcaatacaatctcgacgcatcgccacccttttactttggttttgtttcgacgagttcttgctttcggattgagctgcatcggtttcgatcttcaactagaggtaaaacttgttatggcggcttgcgttttcgggattagtgcttccatctttatgatactctaatcttgtttatgtagttcgttgagttatcagatattctatataatctcaggcaatattgttatctaaccctcaaatcggctaacatctgttgctaaaaggcagccgatcaggttaaatactattgttgacttagattatataggatatctaccgctctatgaaatatccaacggcttgattgtctagatattgtccttcttttcatacttatagctgcatcagttgagtttgatcttataagttgtcttagaatctcaatctctagcctgcttttggttgccgattagggtagtatcggggtttcaaccgatcttacctgatttagctttatatttcatgtatttgattgatattgaaagtgcatctaggcccctaatgattttggtgattaattacaatgcgattagagaggactaacatttttatttaagcaaatgtgaaggttgttttgtcctcaatgagttagcgtaatacatatcccgccgaatacgttgatgtgatgtaatgcggcaaatgagcaaatggtattttgtacgttttcgtttccttgagttaataggaaagccgcactattaagagggatgatgcattgacatacgaggagtgatcaaagtgctcaaaatctatttttaaaaagtgtttctcctcagtttggtgtgttctggattttttcggagttttccgaaactcattttcggactttccgaaaacacacagaaccagattttcgcttctggaaattttcggatatgtccgaaagtgattttcggactttccgaaaaagactgcgaaagcaaaagtggttttgtatattttcggacttgtccgaatctgatttttggattttccgaaaatcatcagtagagtcaatttcgcttctgtatatttttggacttgtccgaaagttatttttggacttttccgagaacatccagaacgatgttgttggtactagaaattttcggacttgtccgaaaagttttcggaatgtccgaaaaatccttcgttaactttgttgttggtgctgagctggaattttcggacatgtccgaaaatctttcggaatatccgaaaatctgaattattgtgcataacggacagaatctgggctgtggctataaatagccccctcccctcacttgtgagggctgctggttccattccaatcatttgtgcccttggcttgctctttctctagcacttttgagccttgttttcttgttttccctctcacccgtgttcgatttggatttggtgtgtgtgtgagagttgtggattcgagtttgtgggagtgcttgttgttgacttcgtgaagatttgtgagcactttcatcatctccgggagttctttgcttcatttgttactcttggaggttgaggactcctaggcggctaggtgtcgctcccgagccaccgatctacttatggttggccgggagaagtttgtgaaggtcggatctcacctccaaaagggaagagatacccttagtggaaggaggagtgcttagtgcaacctcttgaggaaagggttagctaagacccgactcttagtgagctcctcaacggagagtagaatcccctcaaggattcgaacttcgggaacaacctcgtgagcttcatctttggtgactttacttcctccctctccactagctttgcttgtttgagccgctacaggtctagttgctgtttgtgctagcatattcttgttgtaggcaactagatctaggatttactttgctgtttgtgctgactccgaaaattttcggatatatccaaaaatttcagaaatatccgaaaattagtgcttccgcttttaattgaatttttgaattagcctattcaccctcccccctctaggcctaatttacactttcagatatgctagatcttccctttatattaagatcttattacaataaagtatattaggcttttgtttgatatattttacttgttttaatatcttagtatagagtgatatcggattattagccgatacatgctagatctattggatcggctatgctatgaacatctataatctcattgttagtatatacttcgatctaagtgatttatactgtctcggtatgacgaccgatctatcccaattacttgatttaagtttatatcgacataaggattatatattgttaatatctacagccgatcgagtagatttagtcttttcttatttattcatggttgccgatcgattcacatatgacatcggctcagagataaataatatgtcatcgtcaactagccgatcggctatcatttatggatttaaccacgatttctttgtctttatttcttgttgattgcaggatcaaatcaattggcacgctcacgaacctaaaaggcaagatttttggacctgcactagagttaagcagatctctccggcctcgtgttttttacatcaacaccaccgcagtccaagctccgccacccgggccccgccgccactgttcctccgtcgcgtgcctgcttctgcacggcgaggagagctcctctggagagagagggagagaggggagagggagaggaaaaggaatgggaagtgataaatttggggatagggttaatgtgtgtaatcaggggtattttggtctattagaacacattttttttcttttcttaaatgaaaccagaatggtataatagaaacagggtctaatggcaactccaattttgaaaaacaggatctaataagcaaatttgaaaacgtagggtcagattgttaattagacttcagaatagagtcgaatgaccaattctccctaataataatattgatagagatttaaactctacaatatgctttaattaaatatatagtttttttagtttccactaaatatgcagttttataattattgccttagttttatgtagtttctgtactttttatgaaactagaaaaaatacacgtacgttgcaacgggtaaaaatattttctcattgataaaacagctattaggccattcccagcccaagacactagacatagtttctataaacttcacgtcatcgagaaaatagtactaaagatgctactcttccaatgcatacaccactactcaatacttaaatttaatactacttatctcatgtgatgtcttcgatattgtgtagaaactatgtctcatgcaagatatggtttcttctctttcctcatttattcacttaccacatcatttttcattttagttggcagcttatttaatgctatagacaccatcctagttattggattgggaatagcattagaagctgagcaataaatgaaggatgaacagggaattgcttttttcaatcaattagagtagaaatacacggcgaggcatatctatgtcgtgacgatgctggggattggatctatttccgtaaaaaatttcgtccgtctttttttatttttcacccttttttccttttttccagtccgttttcctttttttttctccgcccgtttcttttccttctttctgtccgattcctttttctttttttatccgtatattttttttctttctttccgtccttttcactctttttcttttttttcacagttttttccgtttgtttttttttcgcttttttttccatctggttttttctcttcacctttttttcgctttttaccctatgctgttttttactttttttaggtctttttaccgggttttttcatatgtttgctgctgttttttagttgtattttctcgcacgcggtaaggatttgtttttttatgtaccatgtttttttatcgcccggctaaacactaggtcgatctgccttcccatgcgttccctcctccaattgattgccaaaaatcaattccccgctacccctcatcattttttctacgattttcccttttaactctgctctaatccactgaatttaatctctatttaaaaaatcaccgtttttatcccgagttttatcacttcgattttaataaaaacggatagaggagatcaagtgtatcaaaaacaactacgcccgctagggaggttgccggatgatctggatcttggctaaggggttgggttttggtttagcatgttaggtgtcttgttttagggtgtttcgtgggtgtgttttttatctgattgatgggcctctgcagtgatcctatgctccagtgttaacttgttcttttaagtcggattttttttctcgttctgttgtgtaagacctctgttatctttggctttgtttaaaagccgggtattatgaatgcctgttataaaaaaaagtgtatcaaaaaccctcaaccaattttgaaagatcgtaaaagattggaccggatttgacgggtatcggttttggcatgtacggacacaacattgtctttgaagattgaagaggacagtcagctatgcgagcaggacatacaactccacttgacaaggaatgaaatgagcttttggtccaaaaccaaagagtaaaatatataacgatccaaaaatatttttacccgttgcaacgcacgggtattttttcagtcagaaaaaaaaaccgaaagcccaaaaaaaaaacttccacgtaagagaaaaactaatcggaaaaaaaacaaaaaaaaacagatttaccgaaattaaaccgaaagtcttaggtattttttattagatatagataataaaagcgaaatggcatgtagcctagtggttacaagagccttattagcacttgaggtcctgggttcgactcccaatgggagcgaattttccaggatttaacggcgttgtgctttcagtggtgggcgacgtacccctcgatagcgaggtgcctatgatgacttcgtcaaactctcaaggatttgccggcccagtcttttcgaagatgctaggggtagtgtttgcgtgcgtgcgttcataggggtgagtgtgcgtgcgttgtctctcaaggacttgccggcccagtcttcgaagatgctaggggtacggtttgcgtgcgtgcatttataggggtgagtgcacgtatgttgtcaatgtctgcgttgtactgtgtaattcttataaaaaaaaggtatagataataaaaaaacaaaagcacttccaatctcgtacgcacgagcgcacggatggacgatcatggggacgtgtctcagatcgatagttacgacctttaaccgttcatcttatttaaaaaaattataaaaaaaattaaaaagataaatcacgtataaagtattattcatgttttatcatttaacaacgataaaaatactaattataaaaaaatttcatataaaacggataattaaacgttggatacggaaacttaggaattgagtctttttgggacggagggagtagaaattacgctcgtggaattatagtttcgattcagttcaagctggcaaggaagcagtacaatagtacaatagggtaggattgggttaatttctcaatctttctgcggtaatgacccggagaatgctagttgtcgggcgtccgatgggagggaagaaaaatcagacgctgcatggtctgccatttgcatgcaaagaatctttccctacgtgctttcatctctcatttcttcaaaagattttttctcataaactatttagctaatgtacgatctgattgcatcactaaattcgttacaattaaatctttacaacaagaccacacatgattatattttgataaaaaaaatattttagttttttattgattttttttaatgttgcatatggtctcttttgatgtttcaaccagtagttttacaatgtttcagctagtctactcataatgttttactatgtacggatcaaatgttgcattggattttgatattatggaacgcgctgttacaacataaaaacccacgtattttggaaacccgctattaagggaattcgttttattttttgttcaaccaaaaatgtttcacctagtgtactcatgatgtttcactatttatagatctaaagttacagtgatctgagatactctattgcaacaaaaaacccacatattttggaaaccctttattaagggaattcgttttatttttttgttccattaaaaaatgtttcgtttagtatactcacaatgtttcactatgtatggatcaaatgttgcagtgaactaaaacattctttcgctatttgctgaaacattgtttttatataaggtgaaacaacacccgatttaaacgagtgaaacattttcgatctacttattgaaacaattccgatatacctggtggaacatcgtgcaacattaaaaaaaatcaataataagctaaaaaatatttcatcagaatatatccatgtgtggtcttatttagaagatttaattgcaacgaatttaatggtgcaatcggatcatgatttggataaataatttaagagaaaaatcagtttgaatttgttttacacgtaaatcggcgttgacgtcatgccgatttttaaagatttggatcgggcgaccgatccctagtcatccccaaatgacccatgcgataacatgtgcatggatttctgagcaacgatatacataattttttttcgacgcacatggaaaatattttaacgcaagcggaagcgaactaaaaatactaccggaaacctatgtatatatatatagtcagattagatcttttatctttttgtgattatgaatttagattgtttatttatttttttttaaataaaaagaggacaatcgaagagagtgccaagagagggggccgggggggggactcgcgcgtccggaaggggatttctcgcgcataatgagaagactgacaccgataaaaaaaatacctcaacgtaaaaaaggaaaaatgacgacaatagataaaacgacggaccaaaataatactacctccgttttttaatagatgacgccgttgactttttctgatatgtttgatcatccgtcttattcaaaaaatttatgtaattataatttattttgttatgagttgttttatcactcatagtactttaagtgtgatttatatcttatacatttgaataaaatttttgaataagacgaatggtaaagcgtatgagaaaaagtcaacggcgtcatctattaaaaaacggagggaatacctacaagccttatgtacttgaatttaatttttattaaaattttcatgattaaccacattctctataatttttttaattttttaaagctcaattgctaattttaataattaatttaaaattaaaactaacttaaaaaccctcttctaaggccctatttgattcagcttaggattattataatctagcttattaggagtaagctgaaacaaacaagtagattattatagcatattattataatctataagccagattattataatctaataagctgctatagaggagcttttttcagattattgagtggctaaagacccactatccctacatacttgagaaaaattacccacctatgccatcaaccgaacagatagctgagagcattatagactttatcctttcaaacccaataatccatgcctccaataatccagacaaacaaataactcacagcttattctatgtcagcttattataattcagcttataataatctggcttaataatctagattataataattataagctgaaacaaacagggcctaaatctgggatcaaatctagcccattcttccttcttcacccccgagccgtcccgcttcctctcctctctcttgagccgtcatccatctgttcgctcgggcccagcagccgccacacttcctctcctacctcttgggccgctaatcccgtgtccgctcaggcccagcagctgtgccagcccatggaaagaaagcggacaagaataaacccgagaaaaaaaaggcgaaaaaaagagaaaaagggcgaaaaaagaaaataaaaaagaaatagtggaaaaaaatttagacggatgaaaataaattcggatgccttgcgtaaaaatgcccgtgcgttgcaatgggtaaaggtgttttttcagtgatacaacaactattagaaaccgagcaataaattaaaacattgggatcactatacattataatcgaagaagttaatgaaagtccttcgttggtttttttggccgctcggcttatctctccttggtccagcacataaacatatctagctcgcataaccgactgcatcttcaacctccggaagatgccacgcatgattgtaagttcaagtgccttaatttggttttggtgattaatgacaaatctaattatatgtgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccgctgagaagcgtaacaccctactcctgtgttctgatggatctgtgagtgaaggaatacagagcgcccgagagcgagagagagttcaggctctagaacccaatcgctagcgtcccaactcttctttcccccccccctttctctagacctgggcctcctttttatctggtccggggtcaccacattggcctcctgctgcctaaggagggatacatgctttttacaatgagggctagtctacagccggaagtgacatctgacaagcagagcacacgcctcctgccccgctcgcccgcttttcccggggacgcccacttcaaccttcatttaatggccagtgacttccttgccatacttgcgctgaagcctggaatggatctgaccgggactgacataccaactccaggagttagcacgccggctccggctagggacgagagccaggaagctctcatcattccgatgggacgaggcgaggcgtgtgacaggccgcctgttgccacctaacccgcgatctgaccggtctgtgaccggtcacacaccgcgaccggtcacggaccggataagcgtgcgctgtgccgcattaaatgcggcgtggcgcgctcgtccaacctgctataaatgcggttaggtgagcccggtcggctcacctaacgcacagacgtggcgccaagaccacaggggggcggggcgccccagccctcggggccgaaacgggagcggcccgacccctcggggagacagagggaggggtggccacgtcaccctcgggcccgacccccccgagggggtcaggccacgtgggtgaccgcggctacccaagcctctagtcacgatacccccggccccatgtcaccgacaatatgatactaacatttttatgagcttttgtttgactaatctcatttggatatgaaagtaaaaatgatgagaggtatgtattaaacttcacatattctaactttgtctctcctgtggatccaaaatatagtgtgagctccctcattgatcttgattgattatgtgcatatgtgttcctttatatccatatgtatgcacatcttgagggggaggttactctatattttgtttatttaagatttctatcttgatttgaaatcatctttcatctcatctctccatattgtttatatcggattattatctatcacaaaagagagaaaagattgaaagatcttgaattaaataatttgtgtaattgttgctttggtgatagatgataaaccgatatttatgggattaatctctcttttacataagttttcaacaaggttatttcccgataataagatgtggtagatatgcattctttggtgatggaccttaatcatgacaaggatgaaattcgtggagataaagcgatatgtatcacttcttatctcatcctttttgataggttcatatatatgatttccatgttattgttatataagtgtgagactaatgtttacttgagtcttatcttatttagtctcctttacattgagaacatggagatcatgaaggtatgtgttttttgtttatctttatcattgctacatgccttctccatgtgtataggataaaccctattagttcttcataacttatgcatacacttgtctctcttgtatatttatttgtatgcatatatttagggggagcaaatcctatacatttattgtgcatgttttagatccacgttgttcacctattatttatattggatctttgcatttgagcttgcatacgagtatatgacactttgcgatgttaatgaatactcaacaaacatatccatatctttcatatgcaaccggttagtcaccaagtggaggatgacaaccgatttgttggtactaatgttcccctttgagatgtgcaaaggaataggtctaattgtgatgaggctaatggatgacaccatgggttgatggtcaccaagccaaggacatcgccatgtcgacaagaatgaagtcaagattgtgatgagaagaaagccttaacaaaggatggtcaagacctcggcataaacatggttcaagcgaatggtcatgagtgttgatcttggctcaagcattgaccccaagttggatggcacaagataaaggtataattgaaataagaatgttttcgtagtctttccccggtcttggtgtttggtgtagaccggatttgctagataggcgccgtattatcaagaggggtctatgaagcgagcacgtcgatgatcttgtgccatattagttcatatgcatgtaggtgcatttggtggtcttgtctagctaagtatgatgagttttctcatgtcccaaacaaagagagaagtgggtatgtccaataggagtgagtgacatcttgtgggtatgtccggtggatatcctttggagatgagccatttctccctgaattaagttgtgtttcttggatgaattgttcatgggttggatagccctttgaataagatttccatagagtctaagaacgtcaaattccgagacccgagtcaagagatatcgccgttttactaacagccggttgagctgaaaagtgacctgcggtctgacagaagtatgttgtccggtctgacctcccatcccatggcggtctgaccgctcatcctaattttgaaggaggtctcgtcttggcgatccaaagccgctagagctgcaaccagtcagaccgagcccctggtggtctggtcgagccgtggacggtctgaccggccactacactgcggtcagaccggccaggttgagtgggctcaatgattgcctagccgttacaaagtagtccgatctgaccagccacactatagtggtctgaccggcagagcaaagagttggggatttcaatcccaatggctagttttggtggttgggggtatatatacccactctctagcagcaagggtaaggttttggcactccattgcattatcttgaacccttgaaagtgttctcacacccttgggcacttagtttatctagtgaggtgttagagagtgagttaagccaatccaagtgcattgcttcattgttatagctagtgtggtacttgatcatcctcggcaagcatcctagacttgttactcttggaggttgccacctcctagatggcttgtggaggtgtttcccggtgatctctccgaggagattgtggaggaggcccgacgccgtttgtgagtgatttggagttcaccaccttcgaagtgaaggaataactaccctagtgatcgaggcttgggtagtcctctccgtgggctggctcccaccttgcccaccccttgatgaagggggcgtgcggtggcttcatggttgagcggtggagttggactcgcctcaacggggattaggaaaccggcgagtttctgaacctcggtgaaaaattccttgtctcttgtctcatttatttgttgcatttacatttgagcaaatttacattcatagagacatatttgagcccatatcacttaggtttgcaaaacttaacttagttgcttagttaaccttgtacctcaccttgcctagcaacttaggttagttttgttgaagtgccattaagttttaaaaccgcctattcacccccctctagtcggcctccttgatcctacaatgatgctggagccgatcctcggcatcaaatccagctgaatcctcgatcctacaatgatgccggagccgatcctcggcatcaaatccagctgaatctttctcgatctcctaaaattggttgagggcttttgatctattcgatctcctttttctatttttttcaaaatcaaccggtcgggattgaatacaacgaattaaaaatgaatggaaagaggaaatcatgaggaatataacaaggttagaaaatagattttcgcaatcaattgaaagaggaaacgtacagacgaatcaacatcgtggcggcggctggagaggctttgcccgtgtggagcggatcggactgagagcaataagaaaaggcgatcggatcggattgagagcagaaaaaacggcaatgaagaaaaccggataaaaaaaaggaagcctgagaaaaacttccttatttttcagccctatcccagttcgatacatcccttcgctcggtttgtctctccttggtccggcccataaacaaatctagcttgcataaccgactgcatcttcaacctctagaagatgccacgcatgacgccgaggagcaaatccagctgaatctttctcgatctccccgaaattggttgagggcttttgatctactcgatctcctttttctgtttttttcaaaatcaaccggtcggtattaaatccaatgaattaaaaccaaatggaaagaggaaatcatgaggaatataacaaggtttttttcaaaatcaatcggtcgggattaaatccaacgaattaaaaccaaatggaaagaggaatataacaaggttagaaaatcgattttcgcagtaaattgaatgaggaaacgtacggatgaatgaacatcgtggcggcggctggaggggctttgcccatgtgcggatcggactaaagagcaataagaaaagacgataggatcggattgagagcagaaaaaaatgacgatgaaaaaagccggataaaaaaagtgagcctgaaaaaaactgtttcacatggaaaagaactaatgggacataaaaaaaaggcgaaaaaagagacggaaaaaaaaccggaaaccttgcgtatttttttattaggcatataggtatacagatatatagatatatagatatactagaaaaaaatactcgtgcattgcatcggggcaaaaacgttttttgagtagtacaaccgctagcaatgaagaaacattaggatcgctattcattataattgaaaaagtaaatgaaaattattccttttttgggcctacaacccattatttccttccttttcttttgaattttgatccactcgatctcctctttctgttttcccgaaatcggaaagaattcacaaaatgggataaaaaggccggtcgggcataattggcgaactgtaagccgaattgagaggggaaatgtgagaaaaatgatgagagaggtggagaatcgattttcgcaattaattgaaggagaaaacgcatggggaaacgatcaattggaggagaaaacgcatatggagacggatcgaagtggcggccactatagggtttggtccgacgacggcaacgtacaacagatcggatgagataaaagaccggatgaaaaaagcgaaaaaggaacctagcaaaaaaaatcgaatcgggcaaaaaaaacaacggaaaaaaagaaaccggataaaaacagcaaagaaaaaacaaaccggcaaaaaaaaagacggaccaaaataaaacaacgaaataaaaagaaaccggataaaaacaccaaaaaaaaagacggaccaaaataaaacaacgaaataaaaagaaaataaaaccggaagcaaaaaaaaaacagaaaaaaggattcggcaaaaaaaaaagacggaccccctctctctctcgttaacccaaatctacaaacccctcccccccttcctctctctcgtccgttccggcgccgccgtgtactcgccttccggccgcggccggcgtcgcatatcatttcgcctccctctgtatcatcactccgctccaccccccacgtagaacatctggcgccaactccttctcgtcatgcccatgcggtgaaatcagtttcgtggtaagagtccgtctcaaagttatcgcctttttttcacccctccgtcctctctggttccgattcggtattgatttggattgcttatttatacaagaagggaaaaaaaaccaaggccactcctagctttggcatcgatcggcccggttgtttggggatcttgcgctcagtagcgaagccaccagtatggcgaggtatggcggccgccatacctgcccaccggctgatcgcctcatcgcatcggctgttcgcctcctctcgtcgacagttgactcgtctcctgccgcgtgccgcccgatctccgactccaggtccaggacaccgccggacgccgttgccacgctggacgccgccacagtaatcactccgagacaccagttggttccatctctcgcacattagcaactatatcctgttgaatcagacaatcagttgttacgagtagtaatgttaaactagctcgtaatatctgtagttacccagattgcgccatggaagaggaagaaccatctaataatcgccgacgccgactgcgcccaatttcagaagctacccagattgggaaaaaaataaaaggtgagaatttaatctacccttgttggtactgttatttattcactttaacgtatctcttattttaaatttttatgtttgttagttgtcagtataaagagattttttagcagtagcactgctaatatatcaggaggagatggaaatgaaaatatagaagcaagagatgataatgaaattcagtccattattttattatatatgtatgttttcttatacaaactagagtactagactagtacttagtccgtagtaagttcgccataggtgaatttttatcctggcttcgccactgcttgcgctgcttctgtttgtatctagaggggatcgatcgaatacttgggagactcaaatccacaaatttcgtcagcattgcgtgctgctgctgcaatactgtggtgagtagatgtttaaagctcccatcttttctctctcttgttttctttctgttctgacatcagtagcacccatccaacgctaataatggcctattacaatttacagtttattaacttccagttgactgcagatcagtgtttttttggtctaatggctaagcgaatgaatccatgtcatgggaaactggtccccaagaacaaaagagccatattacagtttgatgacattcctgaggtaaatactagtagaatctagtgtcaatttccattctatgtacgttatataggtccacttatactgactgtgctgtttttctttttatgaatgtgagtatggagttctgtatatatatatatatatatatatattcaactgacttcttcttgatgtataggatgtggtgttcttgataatccggttgctttcgctgactaatgctgcgcgtgtcagcatggtgtcgcaaaagtggctacaatcttggaggctctatcctaatttagagttcacctcgaaggcgttgggtttgaataaacgggtgcacaaacaagggaggagggctaaatttgtcaggtgtgttaacaccatcataaggcaccacgctggaacagggattaactcattcaccttgaagcgcaacctcaacaatcacaagtacgcacactatattgaccgttggatttactttgcagtccgatctggtgcaaatgaactgactattgacctaagtccacgatggtatgctcatcctcgtgatgtcaaatacagctttccatcctctaatgttgctgctccagaaccaacctctatagagcatcttaagctttgctttatgaatttgaggcctttaccaacttttagtggcctaagaagcttgaagactcttgatttggcccttgtatgtataaccacagaagatttagagagcttgttgagttatacccctgctctacaacagttgaagctaaggcaatgtccaatgctggaatacttgaagatcactgatgtactagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3080 - DNA, 506 bp, Oryza sativa
aacgatccttcttgtacttgatttctgatgattgacattcgttgtttttggtgattgattatattgtcgtacttcatttttgaatgtgacggagataaacctccggggtacgccctcgagacgattccgtttactatgatcactgttattttgatgtaaattatatgccgtctgagagagttcactcccgcgacatttgattattgtgtgtatgttttgtatacaccacgaatgattatacgacccttgatatttgtgttgatcatctatactaaatcgttgatattaatcttattgtttgatagtgtggtttgttcctcgtgagatcgtcaagttaaggtacgacccccgcccggggagttctacacatcggttgatcagtgtcctcttaccttctttattaagcagagtctcgtactgtattgcaaatttagtagttctatatttctgccatgtgctgaatgtacttgaaaaatgaagttccatgattaatgatgagaatcagt

SEQ ID NO: 3081 - DNA, 716 bp, Oryza sativa
gaggccttcttcaaggagtgccccccccctgatgacaagcagcgcaaggagctcagccgcgagatcggcctccagcccctccaggtcaagttctggttccagaacaagcgcacccagatgaaggtaatatactcatccgtgcatccatcgtatatcttacacgtcatgtgaacgtgcatcggttcataatgttgtgtttataaatgttaatggtatgtgtggttgcacgggtttgtatgttgcagacgcagcatgagagacacgagaacaatgcgctgcgcgcagagaacgagaagctgcgggcagagaacatgaggtacaaggaggcgcttgccaacgcgtcctgccccaactgcggcggtccggccgccatcggcgagatgtccttcgacgagcaccacctccgcctcgagaacgcgcgcctccgcgacgagattgacaggatctccgccatcgccgccaagtacgtcggcaagcccgccgcggccgtctcggccgcgtacccgccgctgccgccgtcgaacaggtcgccgctcgatcatatgggcattcccggcgctggcgccgacgtgttcggcgccgacttcgacaagccgctcgtcatcgagctcgccgtggccgccatggaggagcccgtccggatggcgcagctcggcgagccgctctgggcgccggcgctcggcggcgaggcgctcggcgaggagggggctgcagga

SEQ ID NO: 3082 - DNA, 1111 bp, Oryza sativa
acagcttgaaattgattttgacaatatgacaaatataagcatcatttgtaaatactaaatgatttcaaatggaaatatggtcaacaacaaagttgagcctctcatcaagatctacaacttttattttggttacttcttcatctgacaaagtgatagttatattattcacaaaaatcatatttctctcatctggtttataaatatcaacacagatatgtcaattttgtaaacattggtactatcactttgtcggatgaagaagtgaccaaaataaatgttgtagatcttgattagctgtacaagttagctgtctatggctttcccatttaaagtcatgtaatatttacaaatgctgtttatatttgtcatattgtcaaaaccaattttaagctgttagaaacaaagttatatagataaatgaccaaaataaaagttgtagatcttgatgagaggatcaattttgttgttgaccatatttcgatttgaaatcatttactatccgaaaatgtgttatgactaataaaatgaattattatacagcagctatatattttgtactcacaaatataaagacttatctgggaaatggaaaaatagtcatcggtgacgggccttagttcaagcccgatagagattaatctatctctatcgggcattatcttagggcctgtcacagatgagtcatccgtgacgggcctgaatgtcatctcaatcgggcattagtatggagcctgtcaccgatgagtcatctgtgacgggctctacggcaaagcccgattgagatgactcatcactctaatataactagggtttctcagatcggatcgaaaatttttctaagtcccgctacagtttcccgcctccttagaaccctagcgccgccgccaactcctccttcaccgccgtcgtcctccctcgccgccaccaccaccgagaccgccgccaccgccaccgagcccgccgccaccgccgccgagcccgccgccaccgccaccgagcccgccgcctccaccgagcccgccaccaccgccaccgagcccgctgcctccaccgagcccgccgccaccgccaccgagcctctacaccgaccgacgtcggccttcctcgtcgt

SEQ ID NO: 3083 - DNA, 662 bp, Oryza sativa
taattgttttctaacgggtgcaggttttgtaagctacgattctcctgcttccgcacaggcagccattggtgtgatgaacggtttccaattaggcagtaaaaaactcaaagtacaactcaagagagacaactccaagcacagtaaacccttttgacgaaaactatgatgaccacgcgatcaggttcctggtacatatttgtcagataattgatcgttgaattgtttgctctggccgcagcattgggagcttcgtgtatcttctttgttcaattcacattcttgaacactgttacgtcgtgtaatttactgcagcctagtggtagaatttgtttcatcagacccttgtacatcagaagtcagattcattcaattgtggacattttctcctgacagtgattccggtttctcattgacacgattccggactcacccaaaactattatctgaaccattattgacttatcatgtctaaatccccccatggaaatctgatgcttttggaaaatgcttgtcagtgattcatattaagtggagtagtaataatttgtcagtactaacgtggagtatcatttgacaagattcagaatatgaaatttggtggggcgagagtttgatgtctgagcagcagatgcagatcagaaattcagaacaggataaaagca

SEQ ID NO: 3084 - DNA, 543 bp, Oryza sativa
tatctccagcacgccatgacatctagttaccatcttgatctaggccagtttagtgtgctcgggtaagttaagctatcagctattacatgtgcattaattgtcactctgttccatcacatgggtgattacagccatggaattgagtatcccaatgtcggtgatcacatttcgagcacgtagtacttcggaagtggtggtgctcatgactctgagcgcagagtgcaagcgaaggttgcttgagtgaccaaaaaacttgccaggtcgtgacagagttctacgcattgaaaacaacgagatctgcattgtttagttgatcccactagcatacaaatcggatcttggtcaatgcgcgctagctggaggcatcaaccatttccatcaagtcaaacgcgtacatgggttcgagaaattccaccccgttcgagatccatccaccggcgcgagcgccagatgccatccaagaaaatccccatgtttcgtgtaggattcgcgttgaaattgtagagatttttaggctctcgattgggcggagccctgtgaatt

SEQ ID NO: 3085 - DNA, 665 bp, Oryza sativa
ccttcctcaagagaagctgaacaaatattggagtgtgtactgaagagcaggaacccaaagttacccagagaaaggacggtcaggtgtacaaaccgacaagcatttataccacatttattacagatggagggagagatggaggcttcagccgtttggattttggttaaaattaaaggtaatgtgactgaaaagttatgtgtgatgtgataaaaaagactgaattttggatccaaactttagatctaaacacagccagagatcccagcagcaaattgcaattgttaaaagagggcaaagtgtgtgtgcgtgtgtgtgcatttctaggctggattccagtgcagccacatgcgttgtgtctgctgccgccgcgacccatttaggacagggaacagccaagccactagcccgtgctgacctgctagaaattaaccaggtgaatcaacttaatactgctctaggggctgtgatctttccttcgagttcctaacctcacctccctctttctccacgcacacgcttcccaaactatcaaacgggtgtattttttacaaaaagttcctatataaaaattgttttaaaaaatcatattaatctatttctaatttttttactaatacttaattaatcatatactaatcagtcactccgtttccgtgagaagggga

SEQ ID NO: 3086 - DNA, 572 bp, Oryza sativa
caggtcctccaggagctaatctatttatctatcatatcccacaagattatggggaccaagacctttccaatgcattccagaggttcggtagagtactaagtgctaaggtttttgtagacaaagcaacgggttccagcaaatgctttggtaatctctctctctctctctctctctcacacacacacacacacacacacattttgcttatagtctgctaattgttttctaacgggtgcaggttttgtaagctacgattctcctgcttccgcacaggcagccattggtgtgatgaacggtttccaattaggcagtaaaaaactcaaagtacaactcaagagagacaactccaagcacagtaaacccttttgacgaaaactatgatgaccacgcgatcaggttcctggtacatatttgtcagataattgatcgttgaattgtttgctctggccgcagcattgggagcttcgtgtatcttctttgttcaattcacattcttgaacactgttacgtcgtgtaatttactgcagcctagtggtagaatttgtttcatcagacccttgtacatcagaagt

SEQ ID NO: 3087 - DNA, 561 bp, Oryza sativa
  unsure (1)..(561): unsure at all n locations
nnnnnnnnnnnnnnnnnnnnnnnnnnnnnnnnnnnnnnnnnnnnnnnnnnnnnnnnnnnnataaaacactgactaatgtaatgctatcaggatttagtgttaacgttgaatgcataaactgaaaggcttctaacgcatctccgtagagtccattttgtacacagcccacaattgctgtattccatgaaataatatctgatatgggagttatgctttccagcagtgaaaaggcggccagagagtcaccacagcatatatacatgtgtatcagagagttagcagctgaaactccagtcagaaacccatacttcaggatgaaagagtgaacagacttgccaaagttaaggtcttgtggacaaaaacatgaaggtataacagctaccacagtgctcaaggtgcagcttaggccttcagatagtagtcctttgaacatagctttagcctcttctccaagtgaatcgtttcttgagtaaccagaaatcattgtgttccatgagatcaagtctctcattggcattggcctgaacaaaatgcgtgctgtagatgggtcattgcatttca

SEQ ID NO: 3088 - DNA, 554 bp, Oryza sativa
  unsure (1)..(554): unsure at all n locations
nnnnnnnnnnnnnnnnnnnnnnnnnnnnnnnnnnnnnnatatgtttgggccgtagagattgtcacggatcgggctatagagagcagcagtaattttgagttaacaaagcaagtttagagttttgatcctgtccaactaatcgccgggttaatcgggtctacacgcgtgacatgcgccgcaacgagattaccaaaaaccaaaacaagcaaagggcgggcggttcattcattcacagaagaagagggccatcactaggaaaaaatcatcatggtcgtcatggaggggagagacagtatagcctaatctaatcccagattgctagtgattagcacgtagatacatagaagcgatcgatcgaggacacatcgagaaaaaggtaaaagggagatcaattaatcgaagaagagagtttttgaaatatcgatcgatctagctatcatcatgtcgttcatccggaagaagtcgatggagttcttgaagagcttcgaggtgccggcgaagaacccgtcggaggaggcgcagcgccggtggcgggatgccgtcggcacactcgt

SEQ ID NO: 3089 - DNA, 1224 bp, Oryza sativa
ttcaagcttagcacacccagataggtttagaaaatatagctcaacaaggtctgtgactgatgacggcagtttattaaggttactattccttgataggtccaaataacaaagtttttggaggctaccaatgttggcaggcaatatttcaagagagcaattggagagaattagactctgcatattttgaagtgtgtggaaagatttagggagggatataataggaaagcctgagacatcaagataccccagcaacatcagtcgacgaatggaagatggcaggactggattgcttggagtagattgctcttcattggacaatccactcaggtccaatatacgtatgtaactggtttgagagaatgcttttcggggaagttgcatttcaggacattctctaaaacagagggttcgtatcttgcagggtatatgtttaaaaatctcagttcgcttatggtagttgaccaactgtgcatgtcgacagtaatgctcattagctttgtcccatgttgttggtttgttggcatccataacaaggacttcatcagcagcaattatttttgcaagatcatacactaaatcatgcatggtgagctttcgtggagctttggcatgcactgggctaacctgcaaaaatataaagcagacattgaaattattaggtaggagtatcaatgaaatacatgtcttttgaacagctttcatggatgtcgaactcttacatgtacagattgagaaatggcaaaatcaaagaaacaagacaaaacagattacaaacacatttatatctattattctccaggctgtcaaaaaacacaatgtaatttgtactgcacatagaccaataggaaaataaaagaagatatttacaaggaatgcacatttattttgtgttggaatatgaaatatggcatgtatcagtgaatagactataaaatactataggtaataattagggttacaggtgataataaatactcactacagtctcaatggaaataaataggggctatattacgaaaggtattgcaacccaatttcaagcacgagtatagcaaagtaaaaatataatatatattgagaataagtgtaattaaaatagaattatgaataaaaaatgaagatattgaaatgtttggttacgaatgtttgaccaatcatgcataaaatattctatcagaaacatatgttcctagcaagtaatgatgaactatttatgtaaccatt

SEQ ID NO: 3090 - DNA, 550 bp, Oryza sativa
ccattgattttattgcactcatgcttgtacttgctatgatctccagaacacaagctttttattggaatgcttccaaaaaatgtaacggacaccgaattgactgatttattttccaaatatggaaatatcaaggatttacagattttaaggggttcacaacaaacaagtaaaggtgagatctggtgaataacctattttcctaaccatttagagctagaagcactggttgactctggaactttacaatacctaatgtttttgttaaattaactgtgttattgcagctggctgtgcattccttaaatatgaaacaaaggagcaagcagtggcagctattgaggctctaaatgggaagcacaaaatagaggtttgccagaaattagttagaatagcagaaaaattcttagtggttattgaaatgtactgcaattcacacatgaacatgatccatagctctacttagtcatgagtctgatacacataaacagtcaaagctaaagacactctctgctattgcatttatttgataccttgtgtctgcattatatta

SEQ ID NO: 3091 - DNA, 497 bp, Oryza sativa
cattcgctacgtttttgcttgttcagagcaacgcatcgcatcatgcctcgtccacctgaacctgtgcacgtgctgcttcttgctgccatcgcagtgcaagtgttcgtccggtgcacagcacaagctgcgagtgatcagaagccactagtctccaggctcgccaaggattacaacacctcactctacaccatctccgtcaagaacggcgcgccgccgctcgtcgtcgacctcgccggcgcgctcgtctggtcgacgtgcccgtccacgcactccacggtgccatgccagtccgccgcgtgcgacgcggtcaaccggcagcagcctcgccgctgccggtacgtcgacggcggctggttctgggccggccgcgaaccggggtcgcgctgcgcctgcaccgcccacccgttcaatccggtcaccggcgagtgctccaccggcgatctgacgacatttaccatgtcggcgaacacgaccaacggcaccgacctgctgtaccc

SEQ ID NO: 3092 - DNA, 680 bp, Oryza sativa
  unsure (1)..(680): unsure at all n locations
nnnnnnnnnnnnnnnnnnnnnnnnnnnnnnnnnnnnnnnnnnnnnnnnnctaaatgctgatggctttcctttatgctttgcaggagcaggaggtgatgctagtggaaggtctaagcagagtaggagcgagaaaaagagcaggaaagccatgcagaaacttggcatgaagaccatcactggtgtgagccgtgtcactatcaaaaagagcaagaacgtgagctgcttaatcactgttatgccattgtttcttgtaggctcacagaattgttatataccattgcattttgcttaacttttccctgcactaccagattctgttcgtcatctctaaaccagatgtcttcaagagcccaaactcagacacctacgtcatcttcggtgaggcgaagatcgaggatctgagctcgcagctgcagactcaagctgcagagcagttcaaggcacctgacctgagtaacgtcatctcaaaggccgagccttctgcagcagctcaggatgacgaggaggtcgatgagtctggcgtcgagccgaacgacattgaactggtgatgacacaggccaccgtgtcgagatcgatggcggtgaaggcgctgaaggctgctaacggtgacattgtcactgccatcatggagctgacgaactagtggaatcactaaacgttgtgggggggatggaacttg

SEQ ID NO: 3093 - DNA, 7070 bp, Oryza sativa
  unsure (1)..(7070): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactctcgatctactcctccaatccacaataaacaaatctaatacattcacgatataacacattgtaatgcaatatgattcgtagtactttccctaacgtcccatgttatgtatagttcattttgggatcgagtgagaattccattgaagtgatagtgtggtactagtactactataaaactatagaactatgtgtactgcactggaagcacatatgctcttgtgttgatctgaaggtaacacaagatagatggatcgatctaaagtatgagcaaatacgaaatcgcattgaattttatctgataggaaaaatcgcaatgaatcttgatccatgcaaaccagcacgacctccataactcaagtaaatggctcacaacaatctatgacctctataacttaagttcttgctagagggccgatcacagtggacacatggttctcttattcaattttagtactaactatgtactaactgtaaaccattaggcagcgacagtgaagttgaagttgctgcaggtggtctggagcccaaagaggaggccactgaagccgagctgctgcttctcctcgtcgaacaccaccaggttgtgctccatctggtgcccgccgatcaccaccgccgggccgtacccgaccttctccggcctcatctcgacgaacgcgaagcacgccgtggcgtcgtccacctgcaccagcgagttgccgccgaagatgtaccacgccgcgccgtcctcgaggttgatgttgatgtccggcacggcgtagccgagccggttcgagccgatcgtccggctctcgtagcacagctcgaacggcgccaccggcggcgccaccttcttcggccattgcaggatctcgtcccacgccttgacgaacgggccgtacacgtcggggcggagctcggtgtacggaaccatggagctcagctggacgacgagtggcgccccgtggttgggtagtggcacctggtggtggttcacctcgatgctcttggccgtgatgtagtacccgccgccattgccgccggcgagctccgggctgcggcggagcgcggtgtaggacagcttctgcatgatgtccggccgcgagtaggggaagatgaggacgaacgggccgccgccgaagacggcgacgctcgggaggcagagcgcgaacttcttggcgacgttctgcgtcgccgcgacctgcgcgtgcagcgcgaggtcggatcgcccgagaccggcgacgccgacggcgccggcggggagcgaggcgaggagggagcccggcgcgcaggaggcgacggccgggaaggtgaccgggtagagcgggttgctgccgttggtggcgtccgcggcgagcgccgtgcgcgtcaggtcccccggcgcgcacctcccggtgacaccgttgtacgggtgcgccgtgcatttgttgccgtagcggtagtcgccgccggcgccgccgtactgcatccagcagctcggcggcgtgtagtggttggcctccacgcactcgcgctcgtaggggaggacggtggagtgggaggcgtcgcaggtcgaccagacgagctcgccggagaggtcgagggcgagggggtggccgtccttgacggcgatggtgtagagcttggtggcgccgtccttggtgacggccgtgacgaggggcttgccgccgccgccgcttgccagcgtgtgccacggcaacacggcgaggaaggagatgaccaccaggagaagcggtttgcctttggatttggcctgcggcgacgacatggtgtaccgtgtatatatgtacgtgagttttgttaggctaatcgtgattagtgtgtggtaatctgatgtgatttgatgaatgcatggtttgctctttatatagatcgagctagtggtcgtggcctgtcaggtagtaagtactaattttttgttttcaatttttgtatcattcaattggaagcttcgccatgcaaattaatatgcaatcgccagatgcttacaccgttacacgtgctttaatgtgagcatcatgtatgcatgcacggcgaataaattagccctggagaaggcgtgacggtggcatatatacacgtgaacgtgaccgatggcaaatagtattgcagagaggaaatataatgcaccatgcataggaaagaaaaacgagccatgccgttgttgcacggtggtgatttacatcggagtcggcaaacgaagttgactcgtgggcagtcggcacgtggatgggctcgatcgagattcgagtgtcctagttctatagaactataaacgcgaatttattttatttgtttcaaatatagatgaaatgaatcaagcatgtgaatcacgtactacacctcactgcctcagccatcttgtcgggtatacacacaaaataatgactccaactcattttctgacttcttccttttcgtccccgagggagtagaactcaagaaaacaggttgattactcagatagttgaagctctcacagtacaatacaatggaaagcagcccagctgagctgatggccgagccaacagaaggcccttccactcatacattccggcccaacttcaagcccatgccatatggcttcgaccttttactcgtcgcgttctttagtaccgcaccgcttaatcacatcatgcacgaccactttatatagtcctccaatgtaaccaatcgcaagcaatgacgaaaagcaccagcactggtgggtccagtgcattctccatatatttaaggacgtgtgcgctactgagctttcataagtttccttttgcattcttatcttttgaaatcattcgtcaaaaaatggtaacaaatcacaattcataaaataaaaattgtttcttttatattttttgaaaccatttgtcgggaaaactgtaacagaacacaactcataaaatgcaaagtgcacctacgatatacagccttctggagtactttcctccagttaaagaccctatatatggcctatttacttgagtgccatatcaaacacttctgtaaattgaccgttcaaaaaaaaacacttctgtaaattgagctggaaatgaagcggtctctcttttctttttttgtgagaagaaaagccctgtaaatcattgcctcaacacggtcaaactaagccaagccaagttgacctcacaacggtcggactaagctcatcctagtaaagcctatatcagacttgggccattggttgttataccctacgagggacccctagcacgcacactcgctacgtttttagtaccataccgcttaatcacattatgtccgaccggtttaaatagtccggcatggagcaagtacatcaccgagcaatgacgaaatgcatcaacgctggcgggtccggcgtattcacctgatcatttaggacagagattgtgcaccactgagctttgacatgtttttttatcttcgatttcaatatgcatttttgacaacgacttcagtatccatctgacgtaatctaggaatttttttcttcaatcccaggatgatttgacagcatctggtgatttcctcttcaattttcaagtccagtatgtattgataatgacttttaactttagcatctgatgcgatctaggccgcaagagagaagttgaagttgttgcagccccgttcttttactattaagattagattttaacttaattttcattagtatgtttttcaaacggttgaaacactgtgtcttatgcggaagctttttatgtaaaagttgttttgctttcaaatatattttgaaaaaaatcaattttaaatttataataataattaatactcaattaatcatgtgttgacgattttctcattttgtatgcctacacttaatcttacggccttatcttttcgcttgtgcttatgcttattcttatcagccaaattttgatttttcaatcttaaatttgaagttgattttggggttttttatcgaagtttattttcagcctttgattttatatcgctaagaacacatatatataaaagtttatttataattttttttttcgtttgtaaatacgtcgttttgcgatggggctgttaatcttcgtagtatacatttacgggtcaataaatttgataattcgtgtatgctgtagtgtgtcgtagcccgtaccacatccaacacttctcacaattgggctggaaatggaaaattctttttttttttgaagaggcgcggcccatcgttgcttcaaaacggcagggcaaagcccagcctaactaagtctgagttgtctctgttggatgtcaccttccggcccaaccggaagccctggcagtcgcttcgatttggggcactagactttttttagtaccgtattgcttaatcacattatggccgacctgtttaaatactcccgcacgtagcaattgcaacgaagcaatgacgaaaagcaccaacaccggcgggtccggtgtgtctacctgatttaaccattcgggacaagatgggtgtgccttccgagctttgacgattttttgttttccccttcggtttcaagctttcagcttttaccttctttttttttcctgttttccttttcggtttcaggctttcagcgatgcattgatcacatctcagaaatttctgagtcagtaacaaatctgtggcctttctccattattcattgaattgtacttgtaacaaaacacaactcataataataatgaaaaaaaaatggatgcacatctgatgcatatgtgtggaaaaaataaggatcactaacgtatacactatatagtcgatcgactataaccttcctctcttcctctgccctgaatgtcttagaccaccgagcagtggtgttatctgcacgggctacttatccaattcatggtcagatcgagtttctagttgaatgcagtgcataagagaaagctgaaggacataaagtttagaaaattagtaaatgatgtctaacagatctctccaacaagttgaatcctgacgacatgtctttcttatctgttgggtttcctgtttagccccatatgtgttgaacagaatcgtcttggcgaaaagcagttctcattcccaccgccggatcgatgtcctcacctagtctggaatttgaaggtctgatgcaaaatacagcagatgatgctaatgctaaattctcgcttcctcttggtgttttcaccagatatatggggtgctaaaaactggaaggtttttttaactgaaaggtcaatatgtcattcaggactttgtttccacaaaaaatgcaggacctgatggggttcatgtagcatgtgtaccagacgaacaccgctgtaaactgctgcatttcagcttgaattgcttgctatgtttgtgggactagttcaacaatccatggtttgacaggttgttagaattcatcagcagttacacttattttagaaccgagggagtaatcttgaacgtgatctttccctttctttaagggaaaaaaaacagtacagtgctagttcaaattaactaagcatgtgaatcacaaatctcaatcatctgcgaagtgtaccatcatttctgcctttccccccaagtggtagatactccttcaggtgtgcagggcaattccaccgcgttctgtcaattggactggaaaggaaggcccggcccatcgttgcctcagaacggcaggactaaaccaagcccaacatggcccataactgcctcgcaacgtcggagttaagtttagtaccgtactgctcaatcacattacgatcgaccattttaaatagttccgcacgtagcgattgcatcgtcaagcaatgacgaaaagcaccagcaccggcgggtccggcgctctacctgatattattcgggacagatgatgcaccttctgagcttaaaccccaatttttttccctgctttcccctttgcttttagcttcgacatttttttttcctgttttcctcttcgatttcaggctttcagtaacttcgctttaagctttgacattttttttcctgtattcctcttcgatttcaggctctcagtaacaaatctgtggtattctccattattcatcgaaatgtacttgttacaaatcacaactcataataataataatgccaaaaaaaaatgcatgcacatctccgatgcaaatgcaagctatgagctcgaggaatcgactcgatctaggcggcgagagtgaagttgaagttgctgcaggtggtctgcctcccccagagcaggccgctgaatccgagccgctgcttctcctcgtcgaacaccaccaggttgttctccatctggaaccctccgatgatcgccgccggcggcggcgggctgcccttctcccccttcaccttcaccaccgcgaggcacgccgtgttgtcgctcacctgcgccatcgagttgccgccgaacaccgtccagttcttgccgccctccagcaccaggtcgatctgcggcacggcgtagcccagccgcgtcgaccccagatcgcgcgagtcgtagcacagctcgaacggcgccgccggcggcggcggcggcgtgacgcgcttccggccggcggtggccctggcgaacgcgtcgaccaccgctcggtacacgtccggccggagcgccgtgtacgggatcctcgtgcacagctcgacgacgagcggctcttgggtgtagagctgcacctgctcctggttcacggcgatcttggtcgccgagatgaagtatccggggagatccttgttgcggtggaggggagttt

SEQ ID NO: 3094 - DNA, 6095 bp, Oryza sativa
tcgcgagaagggatccggcgcgcaggaggtgacggcggcgaacgacaccgggtagagcgggttcttgccgtcggtggcgttcgccgacagcctcgtccgcgtcaggtcggccgtcgccgactcgccggagaaggggttgtacgggtgggcggtgcacttgcaccggaacgggtcctcgacgtcggcgcggccatagccattgtgggggcatcccggcgggtggtagctgtgcgcgtgcatgcagaagtggtggtggcactccagcgtcgggtgcgcggcggcgcacgacatccagacgagcgcgccggcgaggtcgaggacgagcgggcggccgtccttgatggggacggtgtagagcgaggtcgccgcgtccttggtgatggccgcgacaagcggcttgccattgccattgccattggcactagctgctgcccatggcaacgacgaggccaaggcgacgcagagcgagacggcgaggaggaggtggagcgacattgctggttattagcctgggcaaactagctagcacgcactgtgaattggtgtgtccaagtgtgatggtttatatactcagtacgtcgcagcacctgtgcagcacagcagaatgcgtgtgacatttctctgctatcgctggggatccagacctggtgttttctaaattataaacagtttttatctccagcacgccatgacatctagttagcaatcttgatctaggccagtttagtgtgctcgggtgagttaagctatcagctattacatgtgcattaattgtcactctgttccatcacatgggtgattacagccatggaattgagtatcccaatgtcggtgatcacattttcgagcacgtagtacttccgaagtggtggtgctcatgactctgagcgcagagtgcaagcgaaggttgcttgagtgaccaaaaaacttgccaggtcgtgacagagttctacgcattgaaaacaacgagatctgcattgtttagttgatcccactagcatacaaatcggatcttggtcaatgcgcgctagctggaggcatcaaccatttccatcaagtcaaacgcgtacatgggttcgagaaattccaccccgttcgagatccatccaccggcgcgagcgccagatgccatccaagaaaatccccatgtttcgtgtaggattcgcgttgaaattgtagagatttttaggctctcgattgggcggagccctgtgaattccggtgcgcgcggccgcgtgttctcccgaggattttgaactcgatctgccaaactgggctcacgtggactctgctaggccaaaggcccaattgtacaaactgggccttttgtgcatcacgtcaggtagcgagcaggcctttgtgaggcccagatttcagggcccaaaacggccttcatttcacgttcaaattccatcctacggctaaattaatccaagaacatttcatcagcgtgtttaatccgatatcaatttcaaatgttatgaaatgataggcaaataaacgataaataacaatagattaatcacataaggcacgagatttaacgtgaaaaaccctcctataacataagagaaaaaaaccacaggcgtcagccagcaaaatatcttcactatatctgagcgaggttacaacgccgcacggcggcttacaagaggtatatatatatatgtggaaccttaaaagggacgatgatccgtatccccggcctaaccctaccggtgacgggacgatgatccgtacccccggcctaagcctaccggtgacgggcctccgctccactacgacataaattggcctctattaagtacaaataaatttggatcacaactcaacatcaaatattcgcatcacgtggaacatttttcaaatactgcatgtagatggtagatggactatatattaaaagcaaagttcttaaatgggtgacagatacgggcatatggcatgccggacaccgacattacagttacagttacatggccgcgaaacagtggtaagtaagtaaattatctactgagtcttggtgaaattgaagttactgcacgacgtgtagaacggcagcctcgcgaacccgagccgcttcttctccgagtcgaactgcagcaacatgttctccatctggaaccctccgaggatcaccgccggcgaactggcggcgtcgccggacttcatctccacgaaggccaggcacgccttgccccccttcacgtccaccatcgagttggtccccgtcatcgtgtagttcttcccgccggcgagcatcagcctcaccgccggcacaaagtagccgatccgcgtgttccccagcatcgacgccctgtagcagagcgggaacggcgccacggcggcgaccttcgcgtcgctccggttcaggcccttctcgaactcccggacgaacgggcggaacacgtccggccggagttggccgaacggcacggcggtgcgcagcgccacgccgccggcggcgagcgcgccgctcgggaggggtagccgcgcgtcatcgagggcgatggcgttggcggtgacgtagtagccggggttgtctctcttggcgacgagcggggtgtagtccagcgtcgtcgtgaagtccggcagcccttcgccgaggtatatcgggccgccgccgaagatggccacgccctggccgtacccgagcctcgggaggcagaggaggaacctgccggcgacgccctgcgacgacgcgacctgcgccgggagcgcgaggccggaggcggcgaggccggcgacgcccgtggcgccgcgcggcagccgcgccaggagcctcttgggcgcgcacgccgccacggccttgacggagacctggatcagagggttcttgccgtcggtggtgttggcgatgaacctcgtgtgggcaaggttcccggcggcgcactgcccggtcaccgggttgtacgggtacgccgtgcacacgttcttgctgcagtcgccgccgccgccggtgaccttgcaggtcggagcacggtacgcgttgccgaccacgcacgtcgggtcctggcaggacagcgacgccggcaggtggtcggcggcgcacgtcgaccagacgagcgggccggcgaggtcgacgacgaggttgtcgtagtacctgacggggatggtgtagagcgaggtggccgggtccctggtgacgggaaccaccacggggtcccgacgacgaggcgccgcggcggagcacgacggcggcgacgccagcagcacgagcagcgcggcggcggcggcggcgaggacgaggttgccgtttcgtggcggcatcttgaacgatatgggtgatggatgatgaatgttgtacgtagctaagcttgtgtgtgtcttggtgcgacgcggccatttcttctttatttatagtacacgtgatgaagtgaagctgcaaatgccacacgttttgcaaccaggctggactccatgaagatgaagggagagttcggctttggtcacttggttaggagttaggacgcaaatctggaacttttgttgatgggaatgtggtacagtgggacgtttctttgtcacggacgttcccttctgttggattcaacgattgtttattcactgccgtttgtgtagggtaggaagttggtgtagcagcctgaatttgacactggggacacaggagatcggtttcagaattgcagaggcagcagcacacagattttgacactagtgagattgggtttgtttgccggttcaattcagtgtctgctttgaacttgaaggactgcaggttacaaatgtgcagtaagccgaaaaaataccttccaaacaggccggtcattcctgatctcaagaatttacaacgaaggttgtgtttagttcacgtcaaaattgaaattttggttgaaattggaacgatgtgatggaaaagttagaagtttatatgagtaggaaagttttgatgtgatgaaaaagttgaaagtttaaagaaaaactttaaaactaaacatggccaaagcagattgttccgatctcaacgaacgccataacgcaggcatctcgaacgcatctccccgatctctcaccacaacagcattgcaatctgcatcgactgcgaaaatctggattgattattgggggttcagacttcagagctgctaccatgtcggatcttgcgatggagtaccgagcaatacgcggcagagtcaacggcgcaaacacagcacaaacaacacaaagctcttaacgaaaactcatctcatcttctcgcgcaggaacagacagtgccgcgccgacacaagagtcttctccccaaacacgccacgggaccatcaaccttatcttctcactttgccaagacaaatcgaatcagatgcaatatggtttagtacttcaggacccctttcaatcgcaggattaagaaaacagagaaataggaataacgtaggaattgaatgccacacttattgaattcctatgggattttgaaacacgggtgtagtttgattagcacacagaaaaaacgcaggaaacttagacacatgaagaggaaaacatgaggtgagacctcatgcacctcatgcttatttttctccaaaattgctctagtaagattgctctagtaagtttcattcaataggaatttcaaaggaattgatagaaaacaatcctttgtttcaaaagactatagaattatttcccataggataaaatcctctagaatttctatggtttttccattaattcaaagggcccctttgaatcgtaggattaagaaaacatagaataggaaaaacgtaggattttaatagaaatgtaagagtaaaacagaggattgcaaaatgtaggaaaaacaaaggaatgaccgtttgattgaaccacagggaaaacacaggaattagatgagagatatagacttaaaggaaagttagcaagaggttgaagctcttgctaaatttcctctaaaatctctataggattgtccattccataggaatttcaaaggattagatatgattcaatcctttgtttcaaagggcttcataggaaattttcctataagattgaaatcctctaaaattcctatgtttttcctccaaatcaagagtcacagtttgactaccaaaagagaagaaaaaaagatactaatactatggtttacgtgttagagcaaaacgcattcacggccattcaagatatccacttggtcccaacactgcacaatcgtaatgcttgtatcttagttcaagcgaccaatgtctcaccaatacaagctcttattcaaagttacaaatggtcacgacaagttgacaacaaaaaaagcgagaattatatccttattttgaaatttgaattatagtggcaaacggtgagcccattttagtttcttgcgaagttgaagttgccacaggtagtcctgatgaagaagagggtgccactgaaccctagcctggaagcggcctcgtcgaacagcaaaaagttgttctccatctggaacgcgcccacggtcaccgcgctccgcgccgccctcccgccgtcgacgaacgccaagcacgccgtgtcgcccgccacctgcgccagcgagttcgacccgaacaccgtccagttccggccgccggacgtcacgaggtcgatcggcgccaccgcgtagccgaccctggtgaaccccagcgcgctgctgttgaagcagagctcgaacggggccacgctcggcatgcgcgttatcctcgccgtcgccttggcgaacgcggcgacgaacgggcggtacacgtcgcgccgcaggacggtgtacggcgcggccgtgtcgagcgtcacgccgccgccgcggctgagcgcgccgggagggaggtggaccgcctcttggttcatggcgatgccccggagcttgatgctgtacgccgaggggttcgtcgggctccgggccaggtcggtgtaggagaggacggtgctcgcgtcgaacagcgtcggcggcatcaggttgtacggcccgccgccgaagaacgcgacgccgggcgcggccgccgtgctcggcaggcagacggcgaactgccgcttaagcgacagcttcgagtagagctgggtcggcaggctcaccccgccacggccgaggcccgcgtcgccggccgccatggccggtaacgacctga

SEQ ID NO: 3095 - DNA, 4739 bp, Oryza sativa
cgagcgtgaggtcgccgacggcgcgttcgcccgtcaccggattcgtcgggcgggcggtgcacgcgcgtcctccgttgttgcaggacttgtgcgcccccgacgcggcggcgcactcgccggaggagcacgggacggtggggtgggagggtgagcacggtgaccacagtagctgtccggagaggtcaagcaggtagttcttgttggagatggagagcgtgtggagcccagtcttggtgtccttggtgatcggagctaccaaggcttggattgcaggagatggagaagcttgcaactgcacaagaatgaagaagatgatagcgagaaaaaatgcttgggaaatcatagccatcttgatggtattgtagctgagttgtgtggttgcatgtaaaaggtacagacatgcaatgagtactagttgggatcttgttgagtttttatgtaagatcaagggtcaaagcttgcttatcctatataaaaacgcgcttgcttatcgataatataagtatggttgattagtataatgatttgaagttctgaatctatttcgttgtacagctagctacagtagttctacttcctggttatgtagccagtggtatttgaccattctgattgactgaagttatatatacatggatttgttcatttgataactataatttgttcgttattatttcaagttatatacttggattacgtgcgtacaactgcacaaattaaatcctacagttcactgatatgatacgcatgaattaggtagggcaagctcacatagtcgaaggggaaaatggccaatccatttaggacaagaatctgttgattctcgaaacggcccagagcaaaggcctgttcgaattcgctgccacacaaagcccattgcatcttaacagttgaatcatcatgtgattatttgttctgttctatgttctttatggtgaactggaaatgcaatgtataaggtctcaatgcaaattagagcttcagtccctgagagcaagctacacggttagtcattactggagagatgccaaatgtgctacaacatgagtagcaagtgaaaactgataggacagaacatggtttaaagcagaagggcacaataatcattctattcgtaaatgagaggaacaaccaaagaaacacagtacgggggctgcgatatagttaccttaagatggcagcatattcagaaatcactggaatagacatgcatgtagagcttttcttcgtcttgcctctcttgtttatgttctctgtcctgagaagaatgcccacactctgccgtgttctgcagaaattatgacatacgattaaatgattaatacgaatcacacctgctgccgaaaatatcacaagttggaaaaaaactgacaattcaaaaacatgcacagctagcgagggatccgttaatccccgttaacacaaagtattcgtacactaagcagtactcaaatgaggcatcacaggcacacaacacactaacttggcatgcaagagaactgaactaattgcacaactaagagatagcacctaagaataacatatatcatagagaagataaatattatttgctgaattcctaggtcatcaaatatactgctgaagaaaatgcaaatgaaatgaataaatattactgggtttttgggaggttccatacctttgatccttcggctgtttgtcccggtatgaatatttcattattaatatgattctagggatgtaagaaatattgctggcatcctccccttggcacctctcaatgagtcttggacagttccaaatgttatagttccttcaagctggtatggttccgtatgctctccggtaaacatgtcatgttgggcgaatcaaagatgttaatttgtttcagacaaatgaacttccctatccattccggtaggctactgaatcctcccaaccatagctcatcaagagcaataagattcttcatgctttcaggtaaatctgtcaaatcgggacaaccttggatttcaatgcattttagcgaagcaaggtgtccaaacaattctggtgatatctccagcccttcacatccctccaacagcagttctgagagcgataatattcttcaagcgatcaagtggaaaagtcaccttggcagttctgagaagcctcagccattctggtagcgtctccagcccttcgcatcccttcaaccgcagttctcttaaagcggtaaggttcagtaagcttttaggcagagatgttagcttgggacaattaatgatggtaatgtattcaagggaaacgtgctgccccaaccattctggcaacatttccaagtcctcccaaaaccccaattctagtattctaagagcaggagccagctgcaaacatattttaaggaaataaatgaggagagagaagagcagcgggctacagatttgtagccagctatagcacggactccaagacgcagtgtgtgtatgacagatgggaccaggtattaatagtgtagtacataactattgtatggatgggctattatattggctataattgaattggagctagtagttggctatactattaaacttgctctaagagagagaaagcactggatgacatcgggcaacgtccgcaagccgctgcaacgatgtacttcaaaaatctcaagggtggcaagtctgccccacctgtcaggggaaaagtggcaattacctatgaccacacgaaaaggaagagtggaagacacaaggctcctgaatcctcgttctggcaacacctcgtcgctactgtccaagtaccagttcatacttcttgggggatatggtaggaaactcaactttgggcagttatctaccttcaaaacatgtaaattagggattaagaactcttcatcttctttaccggaccgtgttgtccaccactcttccaagttagtcattctttccaaccaaataactcttaatttcttacagtttccttcctctccatagaattccttgccaattctcctaatgctgggcatgttattcatcctgaaatgtcttaggtttggcaactggccaaatgcaggaagagaatcacatgttgctaaattacagatcctaatgcacatgagataagggagataggaggatatgccagtcaaccaggatgggaaatccttgcacatgtacccatccaacaaaaactcttcaagagtccgaggaggtatgaggttctccagcaccaatttatccttgtccacacttcttgtgccaccaagttcccaggaaaattttaaccaacgaagctccaccatatcccgcaagttagctttcctagcatcttctagccgctcaacattttcaagatgtctaacttccagctcacgacaacgcagtctcccaagctccactatactgctgaaatcagcattttctatctcatgcacatcatgttctacagtgccaggcaaatttaaatgttttttaataatttgagtcttatgaaacacacattctgatcctgtagcagtgttaagcagggtgagactactcatattactgatactatctggcaagccatgcatattataacaaccagtaagatccaggacttgaagacgaaggtcaccaagtgaagatggaagactttcaagacttacgcaatatgacaaattaagatgcttcaaattaaacatgttgcataatgaccagggcaatgactgtagcttagaacaacttgtgaggttcaaagactggagctcagagagatcaccaaagcattcagggagttgtatcagcccatggcagtctgaaagattaaggtatttcaaatgcttaagttggcaaaaggtttttggtagcacttgaaccctgtagcagtcagacatatccaaaacctcaagtctataaagattaccaagatcttctggtagttgttctagctcatggcagtctgagaggattaggtgctctagagactcaaggttaagactatctggaagtttggttagctttgaacaacttgacaagtttacaaatgagagtttagcaaggctaccgaatttaccagggagcttttgaagagcacaacaacctgatatgtctagatgctgtaagcatttaaggttgttaattgattcaggcaactcttcaagcttagcacacccagataggtttagaaaatatagctcaacaaggtctgtgactgatgacggcagtttattaaggttactattccttgataggtccaaataacaaagtttttggaggctaccaatgttggcaggcaatatttcaagagagcaattggagagaattagactctgcatattttgaagtgtgtggaaagatttagggagggatataataggaaagcctgagacatcaagataccccagcaacatcagtcgacgaatggaagatggcaggactggattgcttggagtagattgctcttcattggacaatccactcaggtccaatatacgtatgtaactggtttgagagaatgcttttcggggaagttgcatttcaggacattctctaaaacagagggttcgtatcttgcagggtatatgtttaaaaatctcagttcgcttatggtagttgaccaactgtgcatgtcgacagtaatgctcattagctttgtcccatgttgttggtttgttggcatccataacaaggacttcatcagcagcaattatttttgcaagatcatacactaaatcatgcatggtgagctttcgtggagcttaggcatgcactgggctaacctgcaaaaatatg

SEQ ID NO: 3096 - DNA, 19015 bp, Oryza sativa
aacacatttatatctattattctccaggctgtcaaaaaacacaatgtaatttgtactgcacatagaccaataggaaaataaaagaagatatttacaaggaatgcacatttattttgtgttggaatatgaaatatggcatgtatcagtgaatagactataaaatactataggtaataattagggttacaggtgataataaatactcactacagtctcaatggaaataaataggggctatattacgaaaggtattgcaacccaatttcaagcacgagtatagcaaagtaaaaatataatatatattgagaataagtgtaattaaaatagaattatgaataaaaaatgaagatattgaaatgtttggttacgaatgtttgaccaatcatgcataaaatattctatcagaaacatatgttcctagcaagtaatgatgaactatttatgtaaccattacttgtaagttacctacaagaaaaatgtaaatataaagtcactgtttcattttactagcaaggcatactgccatacccccaaataataaatatacagtgcatgaatggccaaacaggaacttaaatacttactgatgaagacttggaaatctgaagaaaggacatccccagaagataatcaatacaactttgaccagtatgccttgcttgaatgtatccaagggcgctccattgcaggatcaggcggtcactgtccacaacgaagcccttcgagaatgatgcaagacatgtaaagcacattttgtagtttggcttcatgtagtaatagctcaacaagacgcgttccaaagtgtctcgccgattatctactatgaaatccaaaacaatctttctgtctcttatatctctccatgcctcaacggtcctttgctcagacattacttgcccaagagcattagccaccagtggtagtcccccgcacctcccagcaatttgccttccgatttcctctaagccactttgatcatcatcaggtccaaatattctttgcttcatcaccttccagcagtcatcaggtgataaaacatccaaattgatatgatcggcctcatgcacagggcatattttccgctgatttgcaagacaaccagtgtgtagtacttgcactacacttccattgcgtgtagttactataatcttgctacccttgccgccatgttgtaacatctgcttcaacttttccaaattttctccatattcttcccagagatcatctagaccaatcaagtatctcctattggcaagttcttttatcagattatcttgtacaaactgcaagttgcagttgtctaggctgatacttctgtttgctcctctgatgatagctttcccaattttgagcagatcaaaatcctctgaaacataaacccagattttcatatcaaagacacggacccttttgtctgcaaaaactgcttgggctaaggttgtcttccctagtccaccaagcccaacaattggaataattgagatatcctccttggcttcagttttcaatagaaggctgattattttttctgtttcagcatccctccctagcattccaatctccatatcatcactgacagtaaaagtttcgttgcttctactcccttttgcatgtggttcatgacgcacaagattgagcatcttgccatccttttctattgcaactattttatccctcaagttcttcatgttgcgtgctatggtcattttctggaggagcggattgttccaggaaaagtataacttgagctgaaaaataaaattggagtcaaagtcactgtctatattagtgtcctttgtagatcaattttcatctactcagactagtctctgatagtccgatatggatcgggaaatggcatggtagtggaaaagatgaatttcctttttaattttagaaattaatcgggctggtatgatgcaaaaaagttccacaaagaaaatcacacatgtgcagcagctgatccgtaaagttgaagcatataacatttattcaaacacgacaatatgtggaagtaccttggattgatggttcctgatgagctgagcagcatcgaattcatccagcacgtcctcaacgtcgtaggcgacggacttaactttggagagccaccgccgtgccactgctccatcttttcctacttggcgcaccttatcgtcagcatcttgcatcacagcaaccagatctctcatcttctccttcatgtcattcacatcatccttgaacctccacagcagagtggcctcctccactgcgaggtcgccaagcttgctggcgacccgtctcgccacggaactcacaatcatctctccaaccccgctcatggcctcgaagctaccagccagctagagcacaaactccctatctctcccacaagagtatatgctgccaatttgtttgtgaaagctctcttcccacaagtgcactccgtctctttgctttagggaagaccctaccacagtccaccatgagcaaagttattccatgcgacggcatgctccacctacatgtcgcttgcatgagcaaagttattctatttgcccaccaaatagattttaaaatttttagtgcgttttccttaatgaaatttggtcgaccgaacctttcggccgacccggcaaaaaattttttagtgcgcacactttgcattgacacctgatgtgctgagtaggcagtttcagtgcttgctatatcgtctaaaggcaaaatgcactgattctgataaagcattaagatttgcaagtatcagcattttgatgaaaggaattcatagtttagtccatggcatagtgcgcttggtaggtggtgcgtggtggccttcctggagaggatacatatttaatattttacagaaaaggttaaagcgatggagtccaaattaattggaagataaaattaaaatgatttgcaatagccaaacaatggtgaaacctgggtaatctgtcaacaagaagaaatgactatggagacttatccaacaacttgccttagattgaatccttttcaagccttacaagacatccattttggaaggatttacccggcccgtgcgtgaggatgaggaccacacactattcagaattactcctccggatggaatgggactgactgaggaacagccagcaagaaggcaagaatcagggtcgcaactcgcaagatgagattatttccaattttttgagttgtgttagaggaattcgtttcaatcccaaatgttgaaccggatatacatatttatagagagagagagcttaccgattccaacaccaggaaatcgaggcgccgccagccactgcacttccgcctgtggatagaagggctcaaggtgctcggctcgatccatcgttctgcagagggagaacccgctcgaccgcctcctccaaccccttcaccgcctcgccgccggtgtgttcgctccgcccttatggccgacacggggtgaggagagcatctgcgccgccgccgcctctgtcctcttgggctcacccccaactagacgagatcttcagccgacggcccacctaaacacctcctcttaggcccaaaatggtcgtaggccgagtggcccacataggccaagtggcccatggcgcgtacagacgaaaacgaggcggacccgtggttttggtacactgatctttttgaagaaaaaatttgctacactttataaatcaaataaggtcaacccgccttgcatgttgcaaacgtgccggttgtcatttgtcaactgacgcgaccagccctaagtttgcacatatcaattatcaaaaagcggattgtagatcgaaactcctaagttcctagcgttgataaggtaatggcgatgcctggacgacttaatccgtacttctgtttatttagcccactgtgatacatctcattaattaattcattcattcagtcaaatcagtcccaacattgtaagatcgtcaagctagcgccaactggtcacggcgacaagcgagaatgagaactgtagacaaattaactgtagtatattgacgtcgcgaataaaaagaattgttaggcatatatatgatcggttcatccatcctgatcacaaagagcgagatagtttaatttgtctcgaggttgaagttgccacaaggggctggtttggtttgttgcctaaattagcctcaccaatatttggcaatttcaatagtgtttagtgtctatttggtttgaagtcaaattttagcatgtctaagaaaataggccatttcaatagtgaacttatgctattttgacttcaatccaaatacaattttaccttaccaaaattagtcatgtcaaaacttgtcaaaatttggcattgacaaaatttggtaagacctatttagaccacaaaccaaaccaacccaagatatcctgatgaaccaaagggtgccactgactgaaccagcttagtagtctggacgcggcctcatcgaacagcaacaagttacgttgtacgttctccatctggaacgcccgcacggtcaccgcgctcatcgtcgctgcccaaccacagtcgacgaacgccaagcacgccgtgtcgctctcgccacctgcgctagcgagttggacccgattgataggaaacgataggcaaataaacataaaaaacaatagaggagagaaaaaatcactgacaccagccaataaaatatcttcactgtatcggggtaaagttacaacaccgaatggcggcttataagaggtatatacatgaaggtgaaaccctaaaggataacgatccataccgcgggggcgcttcgctccagcagaaactgatatttattatgtgcaaatgaactttggttcacaactcaacaccgatcgatcatcatccagttccccgccgccgcctccgcgtgtcatgggcgcaggtgaatcctccaacgggctcacgctcggcatgcacggtatcgatcctcggtggcgtcgccttccttggcgtcgcaggacggtgcagtgtagggcgcgcgcggccacgtcgagtcatgacatgagcacgccgacgcctggagggaggcggccggacttcttcttggttgacggagatgccccggaggtagatgctgttcgtcgaggggttcattggtcctgaccttggtcgttgtaggagaggatgctgctcacgtcggacggcgtcggcggacagcggcatcagattgtacggcccactcccgaagaaggacacgccacgccggacgtggcgcctgtgacggcgaactgccgcttgagcgacagcttcgagtaccacggccgaggccagaggacgcccctgacggagcttccagcctctgatagatgctagtactcgattagcttactgtcgattcaaaatgcggtagcgtacgtaccaaccagcaagtgaaaaatgtaatagacagatgggagtggagacttagtataccttgaaggtgaaataatattcagaagttgttggaattgactgatttagaattttgcttcgtccctccttttttgctctctacacattctgtcctgggcaaaagaccgcttgatctatggttcactctgccttgattcgctctgcaaaagtatagcatattagccaaaccttgcttgtgctgaaaatatcacaagatgaaaacaaaaacagacaagttaagaaacgtgtacagctaggtgaggactgaggaatcgattaacatcagtaatataaaatattcgttcataaagcagcaatcaaatacagtgtgacaggtttagagcacactcagttggaaattggagagctcaactaattgcaaaacgttgagggatgacgtgagaacaaataccagacaagacaaatattatttgcatcattgaatttctagatcaaaatataatgttgaagcaaatgcaaacgttaatagatgaatgaaaagaatagttattactcatatacctctcatccatcgattgcttgtcccggtataaatatttcaccatctaacataatctttgggatgcgagatatcttgttagcatcctccctttggcaccattcagccagtcttggacaaaaataaatatataataattctaaggtggtaatgttccatatgctctctggcaaagatgtcaagttgggggaatcgaagatgctaatttctttcagataaatgaactgccctatccattccggaaggctattgaacccttccaaccatagttcttcaagagcagtaagattcttcatgctttcaggcaaatatgtcaaattgggagaactttggatatcaaggcattttagggcagtgagatgtccaagcaattctggcaggaaagtcagcatggggcaatcgttaatgacaaaccttttcagtggaatgtgcagccccaacccttctggcagtatctctaatcctttgcatccatccaaacgcaactctgttatagcggttaggttcttcatactactaggcagaaaagtcaacttagggcaatcgatgatgataaactcctctagggaaacgagcatccctaaccattctggcaatatctccagccctttgcatccatccaacagcagccttatcagagcggttaggttcttcatgctttcaggcagaaaagtcaattttgggcaatccatgatgataaacttctctaggcaaatgagcagtcccagcccttctggcaatatctctagtcctttgcatccatccaaccacagctctataagagcggttaggttcttcatactttcaggcagaaaagtcaacttggggcaattgttgatgataaacttctcaagggaaataagcagccccaacccttctggcagtatctctagccctttgcatccatccaaccgcagttctataagagcggttaggttcttcatgctttcaggtagaaaagtcagcttggggcaatcgatgaggacaaacttttccagagaaatgagcatccccagcccttctggcagtatctctagctctttgcatccatacaaatacaacactttcatagcagttaggttcttcatactttcaggcagaaaagttagcatagggtaattgttgatgacaatttttttcagagaaatgagcagccctaaccattttggtagtgtctccagccgtttacagccatccaaccgcagctctatcagagcggctagtttcttcatgctttcaggtagataagtcagcttgggacaattgctgatgacaaactttttcagagaaatgagtagccccagcccttctggtagtgtctctagccctttgcatccatccaaatgcagctctatcaatgcggttaggttcttcatgctttcaggcagaaaagtcagcttggggcaatccatgatgataaacttctccaaggaaataagccggcccatcccttcaggaagtgtctccagccctttgcatccccgcaacaacagttccctcagagaggtaaggttttgtaagcttgtaggcagagtagtcaacacagggcaattgatgaattcaatgacttctaggcaaatgagctgccccagccattcgggcaatatttccaagttctcccacgagcacaaatatagctctctgagggagacgaagctttgaaggatgtctggaaaggtcctcagcccactgcaaccttcaacttgaaaaatctcaatggtggcaagatgttgaaatcttacccacatgtcagggggatatttgcagttgttgatgaccacacgaaaaggaagagtggaagatgcaaggctcccaaaccctcgttctggcaacaccttatcgctattgtccaatgaccagtgcatacttctagggggatacgggaggaaactcaactttgggcagtcaactgccttcaaaaaatgcaaattagggattaagaactctctatcttcttcacccgaccgcgttgtccaccattcttcgaagttatccattcgttctaaccaaataattcttaatttcttgcaattcccttccccatcgtagaattctctgccaatttttctaatggtgggcatattcttcatacaaaaaaatctcagggtttggcaaccgtccaaatgcaggaagagaatcacatgttgctaaattagaaagacataagtaaatgagacaagggaggtaggaggagatgccagacacccagttagggaaatccttgcacatgtacccatccaacataaaactttcaagagttcgaggaggtaataggttctcaagcacctcttcatccttgtccacatttctcgtgccaccaagtccccatgacaaagttagttcccgaaggtcagtcatatcacgcaacttagcttcccttgcattgtccagccgctcaacattttcaagatgttgaattcccagtgcacgacaacttagtttcccaagctccactatactgcaacactctccattttctatctcatgtacatcatgttcttcacggccaggtaaatttagacactctttaatggaccaagccttatcaagcacaccttttgttcctgaaataacatcaagcagcgtgaggctagccatgtcgctgatactatctggcatgtctcgcagactataacaacaagtaaggttcaagacttgaagttgaaggtcaccaaacaaagacggaagatgttcaatccttatacaatatgacaaattgagatgcttcaacttaaatatgttgcataatgattggggtaatgactgtagcttagaacagcttgtgaggttcaaaaactggagctcagaaaggtccccgaagcattcagggagttgtttgaggccatggcagtctgaaagattgaggtctttcaaatgtttaagttggcagaaggattctggtaacactggaatcttgtagcaatcagacaggtccaaaacctctagtctataaagaatcccaaaatcttctggtaggttttctagctcatggcaatctgaaaggattagatgctcaagagactcaaggttaaaattgcctggtagtttggttagctttgaacaacttgtcaagtttacaaatgagagcttagaaaggctgccaaattcatcagggagattttgaagagcacaacaacctgacatgtctagttgttctaagcatttaaggttgtggattgattcaggcaattcttcaagtttagtacacccagataggctgaggagagaaagtttgagaaggtttccaaatgatgtcggaagtttactgaggtcactattccctgataagtctagataacaaagcttgtgtaggttaccaatattagcaggcaaggtttcaagagagcaattggatagaattagagtttgcatattctgaaacatatgcaaatatttaggaagtgctgcaattggcaagcctgagacatcaagataagctagcagcatcagttgacgaatggaggatggcaacgccatactaacagggatagattgcccttcagacgaacatccgctcaggtccaagatccgtatatactttgacccagagaatgcctttcggggaagttgcgatccaatgcactccctaaaatgaatggttctaaccttgcttggtagatctttgaaaaacttgggttgcttctggtagttgaccaactgtgcatgtcggcaataacgcttattattagctttgctccatgtatttggcatggtagcgtccatgacaaggaattcatcaggagcaattattgttgcgagatcatgcactaaatcatgcatggtgagcttgcgtggagctttggtgtgcattggactaacctgcagggaaagctactatcaaaatttaaaacggtgctgcaaaatacaatgtaaatagtgttttgccatgtacaagctgcttaagttgttttttccctttttcattgcctactaccaaaactgaactacaacattatgtaccttttctaaccttcttaattaaatcagcagatgccacatttcctttcaaaaataaattgtaaatcccacaaaattagtaggtataattaatttcagcagcagtgattaatctatatatcttataaagtcgatctcaactaattgttgtgtattgctaattctctcttcccccagaaccacaccatcttaattatttctaggctacatatggttgatcgaaggtgtaggttagatgcagccttatctttaatgaagtcacactgtttaaattatttctagaattagtaagttgttttaaggtataaattgtataaagccatgaacccaagcatttagatggttgatctaattgtaggtttgaatgccctaaactacggaactgcttatttttaccctcaactttgaatactagacaaataatgaaaaaccagacagagtggcaaaaaaacacacaccacaaaaagtagcagaaacaaaatgcgcaaaaggaataattaaaaaaacaatgttgcacttattttgatgagatgaacagatatttcgtctatataatgaaatatatcttttgtagtgtaaatctacaaaaacaatggactaccctaaactaaataaggtgtgtaacctatcaaactgaagcattgtattgaatatatcattttaaacgtattaaatttaaaaataagtatttaatttggaactgaaaatgcagatgttgaaacattaacttgtgggttttaaattaaaagctacaagaaaagaaagattattggactggattaggatactctagcataaattatttatgttacttattaaggttaatactctagaggaagcatatgtataaatttatcttactagcaaagcatatcctagtgagcatatgatgcatcaatatccagacatgaaccgtagaaaggtgttctatgatacttaccatggaagacttggaaatctgaagaaaggacatccgcaaaagatagttgacacacctttgaccattatctcgtgcttcaatgtatccaagggctatccattgctggatcaagcgatcagtgtccatgacgaaacccttcgaaaaggctgccaaatatgtaaagcacattttgaattctcgcttcatatagtaatagctcaacattaggcgctctatagtgtcttgctgatgatctgctttgaaatccaaaacaatctttctatcccttatatctgtccatgcctcaaccgtcctatgttcagacattacttgcccgagagcatttgccaccagtggtagtcctccacacttctcggcaatttgccttccaatttcctctaagccattttggccatcatcaggcccaaatactctccgcttcatgacgctccagcagtcgtaaggtgataaaacacccaaattgatatgatcaggctcaggcaccggacatactttccgttcatttgcaagataaccagtgtatagtacttgcactacgcttccactacgtgtagttgctataatcttgctaccctttccgccatgttgtaacatctgcttcaacttttccaaattttctccatattcttcccagagatcatctagaacaatcaagtatcttctgttggcaagttcttttttcagattattgtttacaaactgcaagttgcagttgtccaggttgatacttctgtttgctcctctgatgatagccttcccaattttgagcaggtcaaactccttggaaacatagacccagattcgcaaatcaaagacattgacccttttgtctgcaaaaactgcttgggctaaggtagtcttccctagtccaccaagcccaacaattgggatgattgagatatcctccttagcttcagtgttcaacagaaggttgattattttttttgtttcggcatccctccctagcattccaatgtccacgtcaccatcatctgcaaaagtttcattgtctctactcccttctgccactagttcacgatgcacatgatgaagcttaatgctatccttttttattgagactattttctccctcgagttcttcatgttgcgggctatggtcatcttccggagaagcggattgttccgggaaaggaataacttgagctgaaaaataaaaatgaagtcaatatcatccgctatgttaattttcttttgtatacccacgatagtatctgatagtctggtatggaacgggaattgacagtctaatagcaaacttctagagaagtgtttatagtggaaaagacaactttgctttttaattttagaaattaattggtttggcacaatgctaaaatattccacaatgaaagtcaggcatgtacagcaagtaaattgatccataaagatgaatcatagaacttttattcaaaacaccaatatgtggaagtggaagtgagtaccttgggttgatggttcttgatgagctgagcagcatcgagctcatccagcacgtcctcaacgtcgtaggcgacggacttgagtttgttgagccaccgccgttccgcctctccatcttttcctccctggcgtgctttgccatcaacatcttgtatcacagcctccagatctctcatcttctcctccatgtcgtccacgtcgtccttgaatctccacagcagagtggcctcctccaccacaagctcgctgagcctgctggcgacccgattcgccacggaactcgcaatcatccctccaatcccgctcatggatggtatggcagattcacagtgaactctatcaacaggaatatggctttgtgaaatagaagcaagatgtagatcgggaggggaagcagccacacatatactagtagtataccacatggcacagttcacgtagtttagtccatggcatagtgcgcttggtaggtggtgcgtggtggccttcctggagaggatacatatttaatattttacagaaaaggttaaagcgatgcagtccaaattaattggaagataaaattaaaatgatttgcaatagccaaacaatggtgaaacctgggtaatctgtcaacaagaagaaatgactatggagacttatccaacaacttgccttagatgcgcaagctaccagacagctagcacatgcgcaagctctctctctctctctcccacaggaatgtatgctgcctgtttgtttgtgaaagctctctacccacaagtgcacttcgtctctttgttttgtggaggaccctaccacagtccacaactgcatgtccatgagagtttttccttgcgattggcatgctccaccaatatgtcgcttgctttacccgtttgcccgccaaatagatttttagtggcacaatttgcatctctttgtttcttgacctgtagcctttttgcatcgacacctgatgtgcagtgcagtgtagacaattcagtgcttgctatatcgtctaaaggcaaaacacatcgattctgagaaagcattacgatttgcaagcatcatccctttgaagaaagaagtattgttgagaccatggcttggcacgcttggtggatggtgggtggcggccttcctggcactgagagtaagagaaaacagtaaaaatcaattcgaagatgaatgaaaaacggaagtgaaaccgggataaagatgggggaagagactagtccagcgacaacttagcattcaatctgcatcttttagtctttacaagacatcaatttgggaaggatctaacaggcctacagtacgtgtgaagatgcaggatcaccacacacgatccagaattattattccagatggacaacggcttgttggaatgtggtggaggaagagccagcagcaaaggccgcggaatcacttccaacttttgggttgcaactgcaaggaggggattcgttccaatctcaaacagtgaaccagatagagaaagagagagagagcttaccaacaccaggagaggcgccgccgctgcacttccgcctgtaccgagccgacccgagccgcgggacacaggggcgcatggtgctcgactcgatccatcgatccggccgccgccgctcgaacggacgccgcctccagcccccttcaccacctcgccgccggtggcttcgctccgccccccgtggctggactcacgggatcgtctgcgccgccgctgccctgaagccaccacagcccatcaagctttcgagctgggccttcggctcacacgcagcctagtccaagcaaacatatgctgctctaaggcccaaagagttgtagcccaagcagcccaaaattatgtcgctcgagctatcaacagtactacacactaatataagggtgcaagtggggaagccgcttatagacaaaattagtgcataaaccgcaggtttgactcacatgttatatatattaacttgatctataaatatgtttataaatcgacccacttgcatatctagatgcggcaagttaggccacgacacaaaaacccatgaattatcatttatttgacctaggagtgaattcgcgagtcggcccgcttgcatccctacactaatatgctcccatggtgattacagacaagatgtcctgactcttagcatgccactcaaatggttaaaaaaaattaaaaaaaaaaagatgtattaacatatgatgtatcatttcacaaatattcaagttgaaatacaatttatataagttgcacaaaaaataaattaaactacagctagttaacgtatatttatagtcaaatttatttttttttattttatggttaaatttcgccttgcatgtttgtggattgatctatcacatattaagttatcttattgttttttaaaaaaatttataaccatttgagtgacatgcaaaacctaatttttagagtttaaaatagttttcctttacagtacaggcgaggcgagacggactgacgatcgaagccgtggttttgctacgccgatggtgctaattaactggtcacgactcacgaggataaccgtgtacctgtggtcaactgaaccagccagcccgaagtttacacacgaatcaaagcggagatcctaggttcctagtgttgatcatctactgtttgcagctgggttttggtttgatccatggttttgttatgttcagtccaccttgagatacatctcatcaaattagcacgacatttactacgtgtataggtcaacgcttaaccctgctaaatcgctatacaaatacacggaaaagagaccatcttatctcagcgtctctcttcatcctaatcacctcgatcattcgctacgtttttgcttgttcagagcaacgcatcgcatcatgcctcgtccacctgaacctgtgcacgtgctgcttcttgctgccatcgcagtgcaagtgttcgtccggtgcacagcacaagctgcgagtgatcagaagccactagtctccaggctcgccaaggattacaacacctcactctacaccatctccgtcaagaacggcgcgccgccgctcgtcgtcgacctcgccggcgcgctcgtctggtcgacgtgcccgtccacgcactccacggtgccatgccagtccgccgcgtgcgacgcggtcaaccggcagcagcctcgccgctgccggtacgtcgacggcggctggttctgggccggccgcgaaccggggtcgcgctgcgcctgcaccgcccacccgttcaatccggtcaccggcgagtgctccaccggcgatctgacgacattcaccatgtcggcgaacacgaccaacggcaccgacctgctgtacccggagtcgttcaccgccgtcggcgcgtgcgcgccggagcggctgctggcgtcgccgtcgctgccgcaggcggccgccggcgtcgcggggttctccgggacgacgccgctctcgctgccgtcgcagctcgccgcgcagcgccggttcggcagcacgttcgccctgtgcctgccggtgttcgcgacgttcggcgacacgccggtgtacctgcccaactacaacccgtacgggcccttcgactacaccaagatgctccggcgaaccccgttcctgacgaacccgaggaggaacggcggttactacctccccgtaaaacgcatctccgtgtcgtggcgcgggcccggcgacgtcccggtgtccctgcccgccggcgcgctcgacctcaacgcccgcacgggccgcggcggcgtcgtgctcagcaccacgacgccgtacgcgatcatgcgcaccgacgtgttccgcgccttcggcaaggcgttcgacacagtcgtgaccaggtacagcatccgacacgagacaaacttacgccataaccaatgtttgatctctagctgattacttcgccacacacggcagaggaacggaaagcagaatggcgagggtggccaggcagaagcagttcgagctttgttacggcggcgcaggcgacaccatgttgtcattccctatgatgaagcggacgggcttcgacgcgccggcgatcaccctggagctggacgccggagccacgggtaactggacgatactgaacggcaactacctggtacgcgagacgtgcgttggggtcgtggagatggggccggaaggcatgccggtggacggcgagccggcggtggtgctcggcgggatgcagttggagaacatcctgatggtgttcgatctggacaaacgcacgctcggcttcagcaggctattggaatgggacctgacgaattgttacagcagcgcaagctttttgtgaggaaataactttatcgtgtctcaggcgttttccaatttccagtgcttgtagtcattgtactcaaacttgagtagtatacattggaacagaataagctgtcacgtaccagccttgatgaatcctgcagggatgaaacttttgttgctgaagctcaaaattcaaaagtaatcgatctaaacttgttcaatcacgatgtctggattctctgtttgtgtgtgtgtgtgtgtgtgtgtgtgtccaagctcaccggatgacgggattagtatagcccaaaggaatcctggagtgaccaagcagcccagccatagacattggtactacaagaactgggtcaaataccggcgatggggctcggcaagcagccgggagaagatatgctggtgtttgaactggaatcagtgcgctgatgaactttcccttggctggctgtgtagttcctgcttgaaccgggcggttgtgacatgtgagattgcagaaatgtttgtcaccaatcaccagtggatgtctatggtataaatgattttcttaagtaattttcagaaacttgcaattatttgaacaaaactatcgctttgctactactttagctttttatttgagaaaaatgcaacaacagtaataataataataaagtgcaactttacccctatgtgcctactacatgtggacccaactttaaacaacacgagtatagcaaattctatgacatatggggctcaaatttgtaagacatttaaaagttgcagctttccgataatatcgttactatatttttgagaactgttgttgaggttctctaaaataacaggaaactaatagctttgataaaatagctattaatatatgatatatcactccacaaatatgtatgtttaaattcaacttatacaattagaaacaaaaacaataaatttgacattgaatagaacgtataatttgcggttaagtttgttattttttgtttcgaattgtataagttaaattttaacttacatggttgtggaatgatatatcatatattgatctatcttaacaattttttttaaaaaaaattgatgattttttaaatgccatgcaaaaaataaggggatgtcacctccctcgagataaaaatccatctcccgttctctgaatctttgattgtttgtttttttttttttttgcagaaatttcaagctcgttactacttgatgatacgtgaaacttaaaacttgatacatgccggaacaaagcaccttgaaaccttttccgtactttgaaccatctccgtacatacttgtaaagtttctggttgttgtttagaaacctggaatcaaaagaacatcagaaagcattcgtacaccgggagaaagtgacccatagacgatgcttcacccacctctaaaatcctatgtacttaacatctcttataatcatgtcagacaacccttaattaatacttccttcggaacattgttttgagatggttcagacttcagagaataatccagcccgatgtttagactccagagccaagccggattgtcagagaaatcctgcgggcatttcccctaccattatttgatctcatatttcacctagaaatacagctaagtgatccttatctaggttccttgacttctaaaatttaggttgtcaatgctaatcaacagtgtattgatacacatttaaaaggatatcgatcgtcaactcctcgacatgataaaccggtgacatcttgaccctaaataactgatcaaaaacgaatcgaataactccacaggtactacatatacatgccatttctgtccacatccaatcaccttcaaaatccatcagattatctgaaattctgatagacaacatggctaaccctcctatcaagtgcttgctccctcctgcaatcgtgtcactagttctgctgatctcatgcatggtggcaaccggtgagcagcaagcaccgtacaaacccctcgtcgtcccgctcgtcagggacagcgacacatccttctacaccatccccatcaagaacggcgcgccgctcgtcgtcgacctcgccggcacgctcgtctggtcgacgtgcccgtcgacgcacaccacggtgtcgtgcctgtccggcacgtgcggcgcagccaaccagcagcagccgcgtcgctgccggtacgtcgatggcggctggttctggtcaggccgcgaggcggggtcgcgctgcgcctgcaccgcccacccgttcaacccggtcaccggcgagtgctccaccggcgatctgacgacattcgccatgtcggctaactccaccgtcaacggcaccagaacgctgcacccggaggagttcgccgccgtcggctcgtgcgcgccgcagcgcctgctggcgtcgctccccgcgggtgccaccggcgtcgcggggttctcccggcggccgctctcgctgccgtcgcagctcgccgcgcagcgcaacttcggcaacaagttcgccctgtgcatgtcccagttcgcgacgtt

SEQ ID NO: 3097 - DNA, 12310 bp, Oryza sativa
  unsure (1)..(12310): unsure at all n locations
nnnnnnnnnnnnnnnnnnnnnnnnnnnnnnnnnnnnnnnnnnnnnnnnnnnnnnnnnnnnnncgaatccaagaatccccggctactacctccccgtcaaaggcatctccgtgtcatggagcgttcccgagacgccggcgtcgctgcccgccggcgcgctcgacctggacgcccgcactggccgcggcggcgtggtgctgagcacgacgacgccgtacacggtcatgcggcccgacgtgttccgcgcgttcgcggaggcgttcgacaccgccataatcaggaggagcaagtacacgtactccaacgtgacgcgccacccgcccgtgggacccttcaagctgtgctacaacggcgcgttcccgatgctgaagcggccggcgagcatggacattccgacgatccacctggagctggacggcgccacgggcacctggtcgtggttcaacgacaactacctggtgtttgcgccgggggcggcgttgtgcgtcggggttctcgagatgggtcccggcggcatgccggtggacggcgagccggcgatggtggtcggcgtgaagcagctggattggaacctgctggtgttcgatctggacaaaatgctgatgtggttcagtggggatctggcctttcgcttggcgggttgttcatattcttctcaaatcgggttataagatcgacctgatcagtgatcagtcactccgtcacggcctgaacgacgagttgtatgcttcagttcagaaactagtgttgaataagaatccgacagacttgatagtgcttcattatcgaagtgctacgaattgttttgctgggcatagtgatatcttggaaactaccattttacttaatcatgagtaaaaattttggggctgctatataccggtataccgttcggacagtataggcctataagcaatttagccggacaattccttccgttcaattagtatgtcagttatcgtgtctcaaaaggtgtgtcatgtcaccccatcgtttgtcattctgtccacgtgcatacgcaaaaaatcttcatgtgatagctaaactagttcagtatagcaagtagtagcctacctagctaccaggtgtcaaatctgatactaggtaggtatcacatctgataccgggtgagcatcaattctattatcaggtatcacgtctgataccgagtgggtgccatgcctcataacaggcatcacacatgtctgatatcgagtgggtgccatgcctcataacaagcatcgtgtgtgatatcggttggtatcaagtaccatataactggatggccaagtatcatatttgatacatggtgggatcggtcttgataaatgatacctggtggttatcaagtcctgatatctaaccggtatcatgtgtttctgccacgtatcaggtgatacttgcgaggtatcagatgatacctatcaggcatcatgcgattcttaccacgtggtgggtgatgcttgcgatgtatcaggtcctgatacctagccggtatcgggtgacacctatcaggtatcatgcgattctaccatgtatcaggtgatacttgtgatgtatcagatgatacctatcaggtatcatgtgattcttaccacgtggtgggtgatgcttgcgatgtatcaggtcctgatacttatcaggtatcatgcgattataccacgtatcaggtgatacttgcgaggtatcagatgatacctatgaggtatcatgcgattcttaccacgtggtcggtgatgcttgcgatgtatcaggtcctgatacctagccgatatcgggtgatacctatcaggtattatgcgattcttatcacgtggtgggtgatgcttgcgatgtatcacgtcctgatacctagccggtatcgggtgatatctatcaggtatcatgcgattctaccacgtatcagatgatacttgtgaggtatcagatggtacctatcatgtatcatgcgatttttaccacgtagagggtgatacttgcgaagtatcaggtcctgatacctaaccggtatcgggtgatacctatcaggtatcatgcgattctaccacgtatcaggtgatacctatcagatatcatgcgattcttatcacgtagaaggtgatacatacgaggtatcagacgatacctaccagatatcaggagccgggcactaaagcatcgtcgccgatggtcctaccgtccacgtcccgagccggagctcgtcgccggcggccacatcttccaccgtccgtgccatgtcggagctcgtcgccggcggccgcgtcctccatcatccacgccccacgccggagctcgtcgccgacggccgcatcctccaccgtcgatgccacgtcggagcttgtcactggtggccgcgtccttcgtcatccacatcccacgacggagctcgtcgccgacggtcgtgtccttcgtcatccatgtcccacgccggagctcgtcgccgatagcagcatcctccaccgtccacgccacgtcggagcttgtcacgggcggccgcttcctccgccgcctcgacgagctagccaagtacgtgctcgtcgtgctccacgccaacgacgcggcgagggcagcaccttcgcgctctacttcctcatctgtctttgcgtccgcgctgggctcctcctcccctgcgccggtgacggcgctgccggcaaggagctcgcggtcgcgcgcggggtagtgcgtcgacggtgcgggcatgggcgccgtagcgccgcggcccatgtcagccatgcgtacgtgctggagcggcactgtgccctgtacaggctgctgctgctgctcgggacgtgcatggtcaggtatcgttcctctttgaattagcaagggtcccgtccggacgggattccggtatgtagcattcccgaaaattttactgattttacttttggtgatgtggataaattttaaacgtccaattttaaatcaataaggtagttttaagttttctttacatatgtggtttctactacatattttccttgtatactaggaaatggatgttaaacttagcctaccctgtatatttcgtccaaaacgctacctattgagcgcctgatggataagaaaatattgagcatttgttccacatatcccgtgaccccctctctctcgtctctctcccacgcaagtcctcaacggcggactgagagacactactcatctcctttgtgtcgtcgagcaacgcccctgttggattggggggtgggggagggggcgtcctagcttcccgtgcagctcccggcaagatcctacggacattggcatgggcagaagcagcaagaacacaatggtccctacaagaatctggaagtagcgtgcctcctgtttgtcggcgacgatggggtgacgagggcttgggcagcagcagctacccgcctcggtggagtagaagggcactatgacatcttggtgtggatttgcaacagagaccaaaggagccaacgatcaccaaagaggaggaagaaaccagagttggaccaatacattttcatgattttttttgatgttccagccaatatatttggatgtttctgttataaaaccggcccgaaatcacatcggaaaccaaacgcggaagaaacgtcatagaagatccaaacacgatgacgacaccgaggcacgatatttgataacggagttcagccaaggcctacatctccggggcactgattacgggcgctcctccctgatccagcatatacaacgtatcagagttacaacgactcacggccggtcgatgccggcagccgctccctctcgctatgctaagtcgccatacggttacaacaggcacgcccctctatttatgagagaatctaggatagagtcgacttatactctagtcctacacctagtacaactccaagtcctaaactgtaaccgactacgtacacatattcgacacaaactctaacaaactccaccttggcgaatatgtcacgccaatccgaatctgttacttgctcgaaccttcgtgtaccaagacttgagttgatcctttttcgccgctcacgccgagctgccccgacaagcctccatcaggctcaccgtaaacaagagactcccgctatccttgtaatttcttcctcctgactccacctgcaacattgctccaccttctctcatatcaccacagtcatcttgccaagtgaattgaattcttcctagctgtcacatcatagactctccgaagaccatgttcaacttcatctaccgtcttaaatttgacttgatctaatccatggccagataaccgatgtcatcaccaaatagataaatcaaactcaccagacttgaagagaaccctttcttccttgtcgtcttatgaaccgagctaattaataaatccaacatccacgctttcccgcatccttagactgagttgtatgcttcagttcagaaccagtgttgaataagcttccggcagtcttgacagtgcttcattatcgaagtgctacgaattgttttactgggcatagagatatcatggaaagtggaaactaccattttactcaatcatgagtaaaaattttactaattttactattgtggataaattttagacgtccaattcttaatcgaatagtagttttcaagattttattacatatgtggtttccactacatattttccctgtatgtactactaggaaatggatgttaaactcggtctaccccgtatgtttcctcaaaaacgctacccatcgagcatccgatggataagaaaatactgggcattcgttccacatatcctgtgaccccttctctcatttctctcccacgcaagttctcaacggttgtcggagagatgctgctcatctccttcgtgtcgtcgagtcatggctgctgcgagcagcgcccctgttggattggggggggggggggcatccttcccgtgcagctcccggccagattctgcagacatcggcatgggcggaacctgtaggaagacagtgatccctacatgaatctgtaagtggcgcggctcatgttcgttggcgacgatggggtgacgaaggcttgggcagcagcagctacccgcctcagtggagtagaagggcattgcagcatcttggtgtggatttgcaacagagaccggaggagccaaccaccatcggagaggaggaagaaaccagatctagaccagtacattttcatgattttttatgttacagccaatatatttggatgtgtcttgggggttgaatctgtgatggatacttagatggtgtttcatatttctactttcgatttctttcatatttgtgatgtttcagcgggttgaagcttgacgtttcatccatgaaaacaaaatgtttcaatggtgtttcaactatgtttcacgatttttgtaggctgacaaattttctatttagtagtgaaacattttttttctagttgcagtgaaacatcgctcgatttttgcgctcactttgtagtcgccttcatgttttgtacttttgttgccccaaagcaaacatcctgctaggccagaaaagcttattttaggctccgtttgggaaactcaagattccgagaaactagtcggtgagaatttgtaaaaatcgggtttcttagccacttacccttgctgcactatataacgggagaaagtcgtcatataggatgtttctccatatttataaagtcctactctatataatctatctcttataatcgttcaatgtcagacaaccgtacgtgcccttgattagtgcttgctcggaccatgggtatgagatggtttcatcagggcataatccagcccaatgtttataacctaagactccagaaccgagccggattgtcttggatcgatccaaacgggcaattttcccttaccattgatctcgtgtgatgcgtaattgtgtactactgcagatagacatacagccagatccttaccagggttccctgacttaaaatccaaactgtgggtgctaatcaacagtgtacagtacagtactcgctcttatattcatttaaaaggccatcgtcaactccttgatatgcatgatggatcggtggcatcttgaccctacaaatattgaccaaaaactaattgaactactactcctgaagtagcagtacaaatacattcaactatgcccatttctgtcgccagccaatcaccttcccaatatatccatcagattttctgaatacacaacatgcctaacactccagccattgtgtcactggttctgttgctatcatgcttggtggcgaccggtgatcagcatgcaacaccagcagcgtacaagctacccctaatcgtccctctcatcagggacaccaacacctccctctacacgatcgccatcaagaaagacgatgcccctctcgtcgtcgacctcgccggcgctctcgtctggtcgacgtgccggtcgtcgacgcacgccacggtgtcgtgcctgtccggcgcgtgcggcgcggccaaccagcagcagccgcgtcgctgccggtacgtcgacggcggctggttctggtccggccgcgaggcggggtcgcgctgcgcctgcaccgcccacccgttcaacccggtcaccggtgagtgctccaccggcgatctcaccagtttcgccatgtcggctaataccaccagcagcggcaccaaactgctgtgcccggaggcgttcgccaccgtcggcgcgtgcgcgccagagcggctgcttggcgtcgctccccgccggcgccaccggcgtcccggggttctcccggcggccgctctcgctgccgtcgcagctcgccgcgcagcgcagcttcggcaacaagttcgccctgtgcctccccggattcgccgcgttcggcgacacgccggtgtacatcgggacggagagtctaggcatcgtcaactacacggaaagcctcccgtacaccccgctcctgacgaacccaagaaaccccggctactacctccccgtcaaaggcatcacggtgagctggtacgggcggaacgtcccggcgtccctgcaagccggcgcgctcgacatgtacgcccgcacgggccgcggcggcgtcgttctgagcaccacgacgccgtacgccgtcatgcggcccgacgtgttccgcgccttcgccgaggcgttcgacgccgccatacgaggaacggattacgccaaggtggtgcgcgtgccggcggtggagcccttcaagctgtgctacgacggcgcgttcccgttccggaagcggccgccgacgtgggacgttccgacgatcgacctggagctcgccggcgccacgggcatctggaggttgttcaccgagaactacatggtgcagacgccgcgcgggatgtgcgtggggatcctcgagatggaggccggcggcggcatgccggtggacggcgagccggcgatggtgctcgggctgaagcagctggacacgaaccttctggtgttcgacctcgacaagatgttgctgtggttcagcggggagctgtcctttcgcttgacgggctgtgtgtcgcccttttgagcctggttctgaacgtctgacgtcctgaaatggcggtgtttgtttgtttttcttttaaattttgaaatatggaggtgtttgtttcagttttgtacaaatgttgaacaaactctcggcagccttcatagagtttcactgcagcactaaaatgctgttttatcataaagatgtagaaacgaagaaggtgttgacacgtaaaattacagaaggttgctgcctctgtatatctttcgatcacaagaccagacaccagagcagcatcaagttacaaaataaaacactcagctgaataaggttttgcgattgttttttcacttatgactgaaaaaatggccatccgttgaaacggataagatgtttttaatcctttcttttggcccaacccacatgtggagccctccagaagatggtgccgtgcccatgcccttacgatgcttaaactgattctccccatcaaatttggccgagtctttctcgatctcctaaaattggtttagggcttttgatccactcgatcttctctttccgtttttctaaaattggagcgaacaaaactcatgataaaaacggtaaggaagcttgccggccggccatcatcggcgacagttaaatggtgattaaatcaggccaagccgaattgaaggagaaaatcataggaaaaatgatgagcgatgagtggggaatcgatttttgtaatccattggaggaggaaacacatggatagacaaattcgacgtggtgatagaggtagggttcggcctagcgaaggaaaaacacggtgaggaaagaaaaaccgaaaactagaagcccttactgcatgcgagaaaaaaaaggggaggaagaaaatggcaaaaaaaaactggacggaccattaaaaaactgtttgaaaaaaaatgtgagaggaaagcggcgactaaaaaaaatattctagtaggtatatatacattaaatcgactctaacagataacggaccacggaaacatcttcaatctttatctacttatattatatatgatatatgatatctgttaccttctaatgcagattttttttttcaaaaaagcacaatacaaacgcagacaataagaggaaggctactttttaactccacagcgaatagtttaattcagcctacagttaactctcacaacaaagaaacacagttgcatcaccactttgcacgctcgctgcttcctgggctgccgaataagcgatcgagccattttggacctatcttgggccaaattagagcaagtacagtagcaggctataaaccagctgtaaatatattttaagaagataaataaagagagaatggcagcggactacagatttgtagccagctatagcacggactctaagacgcagtgtgtgtatgacaggtgggaccagatattaatagtgtagtatgtaactattgtatgaatgagctattagattggctatagatgaattggatctagtagttggctatactattaaacttgctcttacggtcattccttttccgtagcattggcccaaactttgagcccattaaaaagtcttacatacactaaagcctagccgagaaatacggcagttactactcctggcccagtacgagcgtgccgccatacaacatgtgccttgggcccatgcctcgggcccaccccgaccaaactccaaaacccgagaccaccaccaccactccaaactccactcgctgaactagctctcacatctcacgcaaacacacgcatctacagctactacagtacgccgcgcgccatacaaatcgtcgagcaatccgcctcgctctcgccgcccgcacccacgctcacgcacgctcgcctcaccacccacagcgcacgcggccaccaatggcgagcgcccgcgcgcgcggcgggcgagccttcttcctcctcgtactcgtgctcgtcgtactcgcggcgcccgcggccgcgctgcggacgtcggccatctccgcggcgccggagtacccgcggctccccaccgggccgggccacggcggcgggaggcacgcggcgcccgcgcccgcggcggtcctcccgccggcgccggcgctctcgccggacataatgccgctgctcccgtccccggggcccgactccgacggctccgccgaggcgccgtccgacgtcatgcccaccatcccctccagcccgagcccgcccaaccccgacgcgctcttgccggactccgcgctcgccccgttcggctccgcgcccgccgtcgccgcccagtcccgcgcgccgccgccgtcgacgacgacggcggcggcggcggcgtgggcgctccccgtggccgtggggctagtggccatgtggttggtgtagtgggcgagtggtgcaagcgacagcagctgcagctgcagttgcagccttcgggttcagtcgtgcaggaaaaaaagttggccgttggttggtcggttggctttgtattcttggcagcaaaaattgtgaagaaattgttgcttcatttcactaaatttttttagctttcgatctcctgtaaatttttctgtcaagtttacgtaattgtttctggatgggggcggctacatgctatagttttttttttctttctgttttgtaattgttgttatgaggggattacttggttcattgctgtaataaaatcagagaggataatagtctgttcctatcacttctcactcactgaaacttcagttccaattccctgttcttgtttcatgttcatgttctgcaattctgcatcaacagttgatagttgatacacgagccaattgttcttggtttgatgggcccacaagccagtcacagtggcggtgactctgcttcaagcagtaataatggtatttatgattgttttggtgttcatgttaggagtatttgatgctgattaaaccattcggtgtacaggctagggaattatttattccttctctttccagaactgcgcataacctgaaaaaagtgtggctttatgaattaataaagaacaaggaaaaaatatctaaaagagaacataataattcaccagaaagtgcagtatgcaactggaacgccattcatcgaaattctatattctctctttcctgtttctttaggttgatgatcacctcatgattaccgtaaagcttctggcgttgccactctgccaagaaattagtaactttttaagacatgatcaaactgcaggcatgtgatcttgtagtttaattcatggtaagagaagctcacgtggtctctgaacaatgcatctactaccaaagaacatcgactgttgtttctggaaaccgtctaataaaaaattggaagctcctaatcagactatcagaggatgccgttggaccagcatacttgtcaaggaaatggtttttcttttgcaatttacagtattttaacaaatagtatttgttcttaataattactagcttcctttgctctctcggagaagtttacaagataactgcatgagctaaggttaaactaatcaaagaaaagtttgaagataaggatgagatatgctatgctatgcaaagctggtggtaccaaatcaaggatcagtagaaagaccagctgtgcattgttgtcctgacatatcatggacaaatgacaaagaacaaaaatgtcctactgttctacctattcccatatcactgttccactctcaacctggcaggtcaaaaaagttgtcacccaaagtaataagttcaaatgcgtgattattaccacatttccagaggtccatttgagtctctgaatcagaaacattcagacaacaactctcacaaaatgttctgaatttaaatcaacagagctgatatttagtagtataaaacggcaatgcacgaacatgtgaagtgagaaaggaagctggtgcatagctgcaaacacaaaaagggcatccaatgataggaaaaggacatccgtgagtttgagcatgatcaagatgggatcagtcgaccatgtcttcttagccctgacctgcccagtctcttcacgtgtagtgtccatttgccattcgcctctgttactgtttaccttatgattaatctgccaataagcatctaaactaaatcactcctccggtaattgttaatggagttacagtgtcacgtactatccggctcagcatccaacgcagatgcacagtgaagtttactgctcgatgtcgaggtaaaaacaagactgaacatttgacaagacttttgggtatgagggaagctgagcagaggttcccaagaacaacaaaagagcacgaccggtgtctgaagatgctggaatggtgaaaatggtgatgtgaaagaagcatgtgagcgcgagtgtgtgtctatgagagaagattcgtgtagtgagaagaggccaatggatggagtgttagtattattaagcgaggcttgtcacgtgaatgtcctagctgctcctcatccagagatgggagggatggttggaagaatctccattgtttgcgccgtgtcgtcttggacgtcaggattggatgctgtcctgccaaactttaggggaagagagaagggagtagattaacaacatcattgagggatgaagttagtgtgcttagggggtgtttgggagagaggggctaaactcttaaaaccataagtctctagaggagagacttactccctccgtcccataatagatggtgtttttgactttttatttgtaacgtttgaccatttattttatttgaaaaattagtgcaaatataaaaaaagataagtcatatgtaaaatacttttgataataaagcaattgacaaccaaaataaataataattccaaaattttttgaataggacgaatgatcaaccattgataaata

SEQ ID NO: 3098 - DNA, 25075 bp, Oryza sativa
tgaccatttattttatttgaaaaattagtgcaaatataaaaaaagataagtcatatgtaaaatacttttgataataaagcaattgacaaacaaaataaataataattccaaaattttttgaataggacgaatgatcaaacattgataaataaaaactcaaaaagacaagtaatatgggacgcaggtagtatgttttagcccctctctcccaaacacccccttagttactgtggtgcatggcctagtctagcattaggcaagatactaagcacttgattgagcagtattgatgagactgggatcgctgtatatgtgtagttgggcttagaactttattactcgggcctagggttaattagtctgtttgggttgacatggttacataattggctctgctttcaactaattttacaaatttaagagttgaaaaagggaccacttctatttaagaatttctagggcagggctttcaactgaaaactgaacaagtttagggcccttttaattgcatgattgaaaaaaacgtaggaataggaaaatgcatgactttgatatgaatgtaagtgtaaaacagagtattgcaaaacacaggaataactgtttgattgaaccgtaggaaaaacacagaaattagagaagagataaaaactcaatggaaagtttatatgaggtagaaccttatgttagtttttctccaaaacttggcattaggtatttcataggtttctatagaatttatttatttgattcaaagggctatatagaaaaaattcctataggaatgaaattctctaaaattcatatgagaccttgtttagatcccaaaaaattttggccaaaaacatcacatcaaatgtttagacacatacacggggcattaaatgtgaaaaaaaaccaattgcacagtttgcatgtaaattgcgagacgaatcttttgagcataattacgtcatgatttgacaatgtgatgctacaataaacatttgctaatgactgattaattaggcttaataaattcgtctcgcagtttataggcggaatctataatttgttttgttactagtctacgtttaatacttcaaatgtgtgtccatatacttaaaaactttacccccgaagaactaaacacaccctgaatttcctttgaatcaaaatgggcttaacctgaaactgaccgaaattaatccttctgctgggctttgaaacagctcccagctgggctgaaattgccgtagcccaaatgggcccaaacccttgttgaatgggctcgaacttttgggccgtcgaggcctatgcttctgagttctgaagtttctgaaccgcgcaatcaatcgaaccttctgaagcctgaaaccaacgatgcggtcgcatattcgcattgccgcagctaacgcctagcgccggcggcggactggcggtggatgctacgccggactccccgactgctcgccgccgtgaaccccgccaccgcggttcgctccacagccgcgctcgtccagatcgcctcccctctcgaccccttcctcctccaccaactcacagctcgctttcaccatgcaccggcggatgcccaccacctgctcgacgaaacgccgcgcagagccagctccatcgtgcgcgcgctcggcgcatgcaggggcgcgtcacgcgaggaagcggacggcgtcgcggccctccactgcgcggctctcaagtcgggggccgtgctggatccgcccgtgcgcacgtccgtcatcacggcctactcccgggtgcgcgacgtgtgctccgctctgcaggtgttcgacgaggccgctgcaccggacttgatcctgtggaatgccgcgatcagtgctttgacgttgaactgccgttatggcgatgctgtggtccttttccggtggatggtggacgtgcttggggtgattgattcgacgtcaatggtcattatgctgtcgggggcgtcccgtgcaaggagcttggagcatgggattgcctttcatggaatggcactgaagagatgcctagacactgatctgagcctttggaatactctcatggacatgtatgcaaagtgtggggatttttactcttcggaggttgtgtttcagaggatgccatatagggacactacatcatggaattctatggtaagtggaagcttatttaatggacttgctgagatttcagcatattacttcaaggaaatggtccgttccagttttcaggcagatgaggtgagcctgtcttgtgtcctttcagcttgctctcatctcaaggacctgttctcctttggggagtctgtccatagctctgtgatcaaactcggttacgaagacactaccagttcggtggcaaattccctgataacattctattatgagcttgggtttccagaggctgcagaggaggtatttctaagcacttccaacaaaaatttggtaacatggaatgctatgatcaaggggctggtagagaatgatagagttaatgaagccatgtgtatgttccaagaaatgagatcaaagaaccagccagatgttgccactttagtgactataatttcagcttgtggtgatcatggcctacttcctgaagggaaagaagtccatggatacataataaaaaaaggacatatttacgaggagtgttctgtaggaaatagcttacttgatttgtatatgaaatgcaatgacccatctacagcacgcattttgttcaggacaatgccaatgagagacctgatctcatggaacacaatgatttctggttactcaagaaacgattcacttggagaagaggctaaagctatgttcaaaggactactatctgaaggcctaagctgcaccttgagcactgtggtagctgttataccttcatgtttttgtccacaagaccttaactttggcaagtctgttcactctttcatcctgaagtatgggtttctgactggagtttcagctgctaactctctgatacacatgtatatatgctgtggtgactctctggccgccttttcactgctggaaagcataactcccatatcagatattatttcatggaatacagcaattgtgggctgtgtacaaaatggactctacggagatgcgttagaagcctttcagtttatgcattcaacgttaacactaaatcctgatagcattacattagtcagtgttttatcagtatgtggaaacctgaaactgcagtcccttgggaagtccatccactgcatggcgctaaagcgcttgattgaattcaatttaagggtaaagaatgccctgcttaccatgtacttccgatttggagatactgaaagtgctgagttaattttctctagtctcgttggtagaaatctgtgctcctggaattgcatgatctctggttttgcacagaataacgaaggcttgagggcatttcagttctacaagaagatggaggattttgaacccaatgaaatatctattgtcggcattatctgtgcttgcactcaacttggggatcttaggcaaggaaagaacattcatgggcatgtggtcaggtttggtctgcaaactaacgtttttatttcagcatcacttgttgatatgtatagtaagtgcggaagactggacatttcgatcagagtatttgaatcttctgctgaaaaatcgattgcttgctggaattccatgatatcagcttttggattccatgggcttgggttgaaatcgattgaaattttctggaagatgaataattctggagtgaaagctacaagaagtacttttattgctctgttgtcagcttgcagtcactctggacttactgatgaaggattgaagtactaccatcttatgatagaacattttgggattatcccaaccccagaacaccatgtctgtgttgtagacatgcttgggcgtgctggtcggctgcaggaagcacataagtttgtggagagtttaccatcgaaacaagcacatggagtctggggtgcgctgttaagtgcttgcagcaagaaatctgaactgaagatgtgtgaatccgttgccaagcatttgctctgtctggagcctgaaaatagtggatattatgtgaccatgtctaacctgtatgcgtatcaagacatgtggagtggcgcagtgcaagtcagggacattttgcaagataaaggattgatgaagccccgtggccgcagcatcatcggttaaactgtaagttcaatcaccacagaagctatatatatgtattataggcacaggtcgaaatccccattaatgtgtgaaatgtttttttttctcaagaccccagatacttcttgtttcatgctcgatagaacatggtacaagtattgaatatatgattccgctacagttttttttttcatgatcattttttagccatgcatatatattaactgctgctaaccatgtgtaatttcttctattccttgcaagtcacaaatctaaaaatgtattaagaaaaatgtggagaagggtatacatgcaaatactaaattccatagggatggtataaaaaagtagttataagaggggaataggcaccagatgagcagaagcatggatggatggatggctctgtttgagacacgccaccacccaatcgctctctgcactcccctccccctctgcaccactcaaaccccgacctccctctgcatttcacccctcctctccttccttcctccttggcgctcatccaccaccacctcctccaagagccaccaaacggcagcaggatggccgctgtgatgaaagctctcgccgtcgcctcgccgatctcggcacgagcacagccccgacgatgccccgcaggtatggctctctgtgaagctgcattttaatttcttcgaagtagttattatattcctgggctttgttcttgctttgataggtcagaattgattgtttgaagttatgtttgttttgttgcatcatgcttgttatactttgctaagaatgtaattttccttggattaacatgatataaagctaagttgtttttcttaatgtaatatacctctgtctactgagcacatagctagttagccacatattatttgatcactaaactgtggttcaaggtttcaggccttggatgctcagaaaatggactgtactctcaactctgtagtcgtagagctacacagattacttggcttatatctcacattcatagtagttgacttatctgacgaacttttcttctctgaatgaaagctatgtggaaagaaaaaaacatatgcgtagtataaatttttagtgattactggctcagagatatctggaaaagaattaacctgatacacagaaatcaggattgagacatggaattttcttacatttttgaggactgaaatgaagataaattggtccatacacaatatattttacttgtagcataatcaacacacctttgctcatataaacatcgtgtatcttaatagaaacgtttcagaaaaaaatggcattatctgacctggatgttgagaaatgcagtcagaaacatttttttttactcagagattgtcccattgaaatcacccatattaagcaagaagatccaaaggagctcaacagctcaagcctcaagccatgatcaaacatatctggtgtagcatttgattgttaaacagcaaaataacccatgcaccatgttaatttacctgtgaaactatcaaggtaatactactaaacatcagtctatttactgctatgcattttggcatttttcaggttcgtcaggcggccctagccaaagcctgcattcatcgttcggcggcgtctccctgcagtgccggcgcacgaagccggcgtccctccaccggagtcggccgtcgatgcaggtggtgatgatggcggcgaggccggcgatccagttcatccagggcaccgacgagcagacgatcccggacgtgcggctgaccaagtcccgggacggcaccaacggcgtggccatcttcaccttcgaccagccgtcggtgttcgactcgtcggcagagctcggcgacatcaccggcttctacatgatcgacgacgagggcgtgctccagtcggtggacgtcagcgccaagttcgtcaacggcaagccggcgctcatcgaggccaagtacgtcatgcgcacgccgcgggagtgggacaggttcatgcgattcatggagaggtactcccaggccaacggcctccagttcgtcaagaagtgatcgcctttttttttctccttttttccccctcacactgccttgagcatgtactgtgtgctctttcagtgtaaatacctatgaattctgatcatcataagctcgatacatgatgagttgtttggtgtgtgcattgattgcgtttcttctatgagtgcaattttgtattcgtaaatacccctataagcatttcagagattaatatggagtgaaattactatagtactccctccgtattttaatgtatgacgccgttgacttttcgatcaacgtttgataactcgttttattcaaaattttggtgcaaatatgaaagtatttatatcatacttaaagaacatttgttgatgaatcgagtcacaataaaataaatgataattgtataatttttttgaataagacgaatggtcaaacgttggataaaaagtcaacgacgtcatacattaaaatatggaggtagtagtatctgattagtagaaaacatcatactcagtgcaacactgataaatacaaggaatcataacagatgattggtagtcatccataaatgcttgcaagctgaattccgccgtgctttgttacaggaaaaatacattataatattatttaaaataaataaaaatacattttttaagaatgtgttatccatctttttactatagacatatccatctaaatattttttttaacgaaccggcaaattgccaatcatatccatctaaatatgattttacatgtgactaaccatttagattttattgttttctagtattaataggttcaaagggttatttacaaaatttatcatggtaggtggggtccaccacttttgtaaaggagtataaatttaaacgtgaaatatatttgtgtttgtggataaaggaagtataatttatgagtacggtcagcagctgcctaaatgtcctgtcagtgtcaggtggagttaattaagcaattaaaggagtgagttagcttagctgtgggcttgacaacgaggatcaaacagagacagattggtggtgtctggtgagccggctgtgttatttaggagggttgggacctctccccttctcacggaaacggagtgactgattagtatatgattaattaagtattagtaaaaaaattagaaatagattaatatgattttttaaaacaatttttatataggaactttttgtaaaaaatacaccgtttgatagtttgggaagcgtgtgcgtggagaaagagggaggtgaggttaggaactcgaaggaaagatcacagccctagagcagtattaagttgattcacctggttaattctagcaggtcagcacgggctagtggcttggctgttcctgtcctaaatgggtcgcggcggcagcagacacaacgcatgtggctgcactggaatccagcctagaaatgcacacacacgcacacacactttgccctcttttaacaattgcaatttgctgctgggatctctggctgtgtttagatctaaagtttggatccaaaattcagtcttttttatcacatcacacataacttttcagtcacattacctttaattttaaccaaaatccaaacggctgaagcctccatctctccctccatctgtaataaatgtggtataaatgcttgtcggtttgtacacctgaccgtcctttctctgggtaactttgggttcctgctcttcagtacacactccaatatttgttcagcttctcttgaggaaggagggttcatgttttcgacgaaaacagataaataactgtggaattttgaggtttcaacatgagacaaagtagattccgagtgcaatttcaagtggttttcgagtattcaaaagttgaacattaaatttaactaaaaatttatcaaaatctgattgaaacttggtgaaaaccagggggttgagtttcgacgctcaatcagaaaggtgaaccgagaaaacatgcttagctaggatggtcgaggttctcatctaagattgacactttccagtacttccttcatctcataaaaaaacccaatctagtattggatgtgatacattttagtactatgaatttggatacagctctctccagatttattaatagagtgtgttatatctaattttagattcgtttttttgtgtgactagagtacaatatctaccagctgtgtgattaccgatcagatgagtgagcctgccctatatggcgctgcagttaggagtaatagtacagttattaaaagagtaaagacatctgctttctttctgaaaaggtaatggcctggatggctggattctggagtctgggcatagcagaatgtgtgtcactgtatctgcaggcttcttccctcgcaaagcagaaagttgcaatttggctcattattgctaccaaagcacacaacagaggatgatttgatttgactcgttcggacctggggcaattaatcatagtaatattgcattctgctgaagttaacctgaaggagccgcatataatgctcattagctagggatctgggtaagtcgttaattgcaacgaagtatatacaataaatggataagattacaattctggttcattttttaagtgcctgctaaatccgacaatactactaaacagtgatcagctttgttaaagatcaggaggcataatccaaggagagctttgggtttcagcagtgccccgaatcattcagacacatctggatcatgtttcatggggcacccccatcattaaaagcggatcgagagctaagtagcatagcctcctaatctctgtcctttatctttttctataagagtttttttttcacagtcaagtgatcatgtatcattgcattagtaactttttttttttttgctcatgtgggaagattaataggtaaccacagaatcattgaatagttatatcaatgtaatactccatttcatattacatatcgttttgactttgttattagtcaaacaaattagcgacatctacaacatcaaaccagtttctttaaatgtaaccttgaatgtattttgataatggttaatatgtttgtttgtttaaatattattatatttttttataaatttgatcaaacttaaaagactaggaaaaaataaaaacgatttataatataaaacagatggagtatgattcaatttgaacctggcaatgacaagtcgacaactgtgataagtaggagtagattgttcctactactacgtatactattatatagcatccttgtatatgtttatgcattgattcgcaattaggagataccgatttagacagatttacctgagcaaaaccaattattccattttgagacagacttgttgagaagagcaagctccaatcaaacatgccagctctgttttagaaggattgacagtgagagttccgctgttccgattggcttgtgtagccttttatgtccctgtccaacattccccagatccatggctgccatttaatttactttcatttgaaaccaatctatgtatgcatgcatgcatggtggaacccaatctagcaacaaaaccgaaacttgtgttagtagtgttcaatatacaaatttaattttaaaagaacccacaattgtatttgtttttattttcttatcttgcatgatccactactcagtcaccgttttttgaaattgcaaatcgctatcacatgattacatagttggagtagtatatattttctctattgctgacatgaatacatagttgtagtcccaaatttcagctgcattcagagtccttaatacaagttgcagcacacaaatgggtgtataaattttgaaatttgaagtggtccatgagttgacataacctccattatcttgagctcgtcaaactcatgcccacgatgcgtggttgattagctgtctaacctaaccttcattccacgacaaaccatcattatcttctatcacccatgaaaaactaaaattttaagccacctcatactttgcatactgaagtcttaatagcatactaacacacatggtaaataaaagggagtacctatgcatctttcgaaagatttttatgatcatatcacacagatttttaatctttagattaaaatccaatggacacattaaaatgcaaaaagcaactaagaaacaccataatggacactaaattaccatatcttcaagaaaaagaccaaatccaatataaatttcaaaacttacatgcgaagattcaaaaattacaccgtaacttacaaaagttacggtgtaagtttcataaattacactgtaatttacaagaaaacacactgtaaatttgagtgagaaaatcgagtgagagataagaagaaatctttcgagtgagatatagcaaaatcgtaaataaaattcagcactagtcatatccatataattgattattgtgacctcatgatagagacaagaccaaaaaaaaaaagaaacgcaaaaccataattctctgattaatcatagtataacaacatatatataagtcatgataaaaaacttaaaaaaattcagacaatacctaacagacacaataatttatgtttttaaaaaataaaataaataaaataaatgtaaggaaacaaaaaaggaagcggcaagaaaaccgttataacaacagaagaagaacatcacaaggacaacaacctccctcccttgtcttctcaagtccttccctcttcttcttctctctcatcatgtagagagagaaagtttagagatagagagagagaggagcagtacaaacaactgcatgcatatccatttagcaattattaattgctccccaactccaactccatcatctccaccaccacctaaacccacaaaaaactaaaccagaaaaccgcttaaccgcaagcgccgaggcggagagcggaggcagacgcagacgcagcagccgagcacgcggcgacgcccacgcccacgcacacagctcggcttcccggcggaaaccctagcgggcgggcgggccccaatggcggaggagggcgacaaggccacggcggcggcggaggcgggggggaggagcagccgctaccgccgccgctggtggtggtggtgggggtgggggtggtggagcggaggaggagagcgtgaagctgttcgtggggcaggtgccgaagcacatgacggaggcggagctgctcgccatgttccaggaggtggccatcgtcgacgaggtcaccgtcatcaaggacaaggccaccaaggcctcgcgaggtgcggatccgtacgccccggatctgggctcgcgggcgcttgctcgtgccccggggctcgatttggggggcaatgcctgcggggaattcgagctccgcggctgtttgttccccccctttgctttgcttcttccgcgcgtgcttctgtggcgattgttccgcgcaatgtcgtcggaggaatgaattcgagcgtttttggctggattttcgtgtgcttcttgattttagccttgatatgctccattgctggagcgagatctcgcgccgaattaatctggttggtggggggcgttggtggggctcttagcttgaattttgagtggtattggtctgaattgcgtttcatcagtcgaatttgtccaacgccgtttcgaatttcacctttctgctttgtttttcaaaatgcggttttatcggaacgtttatcggcgttttttttctttgggtgcgtagcttgaatttgtttagggagcaatgctgtgccgcaaatgtgctttctacgagtacaaatcaggccacttattttctcttaccaccagtaattttggcacttcttactcgagctttggagcatggaacttagtttggatcgggcttcagaatatcataagacgagctttgttcggacttctgtttggctattttgagctttgctcggacttcagaaatgcaagatggtcatgcatttttttatattatgcgagataactaagttattacgttgttcaatgatttattctaatttgagcgaactagaaatgtgatgatagtttgggtttttacccgattcggtgaattttcacttctttatgttagcattgtgtagagtagtcacttttcaatgcttcatagaccctagagatcgtgctacaaatggaaacttgggtggagcagacatcgctgcaaaattagaaggcatatgctgcatccttcttatttgggacattgacaagccagatttgctccgcttgtgcttttctctttgtctctgtagccccatgccacctgatagcctttcttcttcttttttttctatttcttcgctatatctgtctgcctctcaggttgatgctaattttggatgtcatgaacttaatgcagggtgctgcttcctcatatgcccctcgagggaagaggctgacaaggcagtgaacgcttaccacaataagcacacacttcctggggtacgtgatcgttggaatatattacaatgctaaagttgaattcatgctgttttccttagttgaattgttgcaagctgatcccgtgtttatggggtgaaaattacatgtgattttgaaattccataatctggttgccaaggaacagcattggaagcttgtgcatgtatttggctgtttggtgggaccaaaatgaaatctgtagtgggagtgcggggcactggtgaaatttgacttgggtagggggtctagaatttggaatggtcatgctaaatatctgtggtgggtggtctaaaaatcactggacatggattatccttatttttcagtcaataagtaacatcattattctccacagttctgctgcaaggctgctgatatgcatgtattagtttcagtacgttttgtttcatggctagcatagttaacgagtaatctgattcaaggatgtatatttggttggaaaacaaaaacattacacttaccctcaggcagggctaaacttcgagccacaccactatgaacaagtagtgggtgtgcttggtctttgacagcaataaagttggatctataggaaatttaacctgtcaacagctgcatgatggtctatcttactctcatagcggcacacctaacaaaagttagatcaccaatctggccatcacacttttgtacccatcctgtatggaaatgaactgattgtagcttcagttttgtagcatacctaactgaggtcccaactcccaactgaccaaacaatatggactgagtgttatgattaggatttgaatagaacttttgagatagggacaaaatctcaaactaattctggtgcatactctggtggaccaaattctttcttcggaatgaaaaagcttcatgatttcactagttttggaaacttttaaaaaattatgtaggttgatgttactttcacagttcaggtgtcttcacccagttaatcacagaataagactggacatctaatcccactcccaatcagatgagtaatgttgagacgtgaaacatggatgatgatagaaacaaactataaagtcttggaagttaggactttgtcctaatgttggacaaaagttggagtgcatatgagtgtggtagttggtaatcactgactttgggagccagcaaggcacatttacgtgacattttttttctatagtgttaatagctactgttgtgacaccttgttcatgaatagctgccaaacattcccagttgcttctttcttttatctgatgacaatcttcgttttctttcatcaattcaggcatcaagtcctttacaagtaaaatatgctgatggagagttggagagactaggtatgattgccctttacatagaactgttctttttgccattgattttattgcactcatgcttgtacttgctatgatctccagaacacaagctttttattggaatgcttccaaaaaatgtaacggacaccgaattgactgatttattttccaaatatggaaatatcaaggatttacagattttaaggggttcacaacaaacaagtaaaggtgagatctggtgaataacctattttcctaaccatttagagctagaagcactggttgactctggaactttacaatacctaatgtttttgttaaattaactgtgttattgcagctggctgtgcattccttaaatatgaaacaaaggagcaagcagtggcagctattgaggctctaaatgggaagcacaaaatagaggtttgccagaaattagttagaatagcagaaaaattcttagtggttattgaaatgtactgcaattcacacatgaacatgatccatagctctacttagtcatgagtctgatacacataaacagtcaaagctaaagacactctctgctattgcatttatttgataccttgtgtctgcattatattatccagttacatcccttctcaaaccccacgttatttttcatgaatatattataatctcttctgatttatttgttagggctctagtgtgccgttggttgtcaaatgggccgatacagaaaaggaaaggcaggcccgaaaagcacaaaaggctcaattgcaatcatctaatatgcctagcgcgagtcctatgcaacaatcttcattatttggggctttacagatgggatatatgcctcaatataatggatttggctatcaggtgacttgtgcttttctcttaatatttttttttacatcatacattgtcgtatacttagcacaagaactatattagtcatattcttctttaaaaatattatttgtcacctgaaaacattatcaggatatgccccaataataatttggttcacgttgtttcatggccactatttggtactgctacacacataaatggtggctcttgccatattcagtgtaaaaggggcatttgtccaaactgctaaaattcttcatcttcgttcttcattatattgttggtactttctcacagaagaaaaattttgtcggtacttcaaaccctagcattgagcttcaagagagtgcttaagatttttttttaatgcacacatattttgcttggaataagtctgattttgttttcttttgcagccaccagggacatacggacttatgcagtaccccttatctcctatgcagaatcaagccacattcccaaacatggttcaacctgttaatcaaggaaactctatacgaggagtcaaccctgaactgtcccctaattcagttcctagatcattcaacgcaatgcagttaagcagcccttatccacctgtacctggtgtgcagtatgctggatcctaccctggtggtctcatgaataatcgtcctttcgggaattcgttcagttcgattaaagttccaattgtaaatgcaaattctcctgcatcttctagtcccagtagcaatcctggtggccaaatagaaggttagacacattctacttacacctttagcctttgtgctggagaaaacaccgttttcttccaagatgttatctggaaaaagctgcaaccttagcaatacattttccgagaaaaatcatgtggcttttgattctataccatgtacgttatcctgaaatgtttataatgtgcttctgtacatgaggaatccaaatgcatataaggacatcagagttcaggagatgaacaaaaatctaacaaagatattgaagaatggttagctacctgattgtgctaactaatactctctctttctgaatatatgtttactatcagtgtagctgtcattttgaagtccatcatgttttaaagactagtcttcatgcttacaggtcctccaggagctaatctatttatctatcatatcccacaagattatggggaccaagacctttccaatgcattccagaggttcggtagagtactaagtgctaaggtttttgtagacaaagcaacgggttccagcaaatgctttggtaatctctctctctctctctctctctcacacacacacacacacacacacattttgcttatagtctgctaattgttttctaacgggtgcaggttttgtaagctacgattctcctgcttccgcacaggcagccattggtgtgatgaacggtttccaattaggcagtaaaaaactcaaagtacaactcaagagagacaactccaagcacagtaaacccttttgacgaaaactatgatgaccacgcgatcaggttcctggtacatatttgtcagataattgatcgttgaattgtttgctctggccgcagcattgggagcttcgtgtatcttctttgttcaattcacattcttgaacactgttacgtcgtgtaatttactgcagcctagtggtagaatttgtttcatcagacccttgtacatcagaagtcagattcattcaattgtggacattttctcctgacagtgattccggtttctcattgacacgattccggactcacccaaaactattatctgaaccattattgacttatcatgtctaaatccccccatggaaatctgatgcttttggaaaatgcttgtcagtgattcatattaagtggagtagtaataatttgtcagtactaacgtggagtatcatttgacaagattcagaatatgaaatttggtggggcgagagtttgatgtctgagcagcagatgcagatcagaaattcagaacaggataaaagcaatggaccccctgcactccatcgtgcaacaactccagatggccatgccatgggccccaacacagggtattctttctagcttgtcccaacaacaattttgtcctttctcatgtgcaaccagcagcgacaggactacgctgcaattgcttgtgcttaccctgaattaaccggtaagaggcgccacagccgcgaaacggccaattgttttgcagtaactcatctgaacttttgaaaaagagtttctcctttctggctcgccgctaccaacatcaaaatggatcgtgctgtgtatgtttgccagctttggctatgattgtgacagtgtacttaattgcgtgtgcacaacgggttatctgagtaggacgcgttagctgagtagctgtacggttatcatgcacggctcattaggcacatctgcattctgcaccaaactcactgattagtctctactcagtttgggcatgtgaaacagtgaaagagtttgaataactccgtagtgcatcatcaggaattcaatctcaagctatctgcttgaattaaacatcactccttctgttccgtagtattacattatgggtttgtcctaaatcaaccttcctcaaatttaaccaaatatatatatatatatatatatatatatatatatatatatatatatatatatatatatatatatatatatatatatatatatatatatatataaagcaacattttcaacacaaatatactatcaaaatattcaattatgaatttgatgttacagatgttagtactatatatttttataaacttgaataaactaaaaaaaattagcttagtgtaaacctaaaacgacttggctgtgttcggaaccttgtgttcccaacacaagctggccgcacggaaaacggcacggtccattagcacatgattaattagatatttgctatttttttaaaaaaaagaattaatatgattttttaagcaactttcgtatagaaactttttaaaaaaacacaccgtttaacagtttgaaaagcgtgcgcgcgaaaaacaagaaaaaagtgttgggaacttgtacttccaaacaacatgagacgacggaaggagtaccctggtacgagaaaacagtctggtgattggtgagtaccacaaacttgtaataatgcttaccgatcccttggtagcacggcacgaagccccccttgtccaggctggccatggtctgcgacgtacggcgtagcctgcacaaacgtctatatgtagttgccgccaaagaggtcaacatactccctccgtcccaaaaaaaaaaccaatcctgtgtttgaatttaggattaggtttttttagactagggagtaggggatttgggggctctttgccattgacgccgtcaccgacgccgtgtggccatcccgccgccaaacgatcttcttgcaaatcactctcctcctagcagcgggtctgcacaagaaatggcggcgaaggtggggaggtcatctcctctctggcgaagtttggaaggggaaatggaagagatccgatggcctagattgctctggtagtgacatagttgtatggtttgatcgcgtgtgactttcccatttgatagggtctaaactcctaaatttaatttcaaaatttaatttcaaaagttgggtttgaattgtagttatggagttactaaaacccaattctacctctctaatttattttattagagcactttagtcagctcacttcattttttatttttatattgaagttgaaattgttttgattggactttagctccagaaaatgtggacttcagctccggacttcattttttttattgaagctgtgtcaaactggcggtagaagtcctctgtgttcgcatgagctcgatgtgaattgtgaactattccctccacacgaaaaaccgagcgtttcattagcgcataattaattaagtattagtttttttttcaaaaatagattaatttgattttttaagcaactttcatatagaaacttttttaagtagtacaccatttagcagtttaaaaaacgtgcgcgtgaaaaacgagggaaatgtgttgggaacgaggggttgcaacacagcaagtctgacccttaccaatattccgctcctgcgaaaatcacctactacttttcgatctctatcgaatcctggtgttcgccggcgacggcgaccgatgtcctccgccgcgtctcccggcggcgcgagggagcgcccctcctcgcgcaactccgccgtgtggcccgtgccctcctctccctcgcaactcgcatcgcgctgtctcgccgcctctgccgatgcgcacgattgtgcccatctggcaatggtccaccgtccagtccacgcacaacacaaactaattgcgatgtctgtgctcaaatcgaacaaaatttacaaccaatgacgtatacgtatgagcccccacaaactcgcagcaaaatcgaataattctgcttctgcagcagatcaaagcaatgtcctacagaatcatcctgtcatacagaagtaattaactttactttactcgagtaactaattattttgacactttgacaatcgtaaaaaaaaaaagaaggaaaagataatgacgagatgatatccaattaagtagtagtacgtgtcaaatcaaactaattgaacttaactttgtacatcacgctaggtgaacacgtcgtgccgagcttgctgttcttgccgccgatgatgccgtggtggtagtacggcaccacgccgttcttggccaggccggcggcgaagaaccatggtcggcgacggggtgacctgcatgaacatgtagttcccggcgaagaggtccccgacgtaggggctcccttccttgagccgccgcaccaccttcgccaccgacgccctcaccgcgccgcccaccgccgccgccttcctccgcagcaccctcgccagcctcgagatcctcagcctcggcctcatcctcctcctcctcctcctgccaatgccgccgccgccgccatgctgcgcggcggccgcggcggcggcggtgatagccgcgtagtactgctcctgcagctgctgcggcacatcaggcggcgccgccaccgccgccgttggaagcttcttgagcctgcggtaggagaacctcctgctcatcaggtaagacgacggcatggcgatcagccgatgatcaccggagctggagaaggagaaagcgaggtatttcagcagctcgtgacgcgagcacgcgacatttcgcaaatgcagattggcaatgtggttaattatttgcaataatgtggttgaggttgagacgatcgatcgatggcgagagagagcgagaggagggtggtgattaaagagtggggatgtaaatatggttgggggagtggcagattgagtcgagaggcgaagatgatgcattgaaggcggagaccggtgcgcgctgtggatcagttagtgcgagtacaactcgacagcagtttaactttggtcgtaatcgtactggtacgggcagcgggagggactgagggaggtgggaatctctctctcttcggcagaagcggccgttcaatgccaccgccgtgctagaatgctaatgtatcacatctcatatcatggattcataagcgagactgcgagatgtcgtaagccgagaatagttttgaccggatttactgttgcgaatttgaatttctcgaaatctgattttgaatcaccttgaaatcacgaaatttcacgcgaaggattgtaaattctgatactgatacaaaccgacaactgattcctcagtcctcactaacgacaggtgttcgagcacaagtgccctaaggccattcacagtacacctaggtatcattctccctcatgcagccagcttaaagattcccctccacttagacatagttcggagcctcgccaagaatcgtcagaattacagcttttgggcccacaagagaagaggtgaagaagggggagggaggggagaagcaccgatgccgtcgtcctccccgatctgcgccagccgaagctcgctggccgcgcagccccccgatccatgcctgccaccaagggaggaggccggacggggagctccgcccgcagcatgggtcgcgtcgccgcctccagccccgacgaggagagatggaggcgtagagctcggtgccgccgccgctccgccgacgctatcgaacaatgacatcgccgccttcggcctcgacgaggagaggtggaggcgtggagctcggcgtgccgccgcttcgcttcgttcgcccgggagagagaatggtggggaaagtgtgagaggagagagagggagagataaaactgagtggagagagataggtgggacccactccaagcaacatgcattgtgaagtatgtagctaatatggttctttagcccaattggaagcccaggcgtagcattttccaggacgcactgtgagcagggttcctcttactgcgtggtaacctcgagacatgccgtggttttaaaaaccgaaaaggttacggtaaccgcgataatcgcgcggttttgtaaaccctccctgagtgtgagtgccctaatacatcaactgcagtccccagcctcaatgtggtgggctaggcttggttcacaaatttattgaattttatcacatggagttctgagctcttccaaactgctggatctatgttgaatttcaaacgaattttaacaaaattccatgaaattcgtcatcgcgctggattgcgtttcaacccaaaatgagattgcaaacgctcggccagtaaccttgtacggttcagaagcaaactgatcagaaacaatccaccaaactggttcaagaggaaagccctcaaaaaattatgagaaactataggttcaacaagacagatgctccagagcatagtcccaaaatagacctctgaaaattggaggtagattctatgcccctctcatattaaaaagaaaaaagaagtggtttttacacttgaagatcctcttctcaacagcagtagtacatagcaaaacccgggcaacaagtgctagacaagggcctgccaccaccgtggctttgacctaggcacagctgctgcccatttgccttataccccacccccccccccccccatccatatttacatgcactaacaagaagtataacagcacgccgaggccgtgtgggacgctgtattgtgcttgcccgccggcccgggagctgatcggccggctacagccagacaagaagaacaggtggtgcctcatcacctcttgaaacctccctaatttacatctgtctagccgcgtgtttcttcgtcatagtaggctcattagaatacacacaagaggcacaatgttggcccaatgaatggaacgccacaggctccgagtagcgtttgctgcaacagcagaatgaatggtaaaaaaaatgaaagctgatacatgaggtaaacagattataactctataagcatagattcatcaatagcgtttttactgtcttgtaaattcatgatgcaattgagtaatgcactgttctcaaatgattgcataaatcagatacagatataaatcaaacataaactgaaatatgagcacgagccataaaagacatggtaacgattaatgttaaaacacaactatataaaatttagcagaggaaatttcttatcccatccaaaataacttgtttgattttgacttttcaccttggcgtacactatctagcgtaactgagcttttctcttggctcacaaatattttgccatccaaggcaactagatcccaaggattacaaaactatgctttctaagatggaggtacttgtttgcccagaagaaaacctatgaatgtttatctcaatcaattgtgagctgaactaaaactccatttagctgaggtaccatcagcagataggcaaactcaagcctgatctggacttcacagaaatgcaacctcgattcagcaatcagcgtaaagatcaaacaaaatggatttaccgtattagcctcaggagcagaaacagcaagtaaaaaacagaagtccaaattgtccagctggatataattagtactacaagaatcctatagtattcttttccgacattctaaagtgaacgaatgaattcctcttagagataacactcattagcagttgagagaatcttaaaaagataaggcaaaaaacttacatgaatgaggtgcaggggccagagccgacaatccagcaggatctcttcttgatgtatgttcacttggaggatgagcatgagcaaaagaaacagtgggcaaaggtggttctggaagaactggaggggatggaataggggacctactgtgcacattgggattccgtggtgacagtgagtgaggtggcaaagcaactggtgaagcaaaatgatggccattggctgtaggctcaggagctggcattacatgagctttattctttggcttgtcagtaccatatggacaccgagatggaggtggagctccatatctgggttcatgcacagggtaatgtactggagcctgagccggagccgaatgcctgctgtcttcatgaccatggtgatggtgatgatggtgatggtgaccatgatggtgcatgggtgctggactaggtgcttcagaaccacccccactatgtaaagaatgtctaagataggatgaaaggcttatctgcttcaccctgccaaatacggtatggttcagacccaggtttcctgaagatgaattagtaattgtttgtgccaactgcttcatccttggtacagatggctggtgattcccaacttcaagaaaaatggaggtctcaacaatagttggagggtcaaccgttgaaccattcaaattcgccaacttgatatacagattctacaatgcacacaataatataagtttaagccaagaataaaaagaaggcaatgatacaatatacactaatcaactttttcacaacaaaatgtaagatccaccaatagaaattcatatgatggattaaaaataccagcccctttctttacagatagttcttagcagactatatcaaaagcatcatccgttatttgtatgtacatagaataaaatgaaaatgaaatggacacatgtatttataaagcagaaaatggtataaattcaagtatgatgagactgtagacagataaacagagacttccttgggttggctatgctaatcttgcaccccttttccatgtggcttcatgaaaaattttaaatcaagagcatatcctcaaaatcacctgttcaagcactgtgtgctctctcatgcttacggacctaactttgtgcgcgcacccctgaaccaagattgttcagtagcaccagaaatcatgaggaagaaatgcagcaaagcatgctatgtctacaggattgtgtgtgtacatcatgtcacatgagaaagtgcctaaattaaacaaatatctaaaactaacatatttaaaaatgaaggaaacttcaaaggaggcgacataaaatgaacagaattcattagtataatcacattaccatataacttaataactacaatgaaggtaatataaaatgagttaagccagaaggtaccactaacctcataggaattgagcagtaacccagttttcatttgatcctttagctcatcgattctgtcttgcactttgtagattgggaaattaagagtgaagttaaaagttgcatgaggtttctgaggaaggaaagcagtttgtggcggaatgattgtaattcctcctgggaatttaagcacttcaaaggacgatgaatttccaaataaggactcggttaactggagtgtcgactgccgcacgacaaaggacataaaataagacctaagaatgctcagccctgttgacgataaagtcaaattctttggataaggcacaatgctgaagataacatttgtccagtttgatccaactaattgtagtgaatttactaccacctgtataagtattcaaacatcagattgtgacgtgatgaaagaaatgtataaataaaagatgtctgcaggccatacagtggagttaggaatgccgatttcctcataaatgtccaattcaagctttgatgcatttccattcagctcaggaaccatcttgtgcagcctaaagcttgccactatatcagctggaagaaaaaaatatcggttcgtaagacacgcgtcttaaaataaagtgcttagaaggattgacatgtattgtgcaattctagacttccagtacttctacacaacagaataaagaacattatatttgtactgcagaatgaccgaaataaagattaaaagttctgcaaaccattccaaaagtgcaatttcagtaaacagtaaatgccaaacaggcttttccacattagacaa

SEQ ID NO: 3099 - DNA, 15273 bp, Oryza sativa
gggcaatgctagaaagtcttataatatgaaacggaggaagtaataaatatggaatggactgcaacctgaattattggctagtaatttactacggttcaacttcagcatttcaataaagccattgcaaacctttgaaaaatgcaaaaagggaaatgggaaccaacaacacaaatatcagtgacagaacctcctacacagatgtgcaattctcacaaaatagttgggtcacagctcaccaaattcggtaattgtatggaaccacaagctgagagtgacggagttgccacttttagcattaaattctaacttactcattgtgcaaaacaagcaccgacacatggctaacgcaatacagatcaaataccgacatcaaatctagcagaaaacagctatacgcgaggaaatttgcatggtatcctctgatagaatggctacgctaaggctaaattaatccgtctcgcatccaaatcgaacgaaacataaatcgcattgaccagggtcgccacagtcagttcaaatttccgtacatccagatccaaacctcagaaacactgcctactcatgaatccgccacgagctaatcagaaatcgaaccgcagattccgctcgtcgggggggcattgcaaccagacgcaacggaaacgaaacggaatcaaaagcgagcaaggcgagagatctcggcaatgcggggctctcaccatcgaagccggcgcccggatccgggccctccgatcccctcccgcgccgcgcgaacggcgggagccagaacaccgccgacagcagcacggcgacgccgagcacgagcgccgccacgcatttcagccgcaccaccccaccgacaccgcagcagcagcaccaccaccaccccagtcgcccgctacctccccttcctcctcctcctcctcttcctcctcttccgcctcctccgccccctgccccatccggcgggcgctgctgctggtgctgcccctcgccgacggcctccttccccatgcggcgcgatctcaccacgacgcatcccggcgccaggcagccgccgcctccgcctccttggacgccattgctggggggggggggggggggcgatccggttggtggagctagggctgggtggtggtggtggtggtcctccgctgctgcggcgtcgttgcttaaggaggaggagattgaggtgggcgagggaaggtgagagaaagtgagaggtaaaccgcaccgcaccgagccgaaggtgaaacgtgaaatgaattggagtggaattttggaagggaagggaggaagacgacgagcagcgctgcggttggagtgacctgacctgacctgaccacgccgagtagtagtagtagtagtggactagactagagttaagtgggtaaagctcacttattgttggctcggtttattaaattaaggtcgttaatttctttctggttgtgttggtgtggaataaatttgtaggtttagctttttctttctctttttcctttttcatggtgttgtgattggtttgttttatctgggtttttggtgaggattggtttgaagattttgaatttggaagggggcaaagtaggggttggatcttctatggccagtgaaccttgtgagtgtttgagtggtagctacctagaaggtgtagttttttttaagtacatagcagtccttaaacttgtgtatgtgtgttatctaagtccttgaattcttaagatgtatttttaagtccttaaacttgtcatgtgtgtcatatacttcctccgtttcacaatataagtcattctagcattttccacattcatattgatgttaatgaatctagatagatacatatgtcgagattcattagcatcagtatgaatgtgaaaaatgctagaatgacttacattatgaaacggagggagtaggtcctaatggattcaaacccgctccatatgctgacgtggcattgctacggaggcacctacatgtcagtgaaatccgcatgtcaagcatatataaaaaataaaattaaaaaccatattttctcatcttaggtaataaaaagataaaaattctaaggtagagaggataaaatatgttttttttattttttatatgtgactgacacgtgggttcgactaacacgtaggtgctatcgtggcatgccacatcagcgcatggagcgggttagagctcgtttggacctagatgacacctcaaggcaagtttgggacccgaaaatacattttgatagtttagggatctagatgacatgctcgcacgagtttagggaccgctcatgcacctcactcttcttcgtttcttttcaagtccagagattttaacattcttaaaattttaagagtgtatgatttgatggtttatttttgaacatctagaaaaatgataatgtttatttattttttgaccagcagataaatagtaactttagttggagttattttgaagtagagggacgaacaaatacaattaaaaaacaacacaaatacactgtataacaagcataacattgtattttcatacgaagaagcataaaacatatatactttctccgtcgcataataagttcatttttaacccctcctatttgtctcaaattaattttttttagtaattatggtatcggaatttgtgaaaatacgatataaatgtattgcaagtaattaaagagaggaataattacattgtgatttgataaagtggaactattatagtcttttgagttttgtattgatatatgtgaatggaaaaaaaacatttactgaaatgaagagagtatatattttagacaacataggatggagttttgtagagtatatttgaagcacccttctaatttaagtcatatagttgaaacatattgatctgatctcaagtttatttttacttgtacaacattcaattctggctccaggatatataaaaatttatacgcttcagatataaatagtttcttcgtacgaaacaacacgatactaatttcttgcctataaatatataatcagctaaccatttcaatataaatctagctacgaactatcaatgcatcatcaatgaacgcgaaaaagaaaaggtaaggtgaaacatcacattagagaatgtgatccttttgttccccatctcgatcattcccggccttctctccggttctctccagtgctgtgagagggcgagtgcttatccaacaatcaacaaccaaacagtgaacaaacgggagaatgtcggagggacggcgaaggcgatatgcctcctcgccacaacaagtccccacaggcgaacagccacaggagatcccggtttttgggtgcagccagcggcggatggatcggcgagcgacctccggaccaggaggcgagacccgtgacgtgggcccgggccccacacccctattccgatcccctctggctttctcgcggaagagcgagagagcctcccctgcgcacggtccactgcacctgatcaagacgagttcgtttatggtgcttccggcttgccaacctccactctctatcgttttctacgtacactttttcccaactcacagtattataaaaaattatatagaaaaatcactttaaaaagtcatattagtttatttatttatgttttttactaatacttagggcctctttagttagtaaaaaaatttgtccccgcatgtcacatcgaatacacagacacacaattaaagtattaaacgtagtctagtaataaaacaaattataaattccgctagtaaactgacggaatctacgagataaatttattaaatctaattaatccgtcattagcaaatgtttattgcagttgcagcaccgcattgtcaaattatggcgcaattaggtttaaaaaatttgtctcgtaatttcctggcaaactgtataattggatttttttttctatatttaatactccatactccctccgtttcgaaaaaaacaaatctagaactagatgtaacatattatagtacaatgaatctagacatatctctgtccagagttataatactaggatgtgacagcgtcaaaattccttaattaatcgtatgataatcttgccgctccgtttatttttttcatgaatcacttttagttcccaactcatagcaaagaaaacagcctcgggtccatgcggaccaggtgcacggagagatccgtacgtgcgtcctcgagtcggtccacgtgcttttccccgtaaattacgaagtgttgaacctctctcgctagtcgctggctcatggacccggtgcacatggactcaccttacgagaacccgctgtcactgaccgcgtgggcccacgtaaacgagagagcacgaactcgccgtcgccgacgctatcagcggccgcgttcaaaaccgaagcgccgcggcggcggcggcgccgcgtgggggacggggcccacatggaagcggcgttgggtggggttggtcgaggtcatcgtcggcggccgcggcggcggcgaggagagccaggtgacggtgagggtgggttagccactcgctgtcggggatggaggagaggagacgccacttggactccatctccgtcgccgtcctccggctacaaggaccatgcacctacccgccgcttgcctcacgcgtcgtccttctcctcgcgtttgcatctctgtctctctccctctagaagttcttgatcagatagacagacagaggaacgaacaactcctgggtgatgaaacgtcggcatctttttttcacggattttggaaggatgagctaattttattttttttgtgggggggggggggggacgtacggtgttaacctacattttgtagtcacgcttgatgactgatttaaggccttgtttagtcgtaaactgtttcttcaaacttctaacttttttatcacatcaaaacttttctacacacgtaaacttttaatttttctatcacatcgtttcaatttcaaccagacttttaattttggcgttaactaaacacaccatacggttctgaatgtacagttgctgtacgttgaggtactgcagctgaatagctgatgagtttagagtgttattattatgcttagttattatcttttcattcattgcactgtcgggttgtactcgctgtttttattaaattcctgtgccgttttcagctcgtagtactcctgctaagagcggggtaataatacagccgacctactggctataagtttctttatagccttctctcagcctacccatataatagttaactcttcacaattaacatagagcctacttgtctctctaacagaatttcttggttcttgtgtccaagtcggctgtaagtttacagcccgcttctcctctctctactatcttcttttctccaactcagcatttagccggctatagcctactattatacttgctctaatcagggttaggtgacagatgaaacagtgtttatgacaatttattcgaagcatggacgaataaattaaatattaaaaaaatgagaaacttgttttaaaaggttgtttaaaacaacgatgaggaaaactttcccattgtaagtttggacaccatgtctacgataatctatagtagtacacactaccttagttccataaaaagacaacctagtaacacattctagttgacatacgattgtcataattcgtagtattatgatgtgtcatatccgatcttaaatttatttttttatatgatagagggagtaagttacggagaatgtgccctcaaataatgtttcaacaatttgaatggggtctaaagggcagaacatatttgtagagcctcctaggtattgtgtaggtattgtttgggaagcttaaaatttcgagaagcatctatttcgtagctagcttacgagaatttggaaaaatatgaaactcattttaccggattctataaccccatattcttagaatttcaaaaaaaaactatactttttagaatgagcttttgtttgggagaagatgcagctgtcgtaaagctcccaaaaacggaccctaggacttcaatggaactgttgctaccgcacacatactgccatttggctaacaattttatccaccgatccactcgtgccacgtttctatttgacaattttcggaatctaagcccctttgtaattgagaaatatcaaatggattttgaattttgaaggattcaatttcctataaaactatttgatttatagaaaatggtaggatcttctcataggattacatttatatggttcaatttcatatgaaaaataagcaagaggtctaacttcttgaaaatttcctgtgatgctattagaggctcctcttcatctttcctatattttctattcctacaagattagaaaaacatgcaacattaatttctgtatgtgtattattcctatgtgtttcctataatgtatttcaaaggggtctttaaaaaaatatcgagtgtcacttatacatttcagtaacatacttaacaaactattataattattgattatgaataattataataattaataatttgcaaaatgggccatcgtcatgcgcacgtggcagtttcaacgtagccacgcccccttcacatctcatacctaagaatcctgcaatttcttttagcatatttccattttgttggtccttactgaacggcttccttttccccctgagatttctatagaaaataatgcgaatgtgaggtagcttacataaagtcgaaaacaatatcttttctacctacacttcaagaaaaagtagggggggaaaaacacagtaaattccgtagtaatagcaaataaatgggccttacatagacggcccagcccatttcaacagtaagatctccaccgagtcaataaaacgcagcgcctcctctcctctactccgctccgccgtcgctgttgctctctgatccctagggtttactttcccctcctcctcgaactctagggtttttccgctcgctctccgccaccatgacggccgccgagacgcaggaggagctgctccgcaagcacctcgaggagcaaaagatcgaggtgatccgtccactcccagcttccctccccccgccgctgttgccctcttcttgtgtgatagaagtctgttcaagaaggatacgatcttttaggatttgtgcgactttagatcggtgggtttggttagatcgtagtggtaaactgccggatctcgtttgctgctgaggttgcgcggcttttaggtgcgagatttgggtggcgaactgagtggttgttggagtgtggatttctggggatcctattgtcctctgcgatcaggagttctttttttactttatggggattctcgttgatgaactctgttgacctctgcaatcaggagttattttcctttcttggaattctcgttgctgtaagtctataggcctcttgcgtgctagtagtagttatgtgctccatgttgtttggcgattcacctatgaagagagatcggtacttctgctttcatggtactcctgtattaaggattacaagttctaaattgattatgaacatgctgaagctagattaaaagcgttataattgtttagcaccctgaagctagattactgctgtttaactatagtgattgttacattagtaacttgggctcatttgttaattagattgttactctaggattctttgttttcctactgcacaaaggtacaagcccttctcttttactcttgagaaaagtccttccttttatgcatagcatgcttattttcaatttggaaatagcatacactggcgtgaatactcactattttattctgcatgtggcttggtctgttgtgggttatggccctgctttgcagggcatgtttgttacttgacagtcagttaaagaaaatgtcattttgcatgctttcagggagatgagcctatccttgaggatgacgatgatgacgaggatgatgatgatgacgaggatgacaaagatgatgatgtagaaggtgtgttggaatccattttagttattgtaatataaaggatagatatatcaggtggctgcccattctctggttgtcgcatgaaacatctctctatttctttaatctataattcatttattgaagcgatggatatttatggagcgcaaaatagttttttttgtagttaactgatttgctaccttcagttccattttgcaaatattctattctttccatactagaactatgacttttgttgttttaattcttcttttgtcatgttatgttcttgttcttttaaacttattcatgcttccctgaattgtcagtgtgagccatctgcattaaaaatttattcacatgctatactgtgatagcaccgttaggtcttgttttgatacataagaatttcaattaccatggccatctcccactttccaaacagggccttattggtacaggatgaatgcttgaacagatcttggttaagaatatactgataatcttggtggagcttgctagatgtattgtatataatatcataagtgataccatatttgtttcactaggagtttagtatttgtgcctttgatgtcaggccaatctaagaggatatatagttcacagttcaaatttacaattataaatccccaaccaagaactgttatcattagaacccaatttctgtttcacggttactcgaaaacagtcaaaggcttcagaaaaactatacttctatgtggtattgtagacttactgtccagtgtttgctacttactgtccagtgtttgctaaatgctgatggctttcctttatgctttgcaggagcaggaggtgatgctagtggaaggtctaagcagagtaggagcgagaaaaagagcaggaaagccatgcagaaacttggcatgaagaccatcactggtgtgagccgtgtcactatcaaaaagagcaagaacgtgagctgcttaatcactgttatgccattgtttcttgtaggctcacagaattgttatataccattgcattttgcttaacttttccctgcactaccagattctgttcgtcatctctaaaccagatgtcttcaagagcccaaactcagacacctacgtcatcttcggtgaggcgaagatcgaggatctgagctcgcagctgcagactcaagctgcagagcagttcaaggcacctgacctgagtaacgtcatctcaaaggccgagccttctgcagcagctcaggatgacgaggaggtcgatgagtctggcgtcgagccgaaggacattgaactggtgatgacacaggccaccgtgtcgagatcgagggcggtgaaggcgctgaaggctgctaacggtgacattgtcactgccatcatggagctgacgaactagtggaatcacgaaacgttgtggtggggatggaacttgtgggttaaattttaatgttgagggcgcattgataggatgaaccctcctccttggttatgctatcttgagagcggtaggtagtgttacgaaacttcaaggcctatatcatcctttgataagatcgactgtttgctatttaatatgcctttttcattcactggtctcgctacacatgcctgcatgctccatggcttctattatcgaaaaactgttgaatgtgaatgagtatgtttttttgcatccaagagtgttgtgggactgacatttggcttaattctgtgcaacacttgtgatctgcccactcgcgcgtcgtagaattttgtaacagctcaaattaggtatatgtactactatgtaaaaaaaaaaactaatcctaactacatatgtgtacatgctagcatagcatgtgctcaggtaaatagctatttgatttttttataggaagttcaagcatttgttcaagtaaatagctatttgatttttttataggaagttcaagcatttgttcaagtaaatagctatttgattttttataaggagaggtttcacggatgtgttcaagtaaaaatagttagaattggattggactatttatggagaggtttcacgcatgtgttcaactaaaaataaatagttagaattggattggattattaatgagacggtgagatttcaagtggtaaaaataattagaattggattggattatttatgagacagcgaggtttcaagtgtgtgttaaggtaaatagttggaattgaattttttatgagggagaggttagggctgtagcgatatgaagaaaccatcagtactgcacagagaactcaattcgcagcaagtcatcgaactcacaaacgggccgtcccgtcctgtatcttccttcatcttcttgccatagttgggcacttgggctggtgcgccgcctaggcaccggcggcggaggcggcggcgcgccacacgcgataagaccgaggcaaggcggcggcgtgccggtgcaccgcgcgcgcaccacacgcgacaagctcgcaaggcggggagaacgccacaacgattgcacgcgccgcccaacagtttgacggataccaggtaggcgcgtatggccgcccgccggccgctcgatctcttatcttctttctctccctccccttgtcgaggttttctccgcggaattaggctcttctctctcgttcccggttgggcgacgacgcgtgatgggcgtgactgagttgctgcttgttgctccaaccttacgagcgcaaagtgttcgacgcaatgcctcagagaagtagccgcggcctgcacttctgcagtcttgcctctgttgaacatctggcacatttgtgctgctctgaactgaaaagattatgctctgatctgaaaaggcaatgctgaaactgatcgtgcaaaatccacaacatttaattttactcttcttttttttcttctaaaactcttagtaacattttgcagttcctaactgaagctgatgctgaaactgatcatgtaaacttctcacatttttctcctgcacgtccccactgcatattttttttgagctcaatagattaaccgatggtgaatataagaagtccaccggaactgggtgggcatgaagcttgtgttcaaaacggccaattttgtgccttccatatttgaccaacagattgcagatatgccaactatcactggtttactacgattaatacatgttcaagcaagatgaacagcttacatatgttcctagtaaactttgccaaggggacatgagtagtgctacaccacaacaatggcatttatccactttccagcctgttctgaccaaattatcttcaggtagaatttgagtgtcacctagagaaatatttttatcatcagaggttatgtaattttccgtaggaagtcaaaacagtccttatggtggcacttggatctcctgtataagaactgtaaaaaattgatattgcggtgattcattcagtgagtaaacattttagacacccagtgaaattcaacacacttcattaaagcaccttccttttcttttacactatggtcatgttctttcttttttggctatcggcatacttgtaaatcctgcttacgattcctcaaacttcatttagtacctgacttgatatttttagtttcttgattcaccattgcctgcatctatttaggagcgggagattgcacaccaaaggtcaaacaggttgatctaaagatgcatagggaccagctgattgggtcggcattcatcgcatttggcatcatattatttgtgggtttcttctatgctgcggttttgaccaagatgcttccaccatatgaaaaccggtttctgtcagcaatccaaaacgataggtaagtaaaaacaaggacagaacagatgttcagcatcattcactgttttcatagatatgttcttttactgcatagggcattgatgtacggttgcaccggaatcacctaaattagttttctgcttatatttacaggtattactgcctgctcataccgttgacactcccagtgataatcgtggctgtctatttgcattggctaagcatgaagatgttcaagcatgcatgaagcctcattctaaaagtctgaagttctttctcaaatgacaacctcattatcatggtgaccaaaaacatactccctccgtcccaaaaaaaactcaacctggacaaaggggattcatgaggttttttgggacggagggagtatattactagtatcgttctcaaagtcagcgttagacttttacaaccattaatatatatatatttttctgccaggaattcaaactatacataattgtactatcgtagaactatttgtccccagctccgtctgttgcactagaaaaaaaacagactaatttaggatcaaggcacaaacaagtgtcaaattttttttgtctatcaaattttgccaccagagtataattattgtttatagtacaaagacttcaaatcttgtgcactgccttttatgtcaattttttaccatgggtcttgcattgaatttttcttttttttcaaaaaaaacatattgttgtgctaaaaaaaaagagaaaagaaacaaaagcaatctaaatttggtagcgcgttggctttgctatgtttacccgggatatgtttgggccgtagagattgtcacggatcgggctatagagagcagcagtaattttgagttaacaaagcaagtttagagttttgatcctgtccaactaatcgccgggttaatcgggtctacacgcgtgacatgcgccgcaacgagattaccaaaaaccaaaacaagcaaagggcgggcggttcattcattcacagaagaagagggccatcactaggaaaaaatcatcatggtcgtcatggaggggagagacagtatagcctaatctaatcccagattgctagtgattagcacgtagatacatagaagcgatcgatcgaggacacatcgagaaaaaggtaaaagggagatcaattaatcgaagaagagagtttttgaaatatcgatcgatctagctatcatcatgtcgttcatccggaagaagtcgatggagttcttgaagagcttcgaggtgccggcgaagaacccgtcggaggaggcgcagcgccggtggcgggatgccgtcggcacgctcgtcaagaaccgccgccgccgcttccggatggtacccgacctcgacaagcgctcgcaggccgagacccagcgccgcaagatccaggtacgtacctgctctcttcaattccatcggcgtcgccggcgatcgcctatctccctctccatcttaccttctactatcccttttcatattaaagtaattctgaattttctttgaaatcaaactactttagctttaactaaatttacaaaatatatttttttattttattagctttaataaaactaatttagtactaaatattgttgctatatttttttcataaacttgatctaactttaaaataaataacttgaaaaataaatcaaaacaacttatataatattaaataaagaaaatatttttttgcatcgatcactgcatgcgtcacttaattagatctgaattctgcaatctgcaatgcacgatcgagcatgcacgcgtcatctgcgtgcatgctccacacacacggacacacctcacacctcacatcaggaattacatgcaactttgaagcatgatagagtgggaatggcgtggaccgacatggcattggtctatgtagttgatcctacatgttagatttcataaatgttatacacctagttagagtatagttttatattttgtacaacaaaactaaaatgactcaaatccaataaatccgagtctcactgttttggatcaacttggtcaggtaggatgtatataaaaccgtgaggtatctcccattaggatagtggcgaaaaaaaatgttttggatcgactcggtaaggtaggatgtgcataaaactctgaggtatctcccattaggatagtggcgaaaaaaaataattatagggcctcattgtttggcatattcatatgcttatcaacaaaaatttgaattttcaacgttaaatttggagctgattttgggtttttttcatcgaagtttatttttcagcttttgcttttagatcgctaagaacacatatataaaagttttattcacaaattgattttcatttgcaaatatgagaaaatatgcctaatgatgaggctgctagagccttggcacacgtgtgcgaataaatatattatagacacctttaaacactagaaatacaaggcattgtagtggtgtgatacgccggtgagcccaggccttgatccaccccctgcatcaggaaagaaatatgtgttccattacaatctgatccacaaattaaaatggatgtgtacaaaattaagtttatggctgacattatacaatattaatttggccgtctttcttttctttggcagttaacgtacatgacagaattaagctacattaaaagtcaggtttccatgttttgaatacttattaattgtattaaaattttccattgaaaagtttacaatgtctcctacttctggaccttggaccttggagtatttgtcattgatgtcttaccgacatctggaccttggacccacatgtcattcaaagagggaatgccacgtgatgatttgggcaaacttttagtggcacaaaaggaattcacccaccaatatagcattaattgttctagtatatatagtgtcgaagcctttgctcttgctatttattcctcataaaataaatttatatagtctttgagagataacaaaaaaattttagtcctagttgccagagttaccaagagataacaaattttgcactgaaaaatatggtaccaaattttggctaggctgtagattattctcgaactgacgctgattttgaattctatgcgatatttttggcgcctttgttactcgacaaaattttttcatggttatatgaagactaggtaaaaaaaactagtttgcctagaactactcttaaaaatcaaaattaaaattcgcccccaaaaggagagggaaacttagaaggtattgtcatgaagaaaatattctttccattctactagtctgaatgtaggatcttaattggcattatagcatatgactgaataaaaaaaactgacgtatgtatgcattggttacaaaacaggagctctgaatttaaaataattaatatgaacgttacatccttggcataagaaaaaactcgtccattcgcattaacaaagaacatagtaccacatggttttaattagcatctccctctggaaataagttcattaacttgatggtacaccctgtgattctgcctgttcaacccaacacaattctactccttttgaaacacagtcaaattaacttcgaaaacctgaaacaatctatg

SEQ ID NO: 3100 - DNA, 691 bp, Oryza sativa
  unsure (1)..(691): unsure at all n locations
nnnnnnnnnnnnnnnnnnnnnnnnnnnnnnnnnnnnnnnnnnnnnnnnnnnnnnnnnnnnnnnnactactatgaatgtgagatataagccaagtaatctgtgtagctctacgactacagagttgagagtacagtccattttctgagcatccaaggcctgaaaccttgaaccacagtttagtgatcaaataatatgtggctaactagctatgtgctcagtagacagaggtatattacattaagaaaaacaacttagctttatatcatgttaatccaaggaaaattacattcttagcaaagtataacaagcatgatgcaacaaaacaaacataacttcaaacaatcaattctgacctatcaaagcaagaacaaagcccaggaatataataactacttcgaagaaattaaaatgcagcttcacagagagccatacctgcggggcatcgtcggggctgtgctcgtgccgagatcggcgaggcgacggcgagagctttcatcacagcggacatcctgctgccgattggtggctcttggaggaggtggtggtggatgagcgccaaggaggaaggaaggagaggaggggtgaaatgcatagggaggtcggngtttgagtggtgcaaagggggaggggagtgcanagagcgattgggtggtggcgtgtnttaaacagagccatncatncatncatgctt

SEQ ID NO: 3101 - DNA, 648 bp, Oryza sativa
tacagtacgtgtgaagatgcaggatcaccacacacgatccagaattattattccagatggacaacggcttgttggaatgtggtggaggaagagccagcagcaaaggccgcggaatcacttccaacttttgggttgcaactgcaaggaggggattcgttccaatctcaaacagtgaaccagatagagaaagagagagagagcttaccaacaccaggagaggcgccgccgctgcacttccgcctgtaccgagccgacccgagccgcgggacacaggggcgcatggtgctcgactcgatccatcgatccggccgccgccgctcgaacggacgccgcctccagcccccttcaccacctcgccgccggtggcttcgctccgccccccgtggctggactcacgggatcgtctgcgccgccgctgccctgaagccaccacagcccatcaagctttcgagctgggccttcggctcacacgcagcctagtccaagcaaacatatgctgctctaaggcccaaagagttgtagcccaagcagcccaaaattatgtcgctcgagctatcaacagtactacacactaatataagggtgcaagtggggaagccgcttatagacaaaattagtgcataaaccgaggtttgactcacatgttat

SEQ ID NO: 3102 - DNA, 517 bp, Oryza sativa
  unsure (1)..(517): unsure at all n locations
catcatcacttatttccatctcatcaccctcaacattttccatattgtcatcatcactttgaacatactcatctccgcttgattcctcattctcactgacgggatcgggcgtgggctcacgacgaccatggcgagtgcggggaggcctanctgaaaaacaaggagcaaaggatggataagcaacaattttagaagccacatattgaagtgggagaaggaggagtgctgtctgtcaggggcggtcaaaccgaaagccaaggccggtcaaaccgcaagccccaagtcggtcagaccaacggctcacggccggtcagaccgacggtcctcggccggtcagaccgcaagctcttggccggtcagaccgccactgacagtagcacaaccgaatccttccacaatccacacaaatgattctaaaaaaattgctaggacaaagttgcccaagattggaacatgaatatcaaggtgtaggtctatttcataaagattgaaacaaagggggaaactacccttaacc

SEQ ID NO: 3103 - DNA, 744 bp, Oryza sativa
ccaaatggcaataagtccaaagcataagagcaaataggagcaaatatccaatatgcaaaagaagcacccatggtgcactatctcaagccacattagagaagtctatgacatttaactcattactcaacttgcaaaagcgggttttatcaagaggcttggtaaaaatgtcggctagttgatccttggttcttatgtggctaatgactatgtcacacttggtaacatggtctcttaggaagtgatggcgaatgtcaatatgcttggttctagaatgttgaaccgggttattggctatttttataacactatcattatcacataggagtggggttttggtgaagaatatgccatagtccaacaaggtttgtttcatccaaagcaattgggcacaacaactacccgccgaaacatattccgccttggcggtagagagggctacggagttttgtttcttggatgaccatgacacaagggatctaccaagcatttggcaactaccggatgtgctctttctatccactttgcaaccggcataatccgaatcggaatagccaacaagcttaatttagcaccttttgggtatcacaagccaatagtagaggaatgctttaaatatcttagaatccttttcacggccactaagtgacactccttaggagcggcttgaaaccgtgcacacatgcaaacactaaacatgatatccggcctagatgcggtaaggtaaagcaagctgggctgcaggaa

SEQ ID NO: 3104 - DNA, 962 bp, Oryza sativa
gggggcgcggagggcgtggtggataggtgggcggtggcctgtggccagcgggagtgacggtgcccgtgtccccctgctgtcgcgccgccccgctgcccccgtgttgccgtgccccccccccctgtcgcgacggagggcggtgaagtggcgagggtggaggcggaggtcgttttcgcccttccgctccgagcccccggtggccaccgccaccgcgcccgagctcgtcgtcatcgtcttcaacctgggttcgtcagtctctctgtctctctcaccctctctctcgggctgtcgggaggtcggcgcgcacggcggcgggtcgacatggccgtggccgctgcccattcccgtgctctaccgcagccccccgcacgccgaccgcctgtccgcgcgctgctgccgctgcccactgcccgtcgacgcacgcctgagagagaaaaggggggaggggttgagaggtaatgacatgtgggccctatattttcttttatttctttttgttgattggatttccacatcaacgccacgtgtatgccacgtaggagaaaaacagctcaggattgagtcgggggagtaattcatccggtatcaatagttcgaggtgtaatatgtctggttttgtggttcggtggggggaggggtaattcgtgctttttccttttaaattaataggtatgtactcttcaccgattgcagtagcaccactatgaagagtatgctttaaagagcttaatttacttatagataccaacctcatgcattgcagtgggattttatgagaaacattaatctaacagctgatggctcatagacaatttgatccaatgatagaagcaccagtttgatgatgcattaagctcccttatactccctctgtccctacatatataagggattttaggtgatatgacgattcgtagtcttaggatacgtctcatccattcaaaatcttttatattttggga

SEQ ID NO: 3105 - DNA, 5862 bp, Oryza sativa
  unsure (1)..(5862): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaaattcggcgtgtctgaggcgaacatagaccaccattgtgctgcaaaagccaagtaacatgtcatttcataattctgaatacatcaagatcaattagatatatcatagttccatgattagaaacataccaggtgaagttttcccatctatggccatccttcttgctagtgccctcccaaattcacccgtcttacgtcggtacatctcaacctccagcaaagcggcggcagccgtatcgatatccgtcatccactcgaatgcctgtcggaggtcttggaagacagtagcacttggagaatacgcgtagtgcgtcctagggttcaatgcggcagctacaaaacatggcacatgttaagtaagagttacataatatgccatgtggattatgttatgaccaatatttaccggcattgatgagagtctcattggttaggtcgtgcatccttctgttcacgatctccatgtatgcttcaaacttgtccctttgattcgcaaaaagagtgtcgtactccattttgagcaactgatatctcaaaagtacctcactcaaattggggttcttgtcctcgtcagcaaaccgaaggaatgagtacataggttggacagaattcactactgcctctaagttctcccaccaagacagactagatagacatgcatgtgcatatctaccttccaaagtcccactaaatttgctttgcatgaagacagaggaagccatccattgcatgaaaagatctcgcttcctaaggaaactctggagaaacatgtagtttgttccgaaccttgtagcattccacttaaccagttcaccacctatagctaagaccatcatagcatgcaacttgttatgattgtatagccatctgcaaattttcctagcactctcaatcaccatttcgtggtctggcatttttccaacctccttaagcatcaagttaactgtgtgtgccacacaaggttgccacacaattgtcttgtattcttgccgtagtagtctgcacgccttcttgtagttagagccattgtcagtgataatttgaacaacatgctccgagcctatttcgcgtaccaccttccttatctcctgcattggtagataacataataaaaattagtccatgcccctaacactgacgataacaggtgatgaagtaatttgttgcatgaaccatacataccttcagcacaaagttagcatcctggctttgcccggtcgcatcaatggacttgtggaaaaacattattccattgcagtatatcagaaaattgatgaccgacatactcgtcggacctgtccaagaatcacacattatagtaacaccgtactcatcccaatccttcttgaacctatcaaattgcttcttcacatccttctctgtagaatcaagatattttccatctatctcgttaccagttggagaaggtacactttcacctacaattgacgtatgaaataagtagtgcacaatgagttagaaaaaaagaagttccttaatagatgcatacgtaccccacttttgtgtctcccgaacggcgctcacaaagtatggattatcggcgtttctaccaggaatgccggcggtaaagaagaaccttgcccatgactcaccaatggcttgcctagcttgcttccccttctttgtgaagaatcctgtgtcaatgcgtggctgcacaggggccttggcagatgctaggttgtaatctctcacagcaggtgactccctatgagacgtagcccttcgtagcatattggtgattgggttacttctacctttccgtgcctccggctgagcggatccactcccaccgccatgctcataagtgccaccacgctcctcaacatccctcctaaagttttcgtcttgtcgtgaggctgcaatggctgcttccatttgttcctcctcgtcggcatcacctgttaggtcataatagttgacccttgctgcttcaacccttcttccgctatcactcttacgctggtcacctgcatcttttatcctgtccaactcacggcagaagaactcacggacatccggaggcactgaattgcaatatgtaacccccttccctcttgcagccaagtgttgctttagtcttgttgccccaccaccgcccctctttgtatggcaatacttacagcgccatccaggtgggatattctccccgtgctcccacacagggtccctactatctgacatctccaccctgtatcaaatgcatgagaaattatcactgctaattataaacatacctcccattatgcaataatacgacgtaattatatgtacactggtaagcatgcatccaaattcttccatactatgacgtatttaatttaacctatatgtacatagaccaaagcaatcaaatatacttcacatgcatggttttagccaagcacgggcaaccaaatgccgaaataaactcatattcccaatgtatttcacatgcatattggtaaaaatatgttctattgacctaaatccccaaatatgtccatgcatatcacagtaaaaaataccataccacggttcaagccacggtaaccatggtagggtggacggttaccacggttttcacacgattaccgcacatacgtatatcgtctcatagattacgaagccgacggtaaccatacaaaaccgcacggttaccgctcctaaccgcgcgaaaaccttcaaaacggagggattacctcttgcccgtcgacccaggcggttaccgtcgcgtaccgcgcggttaccgccgcttaccgcgcgggaaccggcctcgccggcgcggaggcggcggatctggcgcgggcgcacgccgtcgccccttcggtcctgagcgcagctacgcgagagaggggaaaaacggtaggattcgccagagaaacgaagcagaggcttccaaagatattttcctcccattgtgggccttattgggcctcgtgaacagtgcatacttggcccattccatttaatcttttttcttttttataattcacaataggttttgcgctcaaatttgaatttacctgcatctttttgatgaaattttttcaccataacaacatacaaaacaagctttacatccatgatttttttttgatttttttcgattatttttcaaatttttgaatttgagcaaaatttgcccaaaccctaccgccggttttcgttaccgaccccccacggtaagcccggtaaccgcggttaccgcgcggttaccggcgagaaagtgaaccctgctagttatacattgtgaaacttttaacaataaatacctacttttactaggtcccaccttatttactagttggtaaatatacattggtgatgcccttatctagggatgaaaacggtcggaaacgatcggaaaatagcctcaaccatttccgtaaccatatttttctcggaaacgaaattggaaacggtaaagtcggaaacaaaaacgatatcggaaatatcggaaaaccggaaacggaacaatacggacggaaacatgtcggtacagatcggaaaccggtaacaaatacggaaacattaaactataaaaacatatatttaactttacataagtatgttatatatatatacataaattcaagcttatactatataaattataaattaacttcattttagccatgtacaaaagttagagattttattgaagagtcattcaatctataagctgtgggttaagtatagacatgtcctataatatcgacatatttagaatacggtaattaccatattataagaaacggtaatttccgcgagaatacggtaaatacggacacgatcggtataacagcaaaaccatttccgttttcatttccatattttttaccatttccatttttgtttcggtcgattaccatttccatatggctcggccggtagaaagtcgaaaacgaacgccggtcggccggtaattaccgttactgttttcacccctacccttatcaatcgaatctagcctgaggcttgtgttcggtacatgagttcccaactctcccctctcgttttctgtacgcacgtttttcaaactactaaacggtgtttttttaaaaaagtttatatacgaaagttgcttaaaaaatcgtattgatctatttttgaaaaaaatagctaatacttaattaatcacgtgctaatgcggtccgttttccgtgcgtgggtaatgtgtttccaacacccaccactgaacacagcctgaggctgcactcattcctatcaaacaactgagcacggaaaccagagcaagctattactccctctgggttgataatacttatcgttttggacaagggcacggtctaaaaaaacaactttgactattatttttcattataatatgtataaaagtgttaagaaatatatgactttttaaaactaatctataaatgtagttaccatatttgaaagacaaatattttaaaaataatttataatcaaagattgtaaagtttaacctcatcattgtctaaaacgataagtattatcagtccggagggagtagcacactattagttattataacttgaaaaagagttttatttgacttttttaaaatctttatataattaaaagttttttcacgaaatgccgtaacattttttttcaacatttgattgctatctctctcctttgtatgctatctcttctctgtgacttatgtttttcatttttattttatttatgtgttaatttatctagtacagttttaagaaatcaaataggcaaccaatcgttctttcctagtaagatttgcaatatatagtgtaaatatatggaattactcatataatgtaagagatgaaatttcttgtaggcttgtccacatacgtagtattaggatgtttcacatcccgtttgttcattttgagacggagagagtaaacctttagcccaataagcccttaaaatatcgtcattcaatgtaacattttcaagaaaatacatttatatatgcatgtattttacatgccaatgaggttggcccacttgtgagcctttctgctctcatgataccctttctcctttcccttgcatctcggtcccataattctctaaatttcactatctgtgttaatgatattagtgatggaggccttcgaacttggaagttcactaaaggtgtaaaaattctatgtggaatgaactatgaggcaagggtggtacaagaagaagtaaataatggaggccaaacaaagtcacatcgaaaacccgtggagtcgtaggtggcgatatacaagtttgtcaacaatgcgacaaaagaccttgataacatgcagcccattttagaaaaagacattgacaacttgccaacagcagggtttccttcagtcctatacacaatgatgtgccatgagagtaacttgtcacttgactaaggccctgtttagttgccatgcaaaaacttttcaccctgttcgacacatgcatacagtattaaccctaaaccctaaaaaaaaactaattatatagattgcgtgtaaattacgagacgaatctttcaagcttaattgttacatgatttgataatgtggtgctacagtaaacatttgctaatgatagattaattaggcttaataaatttgtctcgcagtttacaggcggaaatctgtaatttgttttgttattagtctacgtttg

SEQ ID NO: 3106 - DNA, 19582 bp, Oryza sativa
gacacaacggacgcgatgagggtggcggcaaggtggtgcgccagctgcctgacgaaatgcgtgagcggaacccccgacgccaccgccgcgaggagtagcttccgcgcgaacgggagcacggctgcaccctccagcgcggcggtggacagcaggaggcaccccgaccgatgccgggcagagcaggaagaagagcaccgacgtgaacgcgtgcgggtccgcccgcagcacgcgcaccatctcctgcaggatctccatcgcgttcatcggaggcaacaacaccacccctcctcctcctccaccaccccgccgctgcgctcgccgcccgccccgccaccgccacgcccatcgtcggccaccaactcgtcgctcccaacgatatctgagacggtgacagagagattgagaggaagaggggaagagagagatgggagagtatgacaggtgggccccaccatttttaaaaaaaatgctgactagattaacacgcgcacgccacgtaggacgataccgctttggattttcggtcgaggggattattcgtccggtatagctagttcgtataaaatgactgattttgtggcttaggggggtaattcatgccgtcgtcctagtttcgagggggtaattcgtactttttccttttttaaataattatttttatgatttaactagacaaaccgttattttatctatctattaaatagccgacgtttctatctctttgtcacgtgatttacactataaaaaactttttatgatgccgcctcttttctggcggagaagcgaaacaaacatttataaaaatgtattggaggattatgggtcatgggccgtcagaaaaagccgattttcattggcggacatgttattttttgaggcgaacctcttaagcatcgctagtaaaaataggttttcgctggcggtaggtaaagagcatcgctcgcgataaaatttcaccatattaaaaggtcctgcctcaccctccatccctcggttgccttgcccctcatacctaccatctttctcactccatctttggccttccctacacccgccgttaaggcacaacgcctaatcgcgctactgtcgtggcatgttgccatgaggaaaccgccgtcaacaagtaccaccaccacatcaaccaatgaggaggtcgaggccaccggatctgggtatttggtgaccccggcctccccgttggtcgatctggctggggagcaagaagacgactgacgatagtgtgtgggaccatcagatctggcagcgacggtcctcggcaatgactctgcacacaggctcggtgacgttagcccatggtggtgacaacggctagggttgcggctcagtgacaacgatgacgacatccttggcggccagcgtaatctcatcgcttgtgatgatttttttagcataggttaccgtcttaagcatggccacctgtgaagaggggatctcattggtggctagtcgtccgcaggtgaaaaggctctattttcattggttatttgtcacaggcggcagactgtgccaccagcgaaaaaattttatccaaaaaaaaaaccttctcatagtagcgtgttttcacaaggtttttttaaaggatccatgatctttcagatctgccactactgacatgttagacattcccatgaaaatataggatctctaaaggattctaaaacatatgctctccgacgttattgttttttatcactctcgttatcataggatagaattttaatcttgtattcaggcataacatccatgtgtttttctttaaaaaaaaacttgtgttccaaacaacaaagcatcctataaatttggaggatgctacgcgtcggacgtccaatatttcacaaatatcggacgcccaaccacgcactgccgcacatctgcttgctgcgttgcttggctgcatatgctgctgcttgccgtgttgcttgcctgccctgtacatgttgcttgtgctgctgctgcttgcatactctctctccctcgtattacatgtgcctaatttttttctctgaaattatatatcttatctaagtttcaattataccattagattcatcgtaattaaatatttataacaaaatctcacatagttatattttaataaaaatatacatatgcttcgaaaaatcaaccattgtttcaccattcatggaaagttgtttcatcacgttgcaactcacatggtgaaatgtttcagattaagagaaatacatcatatagaaattactaaatgaagcaatcacaactactacacgaaacactaaataccaatgagtgaaacataaaaaaaatcatatgaaacataaaatattttgtacaaatacttaataaatttgtttcatcacttgtggagatgtttcaacctatttcataaattgtttcgaagagatgcaacatataaaaagtattgactgcaacaataatcattattacatgaaacattatgtcccgactagtgaaacattttttatatttagcttgaaacatcgaattattattattgatgaaacataaaaaagtattcgctgaaacatataaaaaagataatatgaaatattgcaaatgcattagtgaaacatcaacagatacttgttggaacatttcattaacaatgtatgcaacatttaaaaagtaaaaaaaagtcatcggaatgtagtcatgtgatatcttgttacaaagatttaattgcaatgaatctaataatataattagttagaaattcaaataaatagtttaagagaaaaaaaatttaaattttgaaacatgcttgcatgcacgctcccttggcttgtgagtacatctatcgaactggttcaccatgcatctacattgttgttcttttgaattgggacgctcgattttttctttctggccggacggccgatggtaagcattatcctataaatggagtttctctgtgttttcgacatacaattctattatattcttatatttttcttatttctatgttcactctcggtatatgctcgtacagtgtttcctgtttcctgcggtaggatcaagcgatcccactctgatccaacgggtaagaggcccgctgccacgccaccccggccacctcagcgccccatccacgtctccgaccaatcgccttccccgcatcgcccacgtcgacgtgtccgagcatcctcgaccgtccgatccaggatccacggcccatcccgcctctcccatctggccttctcgactctctctcgactctggaaccttccgccccggcgacgaagcgaacgcgacttccccattattatttttctcctccttcgacttcgatttttcgaactcccccgaacacgacgccgacgagaaggagtcgaggaggcttcgaatccgccgccgccgccaccgccgccgccgccaccgccgccgccgacgagatgtcctccccggcagagtgagcctccctcagtctccccccgatctgtttctgttagtctctgatgccgcgtctcagatcactcgaggttggcctgggttaggggggattacaggaggggcccgggctaaatttatcgtgagtatagctgattagtttcatttttcaaggttagagaggcgtgggtcgttgtggtgtatttagttttttttttggcgcaatgaatttagtggtttaaacttgggctcttagggttcggaattagagatcgcgtgtaggattttgggttgattggttgggttgggctgttgtaactgcaggtgtctttagatggatataagcttattagttaatacactacttttgatgattttgacgagtttatgacaagtaattttagcattggtgggaactgtgaagtaggagtgttctgacggattccttggcatggcctcacttgatgaaaattgaggtctatgaattggctgtttacaaacttgatgaaaattgaggtatatgaattggctgtttacaagtggatattattgtattgtcgttgtagagtttacactccttgctaaagcacaatcatgcgcctggaacaaattgatgttttggttgggaaggttgtatctgatgctatttgtaaattttggagtcagaagcacacttctcggttcgttccactagtaaagacctaaattagatagttgcagtctttgttctccaatacatatctgctaatattcattctccaatgcgcataaattatagagtatgttatagtatttcactgccttcaaaacataaagatgcacagttggatagctataagcttatttgttgaagtatttcactgtcttcaaaacctagatgcacaattggatagttataagcttatttgttgataaattttgcacacggtgaatacaacagcctgtaataaactctggcttgaagcttggtagcatgggttgacattggccattgggtatgctcttatgatctgtggtcattaaaggcggtcgctgttttggtatgagttgaaagttattgaaataatttggtcgctttctaaaatgcatttagctttgctgaattttgttttcctatgttaaattcttaactgcttggggctctgctatgggttttgaaattgctacaagtattgagctaatttctgaatcgacaatgagtgacacttctgttataaaggctttgcaattgtgttagtttgtttctattgtcgggtacacgtgggaagtactgttcgtctgtaatgtatatggaatatataacctgagttgatatccttgatatatatagtacctgcctggtacacgggacacaggctgagtttggaattccattagcttagaccatgttagcatataactagactgttagttttaagaactgtgataggtacaggacatccggtaattttcatcctagatcctctgctgttagtgtgacagtctctctttgagcatgctttagcatattggtttacaatgtaatcagaaattttgaacgagatcatatttgataaactattcattttgtttgataattgcacttgtttttgctcactgatggatgtaattttttactagttaatcgaggtttacagctagaacatgaacacatcaaagtcataactctttgctacagctgcttctggatactcgattacttactttcccttttcaggtactacaactcacttccaccaataagcaaggcatatggaacattgtgtttctttgccactgtactgtgccagctccagatactgaatccaccttttcttgccttatactatccctttgtgttcaagaaatttcaggtcagcatatgtttatatattgtctgttctgttatctaccagtacagtttattgttgccccttgtttttgcacccgaattttttaaaaacacattaggactgaggatttgtttgtctaccccattcccctctcaaacactaactgatacttagttgcgacatgcaccttctataccgtgcatagtgttgtatgtccacacaatgccctatgaacaaatttgtttagcatttggccaatgtaatcaagcattgcagtttgtcctatgcttatgttggcaattggcacctgtaatttgttgcactcctgctattttactttcaatataagagctgtttctgggccttacagatatggaggctatttacaagcttctttttcctgggcaagttttctatcaactttgggattcgccttctgatgatgtaagtcttgttgaaatcaattgtgtgtttgaaagcatgcagagtattacaataagtaaacttgcagccattggttgaatcaattgtgtgtttgggcatgcagagcaagatacggcgtgcagttagaaaagggtgcatttgaaaagcgcacagctgatttcttgtggatgatgatatttggtgccatatcactgctggtcagtgctagcttgtactgtatttttagcagcttaatcagaccttaaaaattcaattcattggactcacatactacatataaatctttcttgcttggatcaggcattgtcagctattcccttcctggatatttatttcttgggagtacccatggtcagcatgcttctttatgtctggagcagagaatatccgaattctcagatcagcatgtatggccttgtccaactgagggtaagcttcactactacccatatatagaactcgatgccctttataggtcatcaatattggtttcaagtcttgtggagcaaattatgtttgattgtgggtaatatactccatttctgcagtccttttatctaccatgggcaatgcttgggttggatgtgatatttggctcagagatactccctggccttctgggaattctcgttggacacacgtactacttcctctcagtgttgcacccgctagccaccggaaagaactacctgaagacaccaatgtgggtgtatccttttttatatgggttcatggccaaagcatttcaatccatgttcaatagctactactactatattttcgatggtacacgctccatggttccttaactgctgtacagacataagattgttgctcgattcagaataggtgtgcaggcgaacgctccggtccgacccgcggccgccaacaccggatcaggcgccttcagaggaaggagctacagactcagtcaatagatctaacctagaggacaccctgtgctgcaagcctgcaacgcctatctgggagatgcaatgtagaatgaagcaaggtacatcaatgggtcaacctggacgctactagacatagactgttcagcagcttcaggaatttgggtttgcccatctaacaggaatgctgaatctgaaatgctctatgggtacaaacgatgtgaaacatttgcattgtacgcatgaaatgtttgtaggcgagaaatgtatactcccttttgttttcggatacttctggccatgattttttttcctacagtggatgatgcttagcacgttactgatttcaagatacgatgcactaaaatgactctaggaattctatgcatctgtgtctggtttgcagtgtttaaaatccatcagactgttccaccaccgctgttctcttccattgtaaccggccggcacaaacaaattcccaacctcacattcaattcgttgtttgccacgtctttgctgcagagaggccaacgtcctttagcgaggcgcgtcaccatcctatatatcgaggattggtgaacaatgtatgtatcgatattgatcactagtgcgtcaattgaaacagagcgtatagataacaacgttaatttgcctgcgtggttcatttttgactatgatatgcacggatgtacgcgtttatatgggcgtatgtgtttgtgttgtattttgaagaaagatccatgcgcgttcataagagagtttttgtgttgcatttgaagaaagaaagaaagaaaaaacctgccgagggcctgtatcattttttctaagcgtgaacaatttccaagctagtattcttttttatataacagtatatttttttttcgtcgcgcaatcaatttatccctttctgttagtgtttcaaagcaactagtgaatgatgcacgttcgcgcgactataacctatctattagctgttattacaattaacaataattttttcaccattcagctaaaccaataattaatgtatagacttagggtttgtatttatcttttccttggtgtttcctgtttttattcgcacgactgtaagtgtctttttttgctactgcttgggccaccaccttgcaatcatgttatctctattgctgtgtaacccaattatcatcatattatattataaatatgtttatcccccactattagaaaatatatttttgttttacatacttgattaatattcgaagaaagtatttggtcggaagtgtaggatcaatacaaatactatactgttttgatatgtaataaatacatattgtaatggaaataaataatttactataattatgctaaacttgtgatattattgtaagaatcaaaattaaatttcactactaccttggttccaaatatcctgggtctagtaaaattgcacatcataattgtaattatgttataagctttgagatgttaactttttttctacatatttgttttgattgttgctgactgataaagtgttatatgtagaataattttccctcttctaaaattatttaattggtcatacttcctttgtcccaaaatataacaactttttagccatcaggatttatcccaaaatataacaacttcttcgccaataatctcttcccaaccaatcacaaccctccaccattcactttttccatctacctccactactcatccaatcacgatcctccactactcacttctacctactttcttaataactgtgttcaactctaaaacttcttatattctggactgatggagtatattctaagaatcgtttgggttgattggctacgccaagccagccctaggcttctttgggaggccaacatgagataaccaatgagacgcaatgagtggctcaaactcttccttctctctgtattttacaacttctagaagattccgatcatttcaatggctaagatttcttgctattttatcattttgtgaatccaatgcttatgagcttaaaaatgatgctgccgttggatgcgtagtgaacggtgatcggacgtggatgtccctctgacgtagaatcagaggatccggttccatatagatgacccacatctttttttactactttattctcccaaccatcatattttatatcatgctgtgttcctttaaaaaagatgtaaatagcagggaatgatctaatgtcaaataattagaagaggtgaagcttcgaacctagatcatctagcctatcattttatagagctagccggaatacccctggatgtttctccatgctttgttcctacagcacttccttaatatttgctaaaaatggcataacaattttttatattactgggcggaaggaatagatgataatgatatccacgaaaaccatctctaaagtctaaacggatcaggagaaattactgtagtactatgttcaatcgatctgatgtaaattgtaaaaccgactccaacacaatacgtctctttcgacaaattaatatcaactacaattattattattattatgtatccctaataagcgaccgcacacggcggaacacggcgatggcatcgtcgccggcggcgacccgcgtggtgcacgtgcactacaacaacgccacggtcaccatcggcacggtcggcgtggcgcgagaggacgatggcgacgacgcggaggcggtggccaagcaaatcgtcgtccgcctcggcatccaccctcctgccggcagcggcgccgacgcccacgccgtcgtcgacctgcgcttcgccctgcaggagcccacgccggccgcgtccgtcccctggcgctggctcgccttctcactctgccgcttcctcgacctccccgccgacggcagccgcctcgaggacgagctatgctccttcgccaccgacgtcgccggcgatggcgccggcggcgcactccacctcctcctcgtcgacgtgcgataccttggcgtgtacgacgaacgcccgtccacgcaagaatggctgccggtgcagctgtacctgccaccggcgaccgacgacgacggcgcggtcgtcgtgctgccgctctgcccgaggcacaccggagcggaggccgagcggtggtgccacgcctgcctcggcgagttcaaggtgggcgacacgctggccacgccggcgtgctgccgccgccgcgccgtgcaccaagaatgcctgcgccgccacctggccaagggccccgacgcccgctctgcggcggcccaaccgcactaacgccggccgccgccgaggccgacgcggcgaggatgcaggggatgtggtggcgctacttcttggcgggaaacctgctctactggctcagcaccacggccgccgtcgtcacccttcgcctcgccgaccgccgcggcgtcgccggcgtgcaccactacttgacgcttggcgccgcctccgccgcctggctcttccatagcgtgggaacgctgctgctcgcggacgatgcattcggattcggattcaccattgatgaactcgcccgcttcctccgtcctctttgcagtcctgttacattcatcctctcatctctagccaacaagagatcataacgatgtaatgtaaagtaatctctattactattatggtacctcgtttgagtcggtttttaatttctctgcggcttttggaaatggatatccctatttgagttgaattttaagcttgtttgtttttgaaaatacaaaaagagtcatataagaaatctcttttaaaaaaacccgcatgctaacttgagatgaaatacaaactcctaattacagtctatgattttctttaaaaaatattcatgcaaattcacacagtgaattttaccctagctaaaccatataacgataataaaattaaaatatcatttacccgttgtaatgctttggcattttttctaagtatatatacatatcaatgatatcatcaaagattttattgttattcacaagacgaacagcatcagatgatcttacacaaacaaaagcttctcgaatacggcaaacattgcaagttacagataccaatttcacaaccaaaactgaacacgattttgcactgcaggcagcaggctcaatccaaccattattcaaacctcgtttcagttttacaatcaatggaacattcaaattttaacaggaaggaaatatgtacagttaactttctctaccccctgtttcagtgttttgtgcggtactatacaaactggctgtttgcagttgtatgtgtcatccactacgtgtaaaactttttcttcaaaactgtatatctgtgggaaacaatgtctatgtgctttgtctacaaaactatgaaccctacaatgataaccaaaatctcccccacaactagagccaacaaccatttcagcatactcatatttctccagctggtagatcgacggaaggtggtgcagaggaacaacgtggccaagagaatcccgtaacaaatggtcgcaccaatcatcgcaaacagcttggttattgaccgtctcgcgtaacacaccagagcaccaatcatcgcaagcaacctggttcttgaacgtgaaagcagtccactgtgaacttctgttttctcagacgtgttatcagctggagttgtatgttcagtttccaacttcactctatcatggctccacacgtcttcatcatcccacttcacatcggagttcatcctgtgcgatccaacttcatatatttttcctgtcggttcgtctctcacatgcacactggatttacctgaacagatacagtgcacacaatattcgaaagaacctggtataaaacaacattttactggttgcagtttgaaagtcaatgaagctaaaacgttgacaggacttacaatcaaattcggtccatccaaccatcatattatccaagtcatatacaacaactttatcagtgaacaaatttcctgcaccacaggtttataatcgcaagaagcagttaccacctaccaccaagtcaaatatgcaaaccatcaaatagtacaattctagtacaggcttagtaacttgccgcccagaatgaacaagtccttctctcgatgattcctttgttctgaactcaaaaacccaagacagtaatagtgctcctaaagagaaacagtttataacacaatatacatcacaatattttctcagtgcatatttgagcaacagcatagtttctttacgaaatacctccatattgtgaaacatatattcatgagggtagactcgcaaagtaagcagttccttgaagtgaaatacaacctctggaaacctagcatcaatactaacaaaaacaacatgttgattagttatctggttgtttgatggatctagctaaactggtacgcttgttcccaagatgaaaaactgagaggactagtagccccattaagtcaaaacatgtcgccactccccagaccagtgagagagaggaggttattctgtgactttgaacaatttattggtgaagattgtgcaatcaacaccaaaatgtatcaaaaagatgttcatatattgctaaaaagttaatctatcactatcagcaagaaaatttaatatatctaattacttgaacagattacctatagaacaaactacattcttatctcatggaacatgatgttaatgtagggcaaaaaaaaggatagaccattaatgtttcctaagaacttagaaagcacatgccattttttccgaagaagaaaaaataatctctaaaatcataaacatatttaccttcgttcatagtggaaacatgaatagcctccaatgtttatgacactgatatcctcaagatcagaaaatatctgtacagaaaaatgacaataaatattgacaagtaaaatgaatgtagcaaagggtgctgaaagaggaaagtgaattttcttacagaatctagaaacgactggtatactttctctggcaggtaagaaatcagagaaccagtttccaatattgtcatgttttgactttttatctcaacatttccagctgaaaggcttagagaagtttctcctacagttatttccagcaaagtagttcggtacctagaactacagcgttggcaaatactccatagtcaatatcacctcgcaattaagaatacatctacaccacagtcatattaaacaacaatgtcaagtaccttgtttgatccagaggagtttttctaacttttggacccacaatatggcctaacacaaatatgcccccactccttttgccatcaaggcagtgagcaaacattttcttccatttttgggactttgccagctggtacaccagagaagtattggatggccccaagcccatcacaccatcaactgtaaagcttgaggataaggatttcaagtgttgagaaatgcttccaaattgaactttagttctgactttgcttgttttgtaatggttgatgacaatttcaagtacaagaaaatcttggacaatttttccgtggagcaaattttcagtgccatacttttcaaagtgaatgcatggatggtctttttggcatggaatagatgtggagctggataggtgtttgcagaaaacatcactacatggtaaaagttgtccagtctgtgaattctccagatcatagaaactcaggacctacacaagtgtaattggttcagaatatttagtcacctccaaatacctgttaggttaagaaaaataaagcagtagataattactctggatgcactttttgtagggcaatctttacaagatatagaattaacccacagaagattagatgtggtgtcaatcaacacaatgaacttttttggtggctcaccaagtatcagttcagcataatagttcctgaaatgaattgttgcaaccaaagttagaattcagtaagtgcacaaacggttgatctatatatatatagagagagagagaaagagagaacatagatcatgtaaagttcctcacccagattgaagtacatttccacctaggtggatatcagctactgataatttgcggcctttgaccttgtcttccatgggcatataattcacattgaagatggtaacggcggatgcatttgttatccatagaagaggcaatataaggtaaatgtagcaatgtggaacaaccatttttatgaccacttatataggatcacaataaagctgcatcaaacaatatcaaaaggaaagtcattagaacttgatagaggacacataatattatctccagaggacacatgcataagttagaagcaaaaaaatagaagggataattgaatgtactttgataaatactccataataacagaatacaagatatttacagtaaacatttcatagttataacttcattggagttacgaagtacccaataagcatttaagacatattgaacaatcaattgagcagagctgattgataaaggatgaactaatccaaatatttagcattcgtttgcatcaatcgtgccacagtggtgtctcccaccaaatcgattagccgcggaaggcacgataagaacagagtctaccacccgcaatctagtgcgtgtagaatgcagaatgcaaatccattagccgcgagaagatgacacacataatcaatatgcaatgtaccccccacatgcacacaatcaagccgccataagaatccccaatccagcatctgcgtgtagaatccccaacccacgcgcgcgcacacaatcaagccgccataagaatccccaatccagcacatctgcgtgcagaatggcatcagaaacgttgtgatgagcacgaacttaccaatccccagcgaaaccgcgtgcgcgagaggatccgacgccgcctcgctcgctcgctccagccgcgcgcgctccacggggaagaaccgaagaagctccctcctccgcgctcctctcacgcgcgggaatctctcgctccgccgccgcgccgtgctgcgctctcctccctcccggaatcccgcctcgtcggacgcgactccgtcaaccggggaagacgccccctcctctctccccaccaccacggcgagccgcgaagctccacgcatccgccggattccgcccgcctcgtcgagcgccgctagggtttcggggaggaggcggcgaggattggaggagaggagggcgggaagcgaagaggagagcgccaagaggggagggagggaagaaaggaagccgttggaagcttagctatgaatgaaagcagaagggcgccactgggttgggcttacccttgggcctacctgtggtaaaatgggctgttgccaagatgggccggtgaggcccatattggggaatcaaccggcacgttttctttgggcctggtttggtatgggccagggattgtgggctgcaaattcaggcctgtttacctttttgccattcgacttttcaatggaataagttcatctgaggtcccttaccttctcaacaaatctgattttcgtccttcaaccggaaaaccagataaaacgggttcctcaactatcaaaaccaatgcaaaataaatcccaagacggtttcaactatcatttcagctgaagtggcacttacgtggctaatttgactcggtctatatctacaagacacatgaagcaaaatttaataatttaaaaaataaaacaaaatatgtgggtccacatatcagtcaaataagaagattaaaaaatagtaggacccacatgttagtgggctccacttcctccaccttatcccctcacttctttgtatcctattcctccccttctccacttgcctccttcctccccgcttgggcctacctctgatatggggcccgataaatcccaatttacaacttcttctctgctaacaaaaccaactccctcaactcattaaaaaaattgggttttctatcacaagaaaaaaaattgcagaagtataaaaatggggattatattatttgtatgtgacatattccccataaaaccttatgccatgtatacaaagggagaaaaagggaagtggtacatgcaaatgatcaatctcttccaatatgaagttagctctatgtattatgatgcatttcgaatgacatgggaaatgaaaagtcaatattttagaaaagtagcggaaattttgaacagacaggagaatgtgggacttcctgtggtggtaaaattaggtcaggaacgattggatcacgacattctcgtatattaacctatattttcctttaaatttagaaccaggtacggatagtcccggataacgtttcactcatcctttatcttatctcatatttttttgtcctctgagtcagattcgggaacgaatttctattgtatctttgattcatagatattaagtctagggaggcaattagagttttaaagaagatacatcaaggaaaaaattatgtaatattacttgtgagcttataaaatagtgattaaccattgtaccattatgtttgtaggttgattcagaataaattttcatatatgtttgataatacgggataaacggacgaatacaactattttcacatcctaatcaatattttttgtggatttggattcaaaccccatttctctttcatatccttcccacgagtctctggtctggcggccgggcaggaaatacctgttccattttcatcctacctgtggagagatttgggagttttttttttcttttggttttcatagctgcaatgctaatccagagctcgcaatgcaaccataagtaaatttgtcttccaaatttctccttcgatcttgcaaaccatttaattaggcagtcattttaccaacgttttgcatgtctactactacctgcatagcaacataaggcaggctcttgatcaattcactgcaggcttcgtcagaaaatgatcccaggctttcaattcctgctgcaccccatcatcgctgtaccatcctccctacatcttcatttcagcaacttattatgatgttgcttcctgccatgacaaagtcacatgaaaatgcaggctttggttgtgtgcgcaaaatctgaattctggtaggaactgagcaggagcagccactagtatttgtgattcagataaggggaattcataaatagagtgtgccttgagaactgagagggagtggccatatgttgttttgcagtaaattctcttgttgggaggaatggaggaagagagaactgatgaattcagagcctgacatttcctgatacatttttgcaaggtatttctctctcacatgcttctgagaaaaaaaatgattgtggagtttgtatactgtatattatctttcctttttcaggtacaccaacagcacattccctttgatttcctcacactgaattgcaggaagtatgcctgcccgtttaattctcacctgttcatcagccaaactatgtgatcaggaggtgcaggtcagaattcaggagtgtatgattgtgtgtgccatgtacgattgtacagattaatagtagtgcaaattttcacatgatttattgacaaagtgttcaatggcactagttgtcaaacaaggtgactacccatgttgttttcagatgaagagattatagcccaattggaaataagaactttcacatgaattctttcttttttgaatcgttatttcacatgaattctacaggagcgagaaccatgaaattcatattggattcctgtgttccaaatattctatattcccaatgttcgaaacttatcgcatttgaccattggtagaataactttcatggtatcctgagctttgcacattggcaaattcttgaaccatttggtgtccatggtagttatagctgagcagagaagtgaaggccactgaaacgcatcctggatgaacagattttctttcacatttcagacaattgtttgtgctggctgtctctctcacagagatggtcctgactgaaaaataggctcttaactccgagtagatatgttgaacaggcagacagagaaatcagcacagtgcattaagcattcttttgtgcaacaacaataaataaccaatgcacccgggttaagcttggggatgacagtgaaatttgaacaagcctacaattggttgatgaaactcatgtaatgtactacaattcagaagggaaaaaagaatatgtaaagtttgttatgcctgcagatatggctaatcaattgggagtcctttcaaatgtctctgattgaagcattgctcatggaaaaaagtattaattcggctacatgatcaatctccatctcattgaatcttttgcttctttttgttcagtgtaactggtgctgctgcttcagcaattactctctctgctggattactatgtctctgtaaacttataggatattttgttctcctgttaatcaaaagaaaaaaaaaacgaatggaagcgtcagatatgtttcttgaacatgatcttctgtttaaaatcgatatatttacaagctaaaaccgtctgaacttgtgttaaatttagactgtaaacgtagtatttaagaagagtagaagagagaaaaaagaacaattgaacagaagttctactctaacttatctttaatttagaccgtggcctattactaatattctaccaccagtattattactcttagaaacgatataaaccatcgatttatgagttttactgttattagaaaaaaaggtagtactagtagctaaatttgtaagtataaatagatataatgaattagataagaaaatataatggatttaaattgattacactatcagtagagatcactttaaaacttgtcattacaaaataaacacatatagtcaaatagatgaaatagtatcatggagtgaccacattgcccttatgttctctctaccctctcccttacatttcccaatgttttctttttggccttaacagtattgtttgtgtgtgtggactgtggaccaaaatttgaaggaaaccgagaaggactagagaaacagtagttacacacacacacacacagagtcacagaagaagctggaccacaagaaagcagagtgacccatgctttgcttgttttaaacctacagtggtaataccccaggagccataaaaacgaaatcttgcagagagatcagaccaggccagcaaatataaatcttgcagagtgcagcaagcaaagcaacaccgttcgtacttgtacggctcgtcgttatgagcttcaatgctgtctctctgctccttgtgtgatgcgtggtacattttgcacatatgcttccataccggatttttccttttttttttcctttgagaaagtttggctgttggttgaatgatgtacagtagattctatcttggtttgtgttagccatttttttcagaccgttaaataatgtgtttttgtaagaaaactttctagaattttttctaaaatatcgaatagaattatttttaagtttacaaatattaaaacttaattaatcacgtaataatggatttctcgttttacatgttcttacctaatcctcatctccatcatattcgaacagagagtaaattattagtgcagtacttacatggcagatttgctgctaacaaagatggtatgtcatacataactctaatttaacccacttaccacctgccaattacccatttaccacctgtcaacaaaggtggtggtatactactaaggctgtattcttaagtttatattcccaatatcaaatctctcatttctcacgcgctagctgcccaaactataaaacgatgttttttttaaaaaaaatataggaaagtttctttaaaaatcatattaacccactatttaattttaatcatatgctaatgcacaccctaagtggatgaaatattttattaaagtacaagaggattttttataatttctgaacttgataaatgttgaaaacaaattctgcagaacttatttccggattagatcgttttgacatgtcatcctccaagactaccctatcatccaagcagtttaactttttgtgttcttttcttttttaaaagagagagggagagagagagaaaagaacggaaccatc

SEQ ID NO: 3107 - DNA, 2710 bp, Oryza sativa
aaaaaagtagctttgacaactatttctattataatatatttagaaatatcaacaaatatatatgattttattgaagtaatttttaatactaaactacacatatggttttcatatttttaagacaaatattttagaaattatttatagtcaaagattttaaagattgattttacccttgttcaaaacgactaatattatcagcatggagggagtaatttttaatttatttttcaactttatatttttttaattaattcatttgtatctcaaataattattacaaatcattcaggtacttaataaaaggacataaagctggtttggcaaaaaaaatcttttataaacaagtttttagagttttattatatttaaacaaaaagttgaaaagataaaaaactacaagagagattgaacactggaaacagaaatgtagtttaactcgtggttcggtataaacagttgtgagaacttttacagtattctgccagtataaatgatcaaaaggtttagattaatttgccctctcatttgaatatattacaatataaaactaaaatcggtagaattgcctctgtatacctattgtgcattgcgtgccgagattccataaatccgtatatacttaattaaattggtacttttttttaatatttttttaaattgcccttgtcagtagtatatatacttaccagtagattatacagtaaaaatcctcatcttttggcgacataagcatcgacaacagtgacagggcacaaacaacatttttcttttatatatattattatataatctcaatttgtaagactacccatattaggcactctgaagtacatctagctgctcttcactaaaaccaagtacacacctgatatagtaataatacacagtaaattaaatgcttagcttcctgatccaatgttaatctcagggcgtcgtactacgtggaagattcacctactacttaatttgctcaaatttaaggacaacactaagagccagcatctcgttcgtcatgcatgccggtttgttacagctgcagcaccacaaatttttgaacaaaataattaaaaccatctagtagcagtaaaatattagtgctatatgatcatattaactgttagaagctagtagtagctatgaaatacagtagtagaaaacatgagagaatcccaaagttttgaaagtacagtgcagaactaactaaccccatgtcagacttagttaacaagatttaaaaagtacgtgtacttaggtgttaatatatcgcctatatacatcaaaggaagaacttggaacatgatatcagtcacgctgcaatattaaaaattttcaaatcgtgtttataattacttctgtatgaacaggcagtactgtgtggtaagtactatagtagtacgtgacattagttgtaaagaaatgacacacttacgacaagaattgaagtgcctttaatttaacttaggtgaacaattaataatatggtaaagttttttgaatttttaggaccatagatgtgagttaaattctgacatgaacagttgaattttgatggcttaaggcaaaagaaaagagagagagagagagagaggaaaaaaaaaggcatccaaaatatggtacccctatgctatgaggatggaatttctgagatgagagaatgcgacaaacaaatactatcccattatattgattattatttggaaattcttggattcttcctgcattcttgcagtggctccttcctcttgttttccaactttctttcgatcaacatgtacataattgttcatctgagatgcaggcttaacaatgtttaatccacgcaagcatgattccatgtgtctctttttgaaatttgaaggcttagctagctgccagaagaagcagctagcggctgcacaacatctgtgtgtagaacagtgcaggcctcgtgcgagtgttggtgagataagatgatatcatcagctttcagttcatcaatcgatcagcatcagaatcgggctgggctggctgatggatgcagccagccacatctgtaatttatattttgtgcacaatataagtatttctaagataccggttctaatgtgcgaaaatctaagcattatcagtaattgttaggtgcttagaaagggaatctaataagttaaaactttaaattttgatttaagagatgagcgaaagtctttccacttattcttaatatgtgttaaataatttagaaatgtttatatttatgaacggagtatgtgtaaatgtgtatccaggacactgaggacaggcactgcagtggataacagttacccatattcctgcctttctccagacaaaatcagtggccatatatacggatcacagatcgctagtatgatgagagatcctatgatgcgttcctctgcatcagtggttgtctgtttgtgggttgtaaaatactccttcccatttgtgagggcccattggttattgcagttatttgaaactgatactgttatactttttttttacctaagaaataaatatatgttataagtgagtgtagtttctgataaagcaaatgccagattttatctattatcttaaaaaaaaatctaaaattgatatgatatgggttttactggtggtgtggttggaatgtgctaatgatgtttgggcacttggctcaaattcttccaaagagatttgctccggtctaacaaaaaatatctcgagg

SEQ ID NO: 3108 - DNA, 3643 bp, Oryza sativa
  unsure (1)..(3643): unsure at all n locations
tccatcccaaaatataaggcataaccactcatacacaaagaccagaaaaaacatttaattgactttttggttggatcaccttgatacatacaagcaatgtgattgggagatttgatgatataagatttaaaacaaatcaattttataggaccaagagatgctaattaatgtatgtatgcatgcatgcatgccttatactatgggacgatagaaaagtggttgtgccatatattttgggatagagggagtagtactataaaattggacaccttctctgaccagatttacagtgctattgatgtgttaaatccatccaaaatcccttataatatgagatggatggagtataatctaagagtaattatgatttgatcttttttatagtgtgctgagtgttttgaatcattgtagcgtccttgattttaattatctgccacatattatcacacgcatcaaatattagacgtatcatagtttgttaggtttgtgattaggttagatatcatcagttgtggtataacatgttttattactttatactccctccatcccataatataaggcgcgcacgtatttcaagattcaacccttaaaacatttgaccaccatttagtataatatgaaatgaattttatttgttaaaaattatatcaatagattgagatttaaatttattttcatatggttataattttgttgttacaaaccttatagtatatgagaaattttaagctaaaaattagttttggagaccgtgccaattttgaccatgccttatattatgggatatagagagtatgctccatcatttactcttcagcctatcagttgtagtcaaaattaaattttaagtcttaattttagagttaacttatttgattttttttatcatagtagtttttttagcttggctttttgtcgctaataatacatatataaaaattgtaatcataaattattttttattcgctaataagcattatgggcctgtttgggggagcttaagattctgaaaagcaggtggttggtagccagcttctaaaaatctggaaaagttgagttttacagtttctgacttctagttcattttctggattctacaactgcaacttctcagaatttggaccaaaagctagactgtttgggagagcttctgattttgagagaagctgcagtagctagaagctcccccaaacaagctctataactcataattaaccgtagataaaatggtgggactgctcattctctaaccaaacaatacaccagttgtaacaaagtttgatgataaccaaattggccatatgttttcttcccccatggttcatgcatgggaccaactggtaggacttgtttcatcgcaaactattataaggtctcatctcaaatgtcaagattttttctttgattcttgtagatgtatcgattcatgttaagctatatttagaatttttgtgaaattatgtgtttctaatgaggtataagtttatgtccatatcttaaaaactgatctaacacaaaggtttgtttagatactacaaatggcacaattcgttcaacccccgatgagttatgcccaattgtctctaccggttttgacattgtcttgtttccgacgaaaataacccttaggacatgttactctgtctctatccaaccaacacgtactaagacagaaggttaggggtattaatgatttttgttgaatttagatcaaattccttcaaaaaccctccaaagtccctcctttgaaaaggatgtcaaatgtaaaaccaacaagtggcaaatgcaaagaacggagtgattggaaaggtgcagagaccggcctggaacaaggtgaaaggaaaacagagctcaaggacaagaatcttgagaaaagaacaaaaatgtggcagtactaccccaatgtactccagggaacaaacaccagcatcagcatcaccgtatctatcccctcctcatctatcaaatcagaacctaatcattgctgaaaagaaagcaagtagcccctcacaaacagagcaaaacatgcatggatggttgaatagagggtgattttcagactttcagttcactgctgctgctagatcagttagcagcaataggcaacagcagtggccagagtctctccctgggtcctgagtcctgactgtgttcaggccaacttctactatctcacatgctcaagtggtggtataatgtatggatggggtgcatatggatctggatagcatcacattcaaatttggaacatgaaatgatttgtgtgccagtatcaaagcaaccccttccttgccatgttttaaactggagtactactactaaggctgtgttgggatatgctgattgggaacttttcccctgcataggaaaggggataactcattagcgcataaataattaagcattagtttagaaaactttaaaaattagattaacataattttaaaagcaattttcctatattttttataaaaaaatacaccatttaatggttcggaaaatgtgcgcacgaaaaacaaggaagtgaaaattgggagaggggactatagaacacgacctaagctgangtattttcggccattcgttgtggtaactttgtgacatgcaggtccgatcctgtcaatttagtggcccggagcgaagctagaaagataggctctttaatacaactctgataatataatgatgtttctaacaaatgtaatacataaaaaaacattcttatcaaataagttgtatatcttcctctcccgggctttctaaatctaagttcctatggcctatgggctcctatatccatagcatacatatatggggttgggccgctcgacttcgagggcatagtgcggtggcacagctcgacctcctcagggccgggcctggtgacatgtaaaacaagacaaatcattagcacataattaattataatattaattactataaacttgaaaaacaagtttaattgattttttagaaaagaaacttctactatcatatacaaggttgttttttttttaaaaaaaacactctgttaaacaatttgagacgtgcgctaatgaaaaatgaggaagttgtaacttccaaacaatgaagcgaatggggcctaaattgcatgtatgcaaatgtattaataattgtttttatcttttgcagttaaatttgtcagtatatactcctatattagtataagtactccttccattttgaaatataagcattctggctaagtacgacattatataggcatttctggctatgtgtcatacatagctagaaaatgaaagtgtgtgatattgacaacatagcaccagcatcacgattttgcatgatgttatcttcgtcctctgttttttaagactttacggtgtgatttaagatttttcaggaaattcagccttttgattctttttggagaagaaatttaaagccagatttgagtcatggattgacttttcttttctttcctggcatctgccaaattttgtatattattttagttctattttttttatcaaaaccgtggggacccctcactgtgttttgataaaaatatatatatatagttgaagagttggcaaaaaaaaaatccttttcgataactatttactacaattaacctcaggaggcttgaaaattgaat

SEQ ID NO: 3109 - DNA, 16482 bp, Oryza sativa
ttttttaaaatagttttttggatattgatatagtctctaagattacatatgtttggtctttgtattttcataatcataaatttatttttattcggaataatttatttatctaattttaaaatgcttcccttgttttaaaatgaaatcacccctgctagtatctaaaaaagatgttaacagagagggggactctcattaacaatattgacagttgataagtaaggggcatcggaaataaaatttcttgatgcatacactgagaaatgaaattcaacctatttttaagataaaattaaattctgcttaaaaatcaatgtattttgaatgaacttattttggtaacgagggaataaaatagtgtgagattttgggaaaacaccagtggtatgggggagcagtcatgagtgcatgattccacccaccagaattaaaattataattcccacgaattaatattaggcacatgtaggtgggtttccatctcttttagagcatgtattaaataatgcatttgcatggatgtgtgtatgatgttacttgtgcagtggtgtatgtgcatatgtgtttcccgtctaatcgcaaaagaaaaaagtagtactcccctatctcagaataagttcatttttcactcattccgcacataccaataaaaaacaaaaagactagaatgtccataatctatcaaatccaatgcaactatccataactttatctacagccaatacaatcaaattcctatttttaaaatcgaatgcaatggttaatctaaaataaaattattatgagataaaataaatgagctaaaaataaacttaatataaaggaagtataagtataatattattgttaggattatacgatgggcattgggccaatgggagcgcttctgtaaagagagatcggataagctttggaggagagggagcaggtgggtccgggttggcagtggggagtccgaccgagcgacagagagatgcacactgatatgccccacgcgtcgtcacgagcgctccctactccctctctgtcacgccgcgcacagtttttgtgtctctgtggtccgctcctcatcctcctcctcccctctccctccgatccaagcacgaatctcaaatgttctattgagatcaaatcaaatcaaatcaagctgaattcaaaacaaaccgtgatatatggagtatacattgtcttttttagctggactagctaggctaagctaacaaaagatggaggtgcagtctttgggcctcattatttggcttttttcgtaataagtcaaaacggcttattagagaataaaaataaatttgtaggtaaaactttaatatatgtgttctcggtgacttaaaagtcaatgctgaaaaagaaattacgttgaaaatatctcaaaatcaatgtcaaaattaaatttgaaaatttaaattttggccttttctttgactgaataggccatccgatgggagcctctcgctttgcacaaagcttggagtgtttttggtaggcccatatatactgcactcccttcgtcccaaaaaaaaaaggcaaaccctgggtttccgtgccaacgtttgactgtccgtcttatatgaaattttttataattagtattttcattgttgttagatgataaaacatgattaatactttatgcgtgacttatctttttaatattttttcataatttttttaaataagacagacggtcaaacgttagacacgaaaaccagggtttgtttttttttggacggagagagtatgccattagctttggtagctcatctaaaggaggaggtcaaatatctacatgcatggtaccctatagtagtaggatctacagaaagaattccaaatgataagtagagtactgtgcagcctgtgcaagctagaatgctattagtgttttctctaaaaaaatgctattggtagatcatatggctaggattcaattcgattatgcggtccaatttataacagcgcccatagctacgagctgctatgctcattagtatttgttctaatcatatcacaatctctatactctaattaccttatgaaaagaggcccaatctagctatatagtatatgcaagtacttaataatacaagtgtgttagctagctagaatgctagtagatcatgtaggattcaattcgatttttctacccggttaataacagcctacgagctgcatgataggtttattgtttgtagtgatcgttaattcgttaccgcaatctctacccaattagtaatagcttctataaaacccaaaaagctttgttctttcattcaaaagagttgttgatatgaagcacacgtggaacgaaaaggtcagaaagctttggcaaagtgaaagacgtgcacaaggaaatttctgacagcctctcatcatctggtctatggttgatgagccgtggaaaacttcatgaagtaattaaaagtaatttattgatagcaataaagctaagtctgaaaaataaactataatagaaacctcaatatcaacttaaaattaagtataaaatttaaaaattttccgcggctcaaacgccaataaaaaaaaagaaaaaacatcaaccttttttattcttgttgaaaagtactgagatgtttcctcgcaaaaaagggaaaaacggagtgatctctcctatttgcagataataaacatttcaaatcaaaaaagaaaagtaattaatcttctagctggtgttatgttacatttcgctaaaagaacagaggggatgctcggctgcggctgcagcaacagcaagcagcaaaacctgcttccatgcaccacaatcacagtcgaggactggccaaatgaagtcttgctttatacctctcggtacagaacttggagaatcacaagcaggtggggctaatttgaatgattgctaaataatgaaggaatggtccatgtacggttataaaaattttaaattcaaaactaatctcagtgttctctactttgataaaaattcaacaactcatggtgcaaggttaatactcctgccgtaccatatcacgtaccatcatcttaggctgagttctactctctccatctaaaaaaaagaaggcaagataggtgatgatttgataccactcaggataataaatatggataagaggttgtacaaatttattgtcctaggtagtgttaaattctcatctagattattctttttttttctttttgggacggagagagtaagtagctatttggaatagctaattcctcattatccatgaacacgtttctccaactactaaatatgtgttttgtgtaaaaaatttttatgtagaagttaatcaagaaaatcatattaatccaggaggagtgaacggtaggacaaaccaaaccgtggaataaagaataatcattaattttggtactgatccaaatttcccattaccgacatttcatttcctttttccagcttagtactcaaagcttgttctttggttcaaaatagtttttgatataaagcacacgtgacacaaaaaaggtcagaaagctttggcaaagagagacaacaggaaatttctgaaaaggttcggccttttgtaattcttgttcaaacatactgtactaagaccctccccctcccccaaataaaaactcctatttgcacataataaacataattccagaccaaaactgtggaaatttaattatctatgttcgattttgctattcaaaactagccttaaatgtaattccagaccaaaacaaaacctgcaaccccattgtttcccttatattatactacttatcagtgtggcttattacttattagctaccaaatataatttataggtaaaagttttatatacatatgtccttagtgatttgaaagcaaatgtttgaagataaactacaatgaaaaagtcaccaaattaacttcaaaattaaggttaaaatttaaatttttgcttgtatgtataagtacaagcgaaactaataggctattggttcttgctagagaattgaaagaatcacaagcagatagagctatttaaatggttgctaaataatgaaaggaatggtccatgtgggaataaaattttaaattcaaaactaatctgagtgttctcaattagagaaaattcaaaggtttaagggcatgttcggctggtattttttgcagctgcacgatagctagcagcagcaaaactgcaaccgcacaacacaagcgctgcagcagcagcgctgccgcgggaacgacagccaaacatgccctagatgtatctgccaaatggtgtgacttagaggcagatataggagtagggttgtgcaatcccactcccgacctgaaatatctattaaaattgtactttaaaattctaaaaattagaacatgaagataaaattatataaataatactaatttagcactaggcttaggaataagattctggttccatcacaggcgtgactctaatatactcatatcaccgtcttacttgttgtgtatataattatcgcccccgctgcccctgcccaagggcaaaacaatcttgttaccacgttatatgcaaacttgtcttggtctccttcaaaccattacctcaaactccctcaatccatgaaaaaatctcgatgagttgtgctatgaccgtccctaataacttcataagttgtagaacattaaataaactgagtagatgtggtctctactaatgttacttagattctactgttattaccagcagaaaaatattgatttatgagttatactatcaatagaaaaatattctattatcagtaattgagatagtggtacatatacattacaatatatattagaagaaaaagacggtctagatttaatttttactacttatgaataaagcccattatagaacacttcgaataaaccaggttatataaaacccatgtatccattcttgtctcgattattgcattttcctatagagcacatttatcatatacactgattagtttctccctcagttttgtcgaaatcatataactaatatactcctatatttttttccacaacaaagtgattagtagtagtactacatatcctagatttggatgtcaagaaagcctggaagctaaccaaaacaagcacacaaaatcattcataattggtcccacttcccatgctactgtcccagtgtcggagaacaggatcatgacttcatgaatccgagactaatctaaattgtgctttttattcaacaaatttacccggagctttagtttttctttaatagtttcacataattcaagtatttgtaatatcttaattttaaaaaatgataaaacatttaagaaccatccaaataacaagacaacagctaggtttcattttgggacagagagaatagctagcaagaatttacatccaagtgtagtatgaatcaaattttcctcatacacactagtttggcacccattaacacacacaaaaaaagaggatgaaaaacagttcagaaaagaacagaaacccacatgattgatcacaaattaaaagcaaaaaaaaaagaaacaaaaatgaaaaataaaaacgagagagctcccaagaacacattaaaacgcattcttatttctaattaccaactcaaaaagctctcctcgtcgtctcactcattcattcccatggattgctcggatgacgttatcaccacctcctctgcaagaacgcgtggcggtcgttctcgccggactccgacgagcggtcgaggcggccgacgacggccgtcttgaagttgaacgcctcctgcacccggttgcacgagcgctgcatgcccacgccgctcaagctcgccctggactccaccaccaccacctcgctcagcggcacccgcttccggccgccgccggcgccggcgccgccggtctccggccgctgcttcggcgcgctctgcgaacgcaccttcgcctcgaacgactgcgtgttggacatgtagttcgggcagttgagcggcgacgagtggatgccgccgccgccgccgccgccgcacacgctcttggtcggcgtcggcggcgcgtgcgcgtaccgcggcgtgctctgcgccgtcgccggccgggccttctccagcgcgcaccagtcgtagtcggggaagtggcgcgacgtcgggacggcgatgcggggcggcggcgcgccgccggggaggtagcacgggagcggcgacgacatggagttggcgcaccagtcctcgccgccgctcgcgcacccagcggcgtcgagcagcagcggggagctcgcccgccgcgacgacgacgaccgcgacttgggcctcccggtgtccacctccacgatcttggggctccggtcgtacccgtacgacgacgactcgatgctcgccgacagccgccggctgtacgccgccacaccgtgctcgctcctcgtgtcgtcgccggcgcacctctcctgctgcatccatcgccaacacacaacgtcaacatcgaacatatacatggcgatgtcgtcggcgagatttagccagcggcgtaccagcgagcggcggggccagaagggagcgtggtggaggtgcgggagattggcggcggcgccggcgccactgcggtgggcgcggacagtggcctgggcgcggacgagcgcctgcatgctctgcagcgtggcggcggcctgccggcgaacgaggtagccgcgcaccagcgcctgcagcttcaccagcgccttgagcgctcgcagcgccttcttcgcctgcacgaacacacgccatgattaacgacaatggcgacgacgacgacgacgaaaccagagcaagaagacgagcacccgttgcttaccaggaagcctctgaatgccgtctggattctgacggcggcggcggcaaggctgcgcgtgtcgccggcgacggtggcggcgaggacgggagccgagcggcccttgctagtaagccgcacgacggcgacggcggcctgagcggccgccacggcggcatcagccgccgccgcggtggccgcggcgacggcgatggcgtgcttgctctgctcccgctccgtgtcggcgtacaccgacctgagccacgccgcctcggccgccctggcgatcgccgcattgcccccggaagcctccgccgccgccgcagcagcagccgccgcggcctccgccgagtccctcgacgacttcccgaagctccacctcttccccccactcgccggcgcctcgcccttctgctccttcctccctcctccccacatgttgcggaaccaccgcgccgccttgcccatctcgccgctgtcgagcggtggcgcggcgcgctccggggtagctagcgggtgaggagtccgagtgagtgagagtgagtgagaatcgagacaggttttgaataagagagggaaaccgcaggggggagggggaggcgcgtgggtggcgtcgcgttcgaaataaaagaagaggagaggaggccaccaccaccaatgcggcagccattaccggacaaacaaaacaaaaccacctctctctttctctctcttcgcttcctccgtcccaatcccaggctactgatagaaagcaatatgaacagtttatcttttttatctagtggtttagatctatttatattaccatttcagttagtggttatagaaattttgagggagcattattgtaaaaaaaataggtgtaaggtataatcgtcatttattagtgactaaatcttctttctcttttatttttcttttcgataaaatatgagtgatgccaataaaatggatgaccataaattgatttagacaaaaaaaacataaataataaagtattccgtaatcattatattagtaaatttataatttacccttaataacgaacaattcagaccattcctactgtactaccggtagagagtaccagagaatataacatcctagtactatatgagatattacctggtacaatatatctagatataatgtatgtctagatatatagtacagtaccacgtaaggttcaatccactacttaagttaagttgtcatattcaagaacagacggagtaattaattaggcataaatagtggattaggattggacgcagcgataaaaaagggacagtgtaagcccaaaaagacgcaaactcgaaagatttcgggcaacaaatattgagagttgcacactcacgcacaccaaaaaaaagcttctctttttctcgctcacaacgcatttttgggaggaagtagaagaagaagaccaaaaagaacaacagaggctgtactcctactccgacgcatgcacgcgtcatcgatcacatcggaattaccacacggggagagagagatgatccatcagagatgagctggaaaacgaaaaagaaaaagaagaagaggagaaaaaaaaaagattgcaacttttgagagagcgagagaatggaatggatgaatgctttctcgatcgatcggccattcggcccccctccatgagcacttccacagtagaagtagtagcacctagcctttcgcttatgcatatgtttattcatactgcttattagcaaatcaaagagattttttactgtccagcagaatttttggtaccacgcggtactgcaatcgtaaccgtccattcagccagatcaaacgacccacaatcatcggtaccgcgaggtacaggaatccggtgcagggtacctccccctttgttcgcgtgtatggaactagtggaagggcagaattggatttttacgtggttagtcaattttcatagagacggtacaagtccctgacccggtaatctgtctcttcccgatccccttccgtcgtccctggcggcggcacagccaatctcgccggacttcgcttcctccctcactgcaaccaaccgtcgccaacctgcccattcccaacttgcccttcccgtagccggtccaggtccggccgccgccgatttctgggagtcgatctacccctggatgatgatgacctcaatgcaccaacaagaagaggtgaccatggcgactagctcagcgcggcgaatatggcctcgacagctcgtctaccgacgccatcgcaagcctttgttcagggaatcgcatcgctgtggtatgcattggatcgcgagcattagcaaacctagaaggaggggacagaaagaagaaaaaacgaagctagatattgagatggctgaaaggcttttggccatggatcgcacaagcaagaagaaattgggcaagcaaagaaaagagatcgaagaatttcagaagtttatttatgggatcactagttgtaatagtgtcccttttattcaagatagttgacaatttgctcaatgaccgccgatgttaattttgtttaagatgaaacagtaagcttaaggtctacaacgaaagaacagtttacacatcagagcaagaaactacaaactttcagaacatctacttttttactactattacattcatactttcagcaaaatcaagtaggttcattacatatatcaaaagacaaggaactaggtccagaacttggcacacaacataaatcaaactcagcctctcccatcaacatagcagattcttccaatgaatatagcagcaaagcaatgtccagcaggaaagaaatacttcatctctctcatacatcttccgtaaagaaactcagggtgttgtgatcctgtgccggagactgcgtaggtgccaccagccgagatgcatagaggatggaggggaggggacaagttgtgaccgtggacgaaggacgagctgccgtaccgcacaggggcagccgagaggcgagccgccacaccaccgcatcagaggccggaagaggacggcacttggacaccgcgtcggagtagggcgaaaggattgcggcggtgacacggcgtagacttcagatgcggatgcagcgcatgggcaggagactgagtcctcgcgagattaagttcaatcccgatcgtgccccgctctaattcaatggtcaaattaagtttcgtaccaggggtaccggtacctgggggtaccgtttgctggacgggagcagtgctctcaaaactaacctataaatataacttttatttatatgttattaaactactgaaaagcaaataatggtgtgaaataaactatgataaaaaaaatcttaaaattaacttcaaaactaaattttaaaatttaaattttaacttataagtataagcacaagcgaaacaatagaagttggcgatcgagatgaggcggggcagcaacatatgaagatggagatgctgacattgaacgggcacagtatgcaaccgtccaaacagtacatccaaaaaaccgcatatgcatcagcatcacgcatctttcgtgagagagagagagagagagacgaagctgcagtagttacaattacctcagttaacagtttatcaccacgggattcgatcgatggagaaggtcaaagaagcagcagtgtagctcagctcacctcagcgcaagctcaagctggagatcatcagtgacgagatgtgagatcatgcatcacactgatgactcatccatacatatatacagcatcttgactcgtggccactgttgctaacgatctcgtcgtcaccacaattcaccaattctagctagctagctaatcactctgcatcgatagatcgatctagctagctagccatccatggcagagagagagagagaggcaggctggttagtgattggaacaggcaaaagctgtactgtagcagtagtacgatctgatgtcgcagggacgacgtcgtcaccgatcgagcgatattgatgaatcgatcgtactcctccttagctaaagcatagggtatgcatcaaatgcagctggtacatgatccagcctacaggtttctgctagcagatatggctaagccccggccttgcaattttttcagctcttggggtatagtacctgcgaaaggtgaccccccaaaagccgtttaaatacacacacattcatgtgtgtggggaggggaagaacagggccacgttatacacgaaagatgcactcgcacacatgtatccaaagtacaacctcatcggttgaccgagagctgatttatataccaaacagcttattcgtgaaaaataatttatgagtgacctttcatatgagtctatggagttaagtctaagatctgagcggtaactttctcattttctgttagtacgttttctaaactgttaaactatgtttatttttttaaaaaaaacttttctacatataattagtttctttcaaaaaaaccaaaattttgagtttatgatagttataaaccatgtgctcataagctttctcgttttgcgtacaactaagcatgtgttttgtttggggactatgtgggataggatgaaaccatccctgattttagggattgggtgatctcacatacttgtttggtttataaaatgagatgatgctagttttttgtttggtagaatggataggggtggggatgggatgaatgacgtttggagatgttagcaccacgtctactcctagtgaggaaggagcagcgaacggcgggcggtggaagcaggagcggcaaacaaccggcgaccggcggtgtggatggaaggagcggcgtgcaagcgagcaggcacaggcgtgagcggcgaacggcagaatgaggagcggcgcgggcgagcgagcgtgtgtagggaaggagctgcatgagcgggcggaggaggactaacgggcgctgggggagggagcggcgccgggggagggagcaagcggaggaggacggagtggtgccgggggagggagtaggcagaaggaggagcggtgccggggagggagtaggcagaaggaggagcggcgcgaaattaattaaacttgacagcagtactgttcatgtagtaactgcatgggaatttaaacttgcaggtgtgtggacggatggatagatggatgggatttggacggtgtgcgtgaagagaacagtaattaagcagagagcggcaatcatgaagattcgaaggacatggaagaacaacatcgatgcgtctacctctgacgacgctgcagcttgcttgcttgcctccaacgaccgacgcatgcaaaaatatggaaaccaagtactgcatggagtagtagcaattaccgatggttatcgctgtaattagtccatactaagttcggtctttagtgctatagctaggagtacacagctttaaaatataaacagagtgaagatatactaactcgataatggcaatcaaatatatatcgcatatttattttataataacttagaaaatatagtactacaaccaatcaactaaaggaaaaaaaatctaagatggtgcctttcatttaaaaatgaagcaatactccataacattcaccatacaccaaaataacaggcagaacggcggtataacatcggcgttggttgcaagacgaaccatccaactccaacagtgatgccaatcggagttgaaagacgttgatcgttccatgtacgtgagacgtactacctccgtcccaaaataaatcaacttctgtaatttaaactttgtcccaaaataaatcaactacaaatcgaaaaattttatttcttcaataccccttatctacctatccatcaatactaatttgctatttatgagggatgttttggtcctttatcctctcttttaattatgcattgggaagctaggagttgtctctttttgggacaaagggagtacgtgactaacgttgatgatgggcagttgttgacttatcaggctggtgggttgacaggatatgctgctaggagggctagaggtgtctatgtggggtgtgggggtgacacgggctatagctgggtcgatcgacccaccttgtccgatgggtaggttcacctttttgcaaatgcatgaatgtacatgttcatctttgaacgtgacgggttcaaacttaacattatattgaagatattatttgttttgtctgcaaaatagaaatcatatttataaaaacagaagcaatagtcacatagtgcaaaatataagtgtacttaggtacactactagaaaaatcatttgatgctacgaaaaaaaaacgtggcatcaatactaaaattatgacaatagatacatgttgccacaattttaaaattgttgctagtcgtggtaataaatagcgtagtaataggttattgcaacgatttttatttagtagcaataaatttagatgttgccacggaatggatgtgccaaaaagacatattgcaacacttcacatcgttgtaataaaaattattgccaccactccatatgtggcaatagttttgcgcaccaaattaaaagttcaaatattaatctatcatcctatctgtttattttttttgatatcgtgtcttggctaggattcgaacttaagacctatccttcacacgtgctctcttttaccaactcacctatgcatcaattctgttggaaaatgcatatcgttccatttgagcctacctaactgagatttgaatcatagatttgaatatctaaaagatttcaaatgaaaaagttatcacctacaaaattgtagatctcgtcgagagctataatctattatatactaaaagtccattaaacttcctataaacgctatcgagtcgccaagtggcattctaataaaaaaaaataaatccgaccattgattttcatttaaattggtggacccattattttagatcgttagatctatttggcagtaaaaatcacatctggaagctcccctctacaaacaaacaagcgtacgtaatgtgcaatgtacctacgtacttctatatgtttctttctttgtctttatgaaaaattaattaaaaccaaaattattttcacaggcaaaaatgccccacaaatagactttcacctactaggtctactaactctccctctgtcactttatacatcttacaacaaacacttttaaaccgctacttggtgctattaaattagagaaatactataaaatcataaaaaaaaagaagtaatcgattatcgatttctacttaaattgatggatacattgccatgtggcattatttaatctcaacgtcgattttacttaaattggtggacccattattttacaccattggattagataaagcaaaacatccatccctcgactttcaattaaatcggtggtccaacattatcaaccgttagattagattgattaggcgcacctccagggtgaaaacggtcggaacggttggaatcggtagcatctcttcagaaacgatgctcgatcggccggtaactgaccatatttatcatttaaacttctcagtgtcgacattaatacaatgcagaaataaattagaaaaaacaaaatttaaaaatagccaaaaaggtatgatcggaaatagtaccccttatacagaaacgacgcgcggtcgatcgggaatttctgtgactgtttttacctcctcatgtaaaaccccacctctgtcctcccacgtaagtatgtacgtactccaatactttttttagattgttagtatttttaaatagaaaaacccaaacctctctcctctccccacccctatgcgacattcaaatccattaaacatcgcatagatgcttctaaactattatatggcattcttaaagcaaagaaaaatctttgaatttttgaaaaaaataatccaaccattggtttttatttaaatctatggaaatattattttcaatcgattgacacattattttgggtcattagatcttttttttttaaaaaaaaagcccaaacctccttgcatctctcttactccgttgcggcatgcggtgttaaaagtccacctataaacactcttaagatgttacgttgctctcatagatcagataaaatcctaaaaattctgacaagaaaacaaaacatccgaccatcggttttgacttaaacatccaatacattattttagatggttagattgatcatttagaaaaacatcccaaacctccctctctccttgccattattttctctttgttttctatctccttaacaattaaaattaaaattatctatatgggcaaaaaaaacaaatggacctctatctattacttatatcccgttagatatatagtgactttctaccgacttaattaatttctcttaacatgcatacggggtgatgtacttatacaaattgaccttgatacttttaaaacaatctttttcagaaataaataaatgttcttaataatgatgttcatagcatccaacttacaaatatgatctatgaagtcactaataaattagagaaaaagaattttaagtgacatatataatttttttaatcataaatgtactcatctagcattatagacaacaagttgaaaataaatgtgtggtcggttgaagatcataccaataagcatgtggattgcacctaggaatcttaataatgatacaaccttgaggtggccttagaaatatatcaagtcaattccatataagaattaaaggccatgtccattttttttatttttctggtaaaacatgctaacattttaaatcatgagtcctgatgtagaacaatctagaaacatgtactcccttcgttacaaaatataaggcacaaccacccttaacccaaataccaagaaactattattatcacctcctaatttgtatcaccctaataaatataatgcatacacccaatagattagagatcttgagggtggaggattttaaaaaataataatttaatggataagatgtgctaattaattgcatgcatgcatgcacgccttatattaattatggaacatcagaaaaaaatagttgtgctttatattatggaatggagggagtattatttgttataagacacttcaatttagtgataattcacaaaaaatactatgaccactacttcaatatttcatgagataaaatttataacatatacctttaccccatgccataaatgcatttatattttcactctaaattgcaaagattaaagcatttcaaggatgattcatagaatggaactttgaaaaaaaatagggcttgaaataaattgaaaactaaaaaaatgttgctggatttaaaacccattctaaatagaaaaaaaacattttatgaggactgttacaatatatgtgtgtgtgtgtgtgtgtgtgtgtgtgtgtgtgtgtgtgtgtgtgtgtgtgtgtgtgtgtgtgtgtatataacttaaaataaaatcaaacaaaaattgatattattggatttcttttggggtatcgagataatccttctggggagtcaaaataccctaaattttctcataggaaccaccttctttgttttgacataatgctttctcataatttcaaaactgcataatctcaagtaattttattttagaatttatatgttgcaagtgtaattgtaagaaaataactagcatctaaagcacactaaataagcttaattttagtttagaatatagtaaaaatattttaataaaaagtcagccacacataaatatttataataaaattcacacacattatataaggtgcccgcgcatgtgcccgg

SEQ ID NO: 3110 - DNA, 36216 bp, Oryza sativa
  unsure (1)..(36216): unsure at all n locations
tcctgcagccaaaaattatcattgcaatagtacaatatattgctacgaattattttttatagtaataatttggtggcaatagctcaattatcttgtagtggtaagataccgcctgtgaaatgtattttcgtaggtgaaaagagaggcaagtgaagggaggttttttcgtagacggaagaggcccgtctgcaaagatgtctttttgcaggtggcccatctaccctccctcgggatagagtatattgtaggcaggcgttgtaacgacccgcatgtgagttggagaaaggggttctgtgaagatcatttatttagtagtataggtaaataacctcatatacttagtactatttctatcactgctacatgacgttctaatcagcgcctacttaacaagactatatgcatgatatatcgtttcattcttgggctcaaatatatactataggcatggtataaaaaagacgagaatattagaaaatgacataatatcaaataattaggaggggtgaggcttcgaactcagatcatgtatcccaccaccttgtgaagctagccggaagatccctgaaagtttctcataggcatggtatatcatactatcatcctttcgtccttgggctcgtatactaaggtgcgtagtacgtaccatgtaaaaattggtacggtggaattggcgttttgaaaggtggtaggggtactaagcagattgcacattaattaagttgatgcaacaccggtgcgatttggtcgtccaacaaatattcagtagctagtgctgctgcagtcgtagtagtatcaagcaagtgaacggtaaacccgttgttacaaggggtgagtgagtttgatccgtacgtacgtacgtgtagggtgctcgcagccacaggattgcacgggttgcgcgtctgccgccgggtggaccaccggattccaaatgtacggcgatcccacaagttggagtagtacaggtacgcccggtaattcggccggcggccggagcgtacgtgccgcaagatacggtgaaaaaccgtcgatgtcattttaaaccatattattcttttattcttttgataaacttataaaaatgtatatatatttatttagtctttttaccaaactctgatagacacatgagaaatcttatcaaaacttgatgatgttattaaaatttgatacggagtaagatttattttagctaccatatatttctggtcgttgttttctggttgctgtggccactaccgtatacgcatgtagccgtattataataggagtatagaaaaaagaaatggtcacctagctagcaactcgtcttttacagaaggatcctgggcggaatctttttgaagtttggttgtggacacgtacggcgacagcaagcttacgtacccgtacctgcatactcatacagatgacaggcgagcgatgagagagaaaaaggaatcttctcgggggtgacgtcaggtgacgtcatggtccgtttttattcccctccccggttggcgcgccggagcaggagcaggcgacccaccggaccccatccattagcccattggagattaatcaactctccaattcaaaacagggcgcccaagggcaccaccgccatttcgccgtgttaagtacggcccctcaaactctcaaacaacattttgaagcggaggagttagcatgattagttttttttttcgaattaaattaagatatgtgtcgccttatgtgggacaaattattcaatacaaaacaaatttttttaatcttgtcagggttatagctaccacataccaaatagcagttgactaaatctcggcatgacccatcacataacatgtcctatacggaaacaacctgcggatataggaggagttccggataaggaaagacaaccagagctgtacatggaaacgacaagaactactcggattgtatccatattggtttccctagttctatttggacaagaggatacctatgggtataaatacaagaccccctaggaggagaggggacaatcaacatacacggaacaacagaagccacaacatacaagccaacatatgccaagacaagccgccggatatcgacttcagagatatgcctggatcgaccctatccgatacctacagaggccggccgtagggatctagcgctgtttctgatctcaccgggcacggattcgaggaggaagattaccctgttatcgactacgagtcagaccttcaatttagaccgccatgtcggcaacagttagataggctaccccaaatattatacttgtatgatccagataaataaagagcaacaccggcttcggctaacaggatgtagggttattacctcacaattcaggggcccgaacctgtataaaaatccccgtctccatcttttacctcagtctcacgtatatcctagtaccaaaaaatccccatactatgcaaataccggaatcgcgacatcaaacatcgatagtggcgcaccaggtaggggactttggtacttcaggattttgatgagatgggttcaagagatggattctccgacaacaagctactcgacgacttctgctatggggagatttaacccgaccgaagtatgtctcccgttgagatcggaatcatcgtcatcaattatattcgatctggcgagatcgaccaaggttcaagacttcgtcgcggtggaagaccaacggtatcgacagcacgagagattgatccaatatgagtcggtcctattcccaatggggtgtcctcggacacgggcccgatttgaatcgagatcaaacgtcgcactgtcctagccaggttaaggtgcaaacaaatcgttccgcgcgtggcatcaactcctacagctagctggtgcaaggcatcggcccgctgagtccaagctggacacggcatctactatcatcgacagagtacaccaacagacagatccaagccaaaaaaacgtgcatgcatgtttggaccaatcaacatttatccacacagtgcatatgtacaattgctttggtaagatatgtctgggctactcagacaggtgcacagaaggtaattagtgagatcgatttttaaattaatctactaatttcgtagatacatctggcatatatctataaaggtatgcaatattttatctacgaatttattgtacctattcagatcatacaacattgtcagatcaataatttattacgtttatctagagcatgtcttttatacaatatctattgcgcgagtgtccccgatgttaaatcgactacaaatctaacgttgggggctcgctctattttcttctgtataaatcatgcttgtttacagtttacataatacctgatatttacatctgctcattatatcctgataatactagaagacccatgcagttttttgagtacatactcgatattctctgctgtatgtcttgccttctagaaaatatttttcaggaacaattgagcactcgagtaggttgtggtcgagtacaccgcattatcgagaatgatctcgacaaatgcagagtcgtcgcgcccaacctaccaatgaagaccgacgacctatctcatagcactggccgtggctggactattcgagaaaaggatgttaacagataattcctcgtgaacgttgtcggcttgatcgcccgacatgattgtgaacggacatccggatatgctacaagttgggtgtgtgagtcatgctggccacatgagaggcacatgtaataaaccaactctagcgcctccattggtgttcgagagataactctactcgctcgctggttctcgaaccagcacgtagcaatctcgctggttctcgaaccagcacgtagcaatctctcgcaccgcaacttccattggtgttcgagagataactctactcgctcgctggttctcgaaccagcacgtagcgatctctcttaccgcaacttccattggtgtccgagagataactctactcgctcgttggttctcgatccagcacgtagcaatctctcgcaccgcacaacttccattggtgtccgagagataactctactcgctcgctggttctcgaaccagtacgtagcaatctctcgcatcgcaacgtccattagtgtccgagagataactctactcgctcgctggttctcgaaccagtatgtagcaatctctcgcatcgcaacgtccattggtgtccgagagataactctatttgctcgctggttttcgaaccaatacgtagcaatctctcgcaccgcaacttccattggtgttcgagagataattctactcgctcgctggttctcgaactagtaaaacgtagcaatctctcgcaccttaacttcagatggtcgagatacgactacagcaataatgcagcggtcctcgcaccatgacttcagatggttgaggaacagctatgactggtcttcgaccggcagcgtagcggtcctcgtaccacgactccaaatgatcgagagacacctattcactggttctcaaccagtcaatcntancgatctctcgtaaatttacttctagtggttgagttacgactactaactggttcttgactagaggtgtagcgattctcccactatttccaattcaagtggtcgagtttagactactatctggtcctcaaccagcggtgtagcgatttcatccactatttccacttctagtggtcgagttatgactactacctggttctcgaccagtggtgtagcgattctcccactatttccacttctagtggtcgagctacgactactaactggttctcgaccagcggtgtagcgattctcccattacctctacttcaacgaagttgatatcaggtacacaatatcgccaagtgttttacccagagatcccttaccatgatgacacctagcgttgaaacctatcctactgtccgtttacaccgtcttgacaaggcctccgaggaacctaaggggacttcggttggggacgcgcagagccgataaggccttgttggatcctgtagagacaaaagaccatgtaagatctggtcgtgtaagagttctgaaaaaggtaagatctggtcgtgtaagattgactcagataaaccctttatatgcccgcacaaggctgaaaaaggaagtcaaacgttatctttgaattcaccgagaacggtcacgtgagcacgataacagttactccaaggtctgcgcgcggttgagaatatgaattcgttcatttgcatcgaagtcgggggctattgtcagggttatggataccacatacctaatagtagttaactaaatctcggcatgacccatcgataggatttagttgactaaatctcggcatcacataccatgtcctatacggaaacaacctgcggatataggaagagttccggataaggaaagacaaccagagttgtacatgaaaacgacaagaactactcgaattatatccatattggtttccctagttctatttggacaaggggatacctatgggtataaatacaagaccctctaggaggagaggggacaatcaacatacacggaacaacagaagccacaacatacaagccaacatatgccaagacaagccgctggatatcgacttcagagatacacctggatcgaccctatccggtacctacagaggccggccgtagggatctagcgctgtttctgatctcgccgggcacggattcgaggaggaagattaccctgttatcgactacgagtcagacctttaattcagaccgccatgtcggtaacagttagataggctaccccaaatattgtacttgtgtgatccagatgaataaagagcaacaccggcttcggccaacaggatgtagggttattacctcacaattcagggacccgaacctgtataaaaatccccgtctccatcttttaccttagtctcgcgtatatcctagtaccaacgatccccatactatgcaaatgccggaatcgcgacatcaaacgtcgacaaatctaagatttaataaaatcattttagtattaaaggcgttgttaaatttttctataaatttaatcaaaatataagtttaaataaaaaaaagtcaatgcaacttgtataatactctttccatctacttttgatagtcatatttcatcttgacatacagactaaggataagtaattctacttatcattaatttaaacatgctactagtcattcctcgtaaacaagcgattcattaatatttacatttttcgatacccatgtagccaatcatgtgtggaataatggagagtcatgtattaaatccgagaaagttattaagaggatatgttgttggattgaaatatgcttataaaaatagaattttcatatttagaaatataactattaaaagtagatggagggagtagttactactcaactataagtttccgtgtccaactttaataattcgttttatttattttttaaaaaaaaactaaaaaaataagtcacacataaagtacaatttatgttttataatctaataacaataaaaatactaatcataaaaaattaaataagattaactattaaagtttgacacgaaaatttatggttgcgtttagtttgggacggacggagtagatctaagctcatcgctgaagccaacagagaagagaactgggagaaattaaaaaaaaaagaaaagaaaggaagcctgtgaactaacgatggtgtctctgcccgggcgggcggcgcgacacaatgaaggctaccaccgatgtttgcgtgcgagcgagcgagctcccaaagaatcatgacgacctgaggcagacaggacaagttgcattatcatgcaggcacgtgcatatatactgtacatgccacgctcatgccgcccttgctcttctgttgctcctttttttttctttcagtttagacaggctgcctatacaactttagtcagttctggagtgaaacactttcaaatatcatcattatataatataattatgatgtaattgtatcatgttatagttacaatataatgtaatttgtatgcaactcacatacaaaaatacatctgcgaggttggggattgatcggtgcctttgtaaattgtaattgtttttgtcaagaaaagaattgttgatatttttttagctaatctgttttggatttgatttgcagttgggtacttgggcttggtctgatctcaaccaggaactgtacgagttgtacgactttgtctctctctaaaaaaactgaagctgcagggattttggagtaaagtctcctatctacaggaatgggccaacgatttcggcctctgaataagcttgggccaacaatttcagcctctgaaataagcttgggccaaaccatggcttgttttgttcgactggaccttccgctgttcttgtgattttttggaataagttcactctaggtccctccattgtcctctagtcttattttccattctcagtccagaaaactggatacaacacatccctcaacttacaaaacaatgcaaacgaggtcccttggcagtattgaccctagttttagctgatgtggcgcatacatggatcagttgactaggtcttcgttgccaaatggcattgacgtcacacttacgaggcaattcaatgcgaaataataataaaatctgtgaggcccacataatcagttacaagaataaaaaaaataaaaaaaagtgggccatgtggctccacatatcatcctcagtactcccctctcctctatatccttcaccttttcctttcctttttctttttttgtcttttcttgcttcttcccctgatggcatccggcgaccagccgcggacgacagagagaagggtggccagcgggagcgccatgtcaggggaaagggagaggccatcgcgcaggcggagagggacaggtcgaaaaggtcggtgttgatgtcggccatagagcgtgcgagcttggtggtggagatgaagccgtcgccgtcaccgtcgaaggcccttcctttcgacgacgtcgtcgccgccgccagcctccctgccccctcactagccttaccgggcggaggtcgaccgagcggatttagttaaacggttttaaaaaattgttgaaagattttagatttttagttgtaattttaacatttgagttgaaattttttaattttacgatggaagttttgaattttaggatgaaagtttcaaaacttgagttgaaaattttttaaatttaagtttaaagttttgaattttgagatgaaagtttggaatattgagttgtaagtttcagagtttaagttgaaattttcagaatttaagtagagttttacaatttctggttaaaagattcaaattctaagtatagatttcttttttttttttgggtaaaaaactgcaacaacagtttgagaaaaaaaaaaccgcaggaggctcgtcaaattaagcacatggattgtccgtgcttattggaaaacagataatgcggaatcagtaattagcgctaatcgtgattttgattcttgtcgtttccaaaggtggcccaccaggcccaacatgcacatgcgcgtgcgctggctgccagcacttattcccttcgttaaaaaaacaataaattaaataaaatcttcgctatgtatcaggacatcccaatgtccacatacatagctccaatttggctgtttttggatggagggattatgtgccatataggattttcggagtttagtctgatctcaacgagaaaactataagaattatgcttctctccgtgtgaaaaaacaaaacctagggcaccgatttgtagggaaaacatatgaaatttgtacgatttgaatcataaatttcctattcgattcattgaaacaaaagattgagactgaacaatcctatgaaattcctatggtcaagacaaggaggttttgtagaaaagttagcatgagatccgacccccataaaaaattaactttgaatctcttctctaattcctgctgtttatccaaacagtgtattcatatattttttcctatattttacaattacatttttggtacctaatttttgtgaatgggctaacaatctcggcctctgaaataagattggaccgaatcatggctgcacaattgatcatgatcagttttgttggactgggccgacacggagatgcaggtggccggcccacagacctgattccgatgtacacaagtcggcgaagaggaaacaactgattagttaatgcatcatctcaattgcaatttgattactgctagtcctacgtataatagagagcaaaaacgcgaagaaaagttggagccgaattcgatcaaagcaaatggtgtacttggctttcttattatcttttcatcgttaatttctttcgctgctgacctctgtgcttctttcactgctacgacaccgatttttccgggcgggctatccaattttcgcgtgcgggtgggcggcccgcacgcacccagtcgtctggaaaaatcgcgattttcgcgtgcgggtggcgcacccgcaagcgaaaaccaatctttgcgtacgggcgctcgcacggagaaaaaaaaagaaaaaagaaaccctaaccctaaccctagtccgccgctgcctagccgaggcccgccgtcgtcgccctcgtggtcgccggctacgaatccgccgctcgctcccgtcgccggcgcaaatgaaccatctcagaagaacacatctcacatctcacaagaacacacatcaacacatctcatatcaacaagaacacatctcacatgaacaaatcacaaataacaaagagaggagggagagatagatccggttgccggtcgccgacgtatgccgctgctccgccggtcctccccctcccctccaccggatctgcaagggagaggagagccgcgcttcgccggccggatccgccgccccctcccccggatctacaaggggaagaaggagagggggcgggcgccgccggatccgtcgccgtcccctttgcctgccgccacgcctctcgcccgccaccacccctttcgccctccgccgcacgcggccggatccgcccccccccccaagccttccctccgccgtatctgcacggggagggaggggagggggcgcacgccgccgctgccgctgtgcatcgccgccgccggatccgccgccgcccccttcgctcgccgccgcgcacagccggatccgccgccgcctcccccggttctgcaaggggaaggaggggatggggcgggtgccgccggatccgccgccctcttcgcccgccgtcatgcactaagggagagagggaggggcgcgctgtgcactgagggagagagagagagaggagaggagaggagagtgggagggaggagtggagtgggagagatcgagggagagcaggcagagggaggtgggcggccaggttaaatgcggtggaccacgcgggtgtgcggttggcttaacccgcccgcacgggataatgtgttatcccgtgcgggcgacatcctggagcctgtccactttttttccatgcggttccacttacgaaccgcatggaaacaaaaaagaggggcgtccaggaaaatctatcctgtagtagtgtttttcgcgcttatattgtgaaggaaaaaagtacgaattacctctcgaactatgacaatagtataaattacccccctaaccacaaaaccagatattttataccctgaactgtctataccggacgaatagccctcttgacctaatccaaagcggtattatcctacgtggcgtacgcgtggcagatgaatagcccaccattgccgaacatggcaataacctaccgtaatctatattcacaattcttgtgattggtaataaaaatgaaaatttaaagtacacaacctttatccttaagcttagctcttagtggttcaaggcataagaccagcggcggatttaccgcccgactagggcgggcagttgcctaggctccccatccacgacccattgagatagagtgacttttgtgcaacaatttgctatcttcccggtcaaagtgtgtcgacgagtgatactcgcggaccggatgaatagagtatcgtggtacgttggaacaggggtctacgtagtacgacatcaaaacagacaaaagacaaggattatactggttcaggcctcttattaggtaatagccctagtccagtttatatgggattgatgatgatgagaacagattacaaagagagtaaccgaaacaggcgatactgacgagatcgtagttgaagatctcgacgagatctcccggcgagttggctttgtggactccggcttcgtaaactttggtggatgtgttggcgatgagatgcgatgcgctttgcctctccctaggggtcctttttataccgtggaataccttgaccccaagaaagacttagagatatgtaaactggcacggtataaccaaagattttatcccaagattttatcccctccgagtaggattccggctattcattaactcatagagatatttttcataacttgagataaatttccaacagcgtatacggaaataagccgtatacgtgaaggtataccttatcggtatatttcataagtcgtaggatatagggtatgtcttatctgtaaccctgataaagtgtaatataggcacttcatagagtatatggatttcatactttagaacgcaaataacaagatggtgcctgatttttcctgttccatgcatgcccgtttggttgagtctgtttgtgcatgtacttgaggccacaataattagttatgtgaattaaaacacctaagcatcaatgcatgcaggagatcgcgcctactaagggtctgtttggcacagctccagctccagctctacccctcctggagctggagctcagccaaacagtttcagctccaccaaaactgggagtggagctgggtggagctctctcacaaaatgaactagagttgtggagctgggttnaggcagntccacaactccactccagacccaactcttggagctaaatttaggagttagagctataccaaacaggccctaatagtccattgttttcaataaaatagttttactttttttaaccgtaatatgtgggtaacagttttaattagaattaccccggcttcatgaaaatcttgcctccgccactgcataagacccaaaagaccaaaagggacgtaagttacaaaagacaacagaaatctaaaactgaaaatcgagagctcaaacactgcatctactttaaataatactaataacaatgccatgcacgctctcctatcttaaatttttattctcttactatttgttagtaggatgttgatagcatgacaatgcaaaaggcagtgttttctcacgtcagagtgaggtgccatgaaacccttatccacctaaaatatctaatccaaacccggctgctattggctaatggctattccgagtccagaacgaggggagtccaggtcaaattccttgaaaccggcctcttctctcgcagccacctgctttgtattttttttttttgcagagccgtacactaggattgtccaacgattttggtttgggagtatgttgagataattctcttttgttcttctagtcttttagaacagtagctgattagtttgttggtttgactcaactaacctggctgctgctgctatcaaatttaagtctttgcttctgtccacctacctctgtcctaaaatatagcaatttttagctatgatggacacacagttatccagattcataactaaaaatacttactccctccgtttcacaatgtaagactttttagcattgcccacatacatatagatgttaatgaatctaaacgcatatatatgtctagattcattaacacctaaataaatatagataatgctagaaagtcttatattatgaaacggatgaagtatattttaggacggatggagtagctccaaaatttgtgtgtagggaatactactcgtatctttttgactataagcttttggtctgaacctgaagacacacttctcaaataggagtatcaagacaataaattccaagcaactactactataaactgtgtgttcaactgccaaccgcacaagtattgcttttcaaaaaaaggaggaaaaacctatgaacttatattgtgtagtctgtgtattccaattgtttttaacaaaaaaaaatgtattctaaccgtataatattagccatatcacttgcgccctccatctttaaatccatatataaatgcaaacttattttgagacaaaggatgtagcacatgcatgactaataatacaggctgcgtgcgcatttgtttacgacaacaattgttgttgtttcatataaagatcatataaaattttgtaaggaaaaagataaaaaaaatcactaataagaaatgaaaaatccatacgtatcataagaggcctaaatttctgccgtatactgaagtggctcataagtcaaaggttgcagcttacatcaaaagtagatagtgaaagagatgtagagggatcacgacataggatgagatatcaccttcagataggccttgtatcactagtttactgctcctgccatgtgattttttataacacgtactcatagtttagtctaaaaactattaatgattaaactttaatcattaatctatcataaaatattttcttagatacatatatatactactctgtcaaaaaaaaatcctagctacaaacctggacatgtttatatccaggtttcacagctaggatttaattttttttaagtattcacatacatgcgcgtacaatattcgtatgaacacgcgcacacacatcgttaactcaccatatacatctcattgcatgacactgagacgtaaatacgagcataggggtcattgaaagaataataacaaatcgtaaatatgagcactcgtgtcaagtctaattcataaaaaatctaacaagttaagttgcctgttttcttccaaattataatattaatagctataaaatctttttttactggttaatagctataaaatcaatataactatataacagaaaagtgctttttaatatagtttttcataacttttaagttaactaaaccattgatcaaaatttataaataaatcaagccaaattgtgtttccgtgaaccgaaaagtttcacccaaaaaaaaaacgcaaacgcaaaattgcagtcaaacccagggggtcaaccgaagcatacgtttcccgtgggcagaggtgaattcaaagcaacactctttgcaacgccccccttatttttcaacccaatttcagtcatttattattattttcttttaaaaaaacccttcgaatttaagctgacgcgacgccgcgtcacccacccaacccaaccccgccttcttcctcttccgcctcgaactcctcttcctcccacgaaatccctttcaattccgccaccgctataaattcctcatctcctcctcctcctaatcccagagacctgtgtacgcgatcttggttagctccggcctttgatcttgaccaccaatctcgcatttcttggatcttctcgtcttcctcactcctcgatcgatccatcgattggttgctggtcggagaccatggtggcggcggcggtggcggcggcggagcaggtggtggcggcgctgcgggaggagtgcgcgacgccggcggcgcggctggatggggtggcggcggcgatggccggcgagatggcggcggggttggcggaggagggcggcagcaagatcaagatgatcgtttcctacgtcgacaacctccccaatgggtaactaattactactagtaattatatttataatcactaataatcacaggtcttgtttccttttaattactgtttcatcatccacttcttcttttagctctctcctacttggaaatttcttagtaattgtgtggttcttggatgccatgaacactttaatatcagcagctacagatgattcggatactctgattgaaaataaaaattggtttgtcaggattaatttgcaagctggtttaatctcctttggttaagtaggtggtggttaattgcatgataatcacatttttagtaggtgttttttctcccaatttggtttcatgtcggttggtaacatgagctatcgttggcttgttgccacctgcagtgagctgccagtgacacagcgtcgtgtgtcggggccaagcaaattgggattagattaaattaaattaaattaatccctagaaggctagaacataatttacctactctttttttttaaaaaaaagaaaaagttaccgcgctcttgcgtgtccatgcgcgtgtcaaattgctcgcactcgtgtcacctgctgcggcagcacgtgtgtgaccccgtgcaacattgcgtgtcagcgtgcgagcgtgtaaccgtgtctagttacagcttgccgatgccaaaaaaaaaaaggcagaaaagttttcttgttaagatcagcagaaaagttttcttttatttgttgcgattagcaggaaattgttttcttgctaagctcgctgccaagacagcataactgcagagcatcaatgcgtgtagtgttactgcatttctgtagatgcaccagctgagacttttcgtttttgtatgattagcggaaaatatcttttgctattctcgttactaaaacaacagaatagtggaacagcaatgtgtgcggtactgtatttctgcataaaaaggtaaaaaaaaagtttccattttttttaaaaaaaaatctgtagtttgcagaaaaaggctttttgtcaagtttgctgccagaatgacataaatgcagaacaacaatgtgtttatcactgcatttctccttttctgttttttttttttttgtgaatagcagaaaagggcttaagcaaagctatctgccaaagcaacaaaatcgcagaacagcaatgtgtgtattactgtatttttcgtgatcagcatgactaacaaccttttgttgtgctaaataatgtaggaccgaagagggcttgttctacgcgctggatcttgggggaacaaacttccgagtcctgcgtgtgcagcttgctggaaaggagaaacgggtcgtgaagcgcgagtcgagggaggtctcgatccctccccatctcatgtccggcaactcctcggtgagtgagcatgtccacacttgtttccatatagtatcataagtttttgggtgaattggctagtatatatcatagtaaaacatcacatttagtctcattggatgaccatgtttgtaatgttgctgtgatgccaatctcaggagctgtttggcttcatcgcttccgcgttagccaagttcgtcgctgatgaaggacataatgccgtgttcaacgacaggcaaagggaactggggttcaccttctctttccctgtgcggcaaacatcgattgcgtctgggactcttatcaagtggaccaaggcgttttctattgatgatgctgtaagaattctcttgatttgtcagttttcccacatcactgcatcagttgttatctaaaaaaacaaattcacaacatcaatgtcacagcgaatctgtttttcacattgttatgtgaaatgctgtcagaattttgtcattggtttctttttctgaaattagtgcttctttggaatatgacaggtaggtgaagatgtggtggccgaattgcagatggccatggagaagcaaggtctggacatgcgcgtttccgcattggttagttctgaaatgatcagttccatatcatttttgaacaaagcgaaatttgttcttatgataagcttgacattattttttgactgtttcagatcaatgacactgttgggacattggcggcaggcagctactacgacgaagatattgtcgtcggtgtgatcttaggcactggctcaaacgccgcatatcttgagaaggcaaatgctatccctaagttggaaggcgagttaccaaaatcaggaaacatggtaaggattagatatttctcaaccgaagtaactggcatgtactgcatagaatcatctactatctgtatttggatttctttctcactgtactttctgaatttcaggttattaatacagaatggggtaacttctcctcatcctgtcttccaataacagaatatgatgaagcactagataaagagagcttaaaccctggagagcaggcaagtttctctagaagattgcatactcctcacatgtcaaaagttttacccacattatatagaactgctacctgttgtctaaaaaaactatgacttgtttttttcagatcttcgagaaattgatttcaggaatgtatctaggtgaaatcgtaaggagagtgcttcttaaaatatctttgcagtcttcaatttttggcaatctagatcagaccaagctcaaaacccgctttattctgaggtatatttctcgctaaactcagttgtgtggtaatcttaatctataagctaggcaaataaagcatgatttgctgagaatatctataggatcacttggagtttcaccattgatccataataattattaggcgcaaaacatatggctttgcaattttccaaaatgagataagcaactttgaaaaaagatgtgctggcttatcctctctctcattatattcaggactcctgatatttccgtgatgcatcatgatggaacacctgatctcagaattgtggctgaaaaacttgcagataacctgaaggtaatcttcatcagtaaatccagcattgaactgtattccctctatccattttatgcacaatgaacacattacacggcattgtccacttttaccacagatcacagacacatccttagaaacaaggaagatggttgtcgaaatctgtgacatcgtcacccgaagatcagcccggctggctgctgctgggatcgtagggatcctcaggaagatcggcagaggcgtcccaggcgacaagcgaaagtcggtcatcgccatcgatggcggtctatatgaacattacaccgaattccggcagtgcctggagaccacgctgacggagttgctcggagaagaggcgtcgaagtcggtggctgtcaagcttgcaaacgacgggtctggccttggagctgccctgattgcagctgctcattctcagtacctgaattgattccccatagacagagttccaacttttattagtgactcagtgctgttgttatagtttatagaatgtggtgaagttctgtatgtttcgaaggagcctgatggactctacaaacaaaattttcagaaatgaaatcgaagccaaatgtgttggtggtgttgcaatttgcagtatctactctgaattattataggagaaaatagttctgaacttttgttgtaccggataaagtagttctgaactttgttgtcggttatttttggttcagtacttacatcaataattccttcatatcacaaaaaaaagtttgtatcaacggatttaaattttgaaatatcaattatatgattcttttcacccatcgttgcccttataagccacggtcaaaattagaattttaaaacttaattttggatttaattttaagacattgtaatttatgtcagcactgataattttttttttaaaaaaaaaggcttatcaactgagactccagctacaaacttaagtctgctaggaatataatctcagcgatcggactcgaggaagattggtagtcattcagttcgcgctaaatgaacctttgaatacacgaagcaacatcatgaatagaagcaccaccgtttagcaaatatataagatcggtcctccataaatgtgtcgaaaatcaacttaaagatgtgcattaagcccaaggaagtacaacaagagtcatctttttttgttcaagcatttccactgaaatgaaagcatatgttctcaacgtgactgcttgtctgaatgtaagcacacaaaatcactcctccattgcatcaccctctgtcacctctaccttcggcttcagttgtgttatctttgtggacaacaccactgcgagacgagagaagaaacacgaatgagttcatattgctgaagcatttctatcaatatgatgtaacattaataagacactgaccagtctgccccttggtgaagttgtaccccttcgaactaacgtaagtccttggatttggtaactggtggtttctcaagtactctgtcttcccctggtaatgttaacaggaggactttgttagcaaaacagaagatagaaacacgcgtccacttttcaagcaacaagagcattttaaagttggttcaatcaaatattctacccctgacgggaagattatagcatagaaatatttggatttatttttggcactgcaggtatctatttatctaagactattgcactttccgtaaattattgcatagagcaaccaaaccgaaggaaacgagtgtcatagattattgactagagcaactgaatagaacgaaatggacatagataactgaatgggaatttcagttcacaggaaattatatcaagaactgcaaccatgtgtgagaaagatagcatacacggacaaataaattgccacaaccatagtttgcctgttaatgccatgcaataataataataataatttatgtaccttggtgattacgcaaacatccacattgctgccactgcccaagtcattgaagataccaccacgaattgcctcagcaacaagttgtattccctcctccctctagagaatttaagaaataattagaatgatataaaacataatgaaaagatatgcagtatcaatatatgtaaataaaaaaaggtatagagcaatcagcaaatgctagcctgaacaaagaacaaaattacactggttcacttactgtgaggccttctttgtacttcgattcaaacactgacattgccgcaagggatccagaacccattgtggcaaaaggaagagtgtccgtggagccatgtggataaacctatatgattcaaaagattaacaaaactacccaaaatttctcttaacagatatttttaacagacaaccatactcagttactcacagtgtgcaggtgtggcccagtaacatctactccaccaagaacaagggcagcactgacatgaccttggtagctaaaacataaggaagaaagaaggtaaaacgtttgcaatgtatgatagtctagctgatgacgcataaacatttgcaatgtttgagagagagggaggcagagagcaatcacctaaaaaggtgcgacttcagtaatgtaagagaggttacaactctggactcacgaccagttgcataacggtgaagttgaagctgggaactgaccatatctagagttgaaacaaaacaagttgtatttttcaattttttttataagacagagaagcaaactaatgaaacaactgggttggagtatacagtccacaactatttttttctcttcatgctaccaggataccataattaatacctgttacagcctcagtgtcagcggcagttcctgctccacagcaatatatgtttggcgccatataatgaattttctcgcagttcttatcagcaactataggaccctcggtggccctcgtgtctgccccaagaacaacaccatcctaagtagaaagcatagttacaccaaagttaactcagcaaattattcatgatgagcagaaaaggatgccaattagatggaacgaagcatggaaaacaaaatcatccatcaaagtattaacaactaggagactaggagcaaaaatacaataggaggttaaaacaagcaccatctacttccctgctgaaagcaactgcaatagccaatgttgccactagaaatctcctctggtaatccattattctttcaggttcaaaaaattttacataaacagaagcataaattcgtgcggtgcgcacatactaaaaactatagttgaggggaaaaaaagctgagaaaactaatgttacagcacaattcagttatatccattatccttatgtccataaagttttatgattcccttgattgcacacaaattaaccagcacacgcaaaagaaaaaagaaaaaaaaactaagagtaccagttagcagaacaaaagagtacctgaaagaccaaaccgacgatggtagtcccggtcttgaggaacccaggcatcttcaagcccttctccacaagcatggcgttcctcgcgcaattgtcgtagctgaacccgcccttcggggggagatccgtcgctccggccatcccgcgctgtcaccgacgaaacaaaaaaaaaatcaaatcaacatctcgcgcacatgaatcacttccccctcgcaaccaatccaccgccgccacaacccctccccacacacacacacacgacacacactatacctcccaatctccctaatctcgcgaaacagcgagcagaaacaaatcgagaaccacaggaaatcgccgccacaaaaccctaaaatcccaacgaagaatcagtggggagattttctccgggggacaaactacctgtcaccaccattactaccaagatcaacaacaaaaaagggcaaaggtaaaagtagcttccagatctagggaggagaagctagggttgaactaccagtctaggttcgcaaattcgtcgagagagaaaaataaaaaaaataaaaggtgtgaggaagatgtaacgagcgggaggatgctctcaccggcgaggatgcggcggcgggaggaaaagcggcagggtggagcggcggcggcgccggcgatggtgggggatcggagattggggctcaggcgaactcggcgacggatcaacttgggtaagggggcaacaaggaaggggaaggcgagagtcggaggcctagtgtactacgggcctttgtataagggcccaagtctcaaaacacactgaaatcgggctcgggtttagaacgaacgcaacgaagtaggagttggattgggggagaagaaaggaaaaaaggacagggacggctgctgcaatattcgtgctgggcatttttttaattatttataattactctctcagtcacatctcataaggtgtttagattcagggtgtaaagtttcggcgtatcacatcgggtattatatagggtgtcgcatagggtgttcgggcactaataaaaatactaattacagtatccgtcggtaaaccgcaagacgaatttattaagcctaattaatctgtcattaacatattttttttaactgtagcaccacattatcaaatcatggaacaattaggcttaaaagattcgtctcgcaaagtagttgcaatatgtgcaattagttattttttagcctatatttgatagttaatgcaggtgtttaaatgttcgatgtgacaaggtgtaaaatttttgggtggaatctaaactggccctaagtaattttgactttttttctagtcaaatcatttcaagtttgatcagatttatagaaaaatctagcaacatgcaccacatcaacatagtgttattaaatctaacatcaaatatattttaataatatgtttattttgtgttaaaaatattactatattttgctataaacttagtcaaacttaaaatatttgacaaaaagaagccaaagtaacttgtagtagggagttttttttttattttgatgggtttttttctttttcctacgcctacactacacacgatcaagtagcgtacattttgatgggtacgtaataagctttaaagggactatctatttatttatttttcttacagatttaaagctttaaattttgcagaattttaaccaatggatacaacccatttcttctaaattaaataacctatcgatcggcggctgtccctccaccgtgtgcctcgacatcgtgctattgctggtgtacgacagcccaagttttttttcggccgcttcgtttcctattttggcccacgtattttcggcccattaagaaaaactgttttatttttgtaaattttacagcaaaccgaaaacgattttgctatatatttgtcgacaaattttctcccaaaaatttgacagatgtaattacagtacaatcgtaatgtaattacactgtaactttcatgtaattacactgtaactatatgtaactatagtgtaacttgtatgtaactctcaaaaatatctctgtaatatgttatttgggtaaaatggaggttgtgggaacaaatccttacacatatgtgtgtgctgtgatttttttttcttcctcaccaaaacaaatcttgtaatagatttaacgattcaaaattacgtgaaacttatatacaagttacactgtagttacatgtaagttacactgtaattacatttaagttacattgtaattacactacgattgtattataattacatttatcaaatttttaggagaaaatttgtcgacaaatgtataggtggtcccaatagcctaatactagtactaacaaggaccgtaaaaggctatttattcttctctagataagcaatcatcgttaaaaataaaaccagaatattataattgctctaggactatttagacaacaaaatatagtgagtaggagtataattttgaagatatcttctcgaacaaccgaacaataccacagataacttcagagggagataacatgagagtttcaggctttcagctgatagcagttaaaacatttttctgaaaaatattcattttgttcttttcaccatcttctaaaagctcagaagaaatcctaggctgtgttgggaattaattcctacacacgaaaaacaatatagtaggttagtacatgattaattaagtattagctaaaaaaactaaaaatagattaatatgatttttaagcaattttttaatataaaatttttgtaaaagatattaccgtttagcggaaaaaaccaagatttgaaaccatttccgttctaaaccaagtgtaactgaatactgaatctactctgaagtctgaaccgagccaaactcagatgaacacacataggcctgaccgctcggacgaataactacaaacactcccaaaatcaacgtgcgtttcttgctctccgaaacctgaatcgacgattgcgaaagatgtgcagatgcttcacgagaatcgcaagataaaacatcaaccggcgacactgacaaagacacatcactcagcatgtccaggattagtagcttgcaagaacagatgaacttgatcctaattaatagtactaacaatttccattctcgattacatcttgtcctagtcgtagtcgacaacatcatgatccccaaaaaaagacgcttcttgcgcatttttgtacacaaaaatcttccaagaacgcgaagagaaaaggattaaaaacaaaacagagagctatcataatcactatgcagatatgcttcctgctctgctcccggcgatgaaaaaaacaagatcaagatcactcggcagctgccctcttcctgctccctgctcgtatctgcaaaaacaagatcaagaacaaaaatcacgggtcagaatcgatcaaatttctcaagaaaaaggagcagaaaaccagaaatttcgctgaccgtggaggcgttcaggtcggagctcctgagcacgcgcagcctcctcgccgcggcgatgaacatgctgcaatcaatcaagaattcgtcgccattagctttggagaagacgagagattcattcatggtgtgtgtgtgtgtcggactcacttccatggcacgtcgccgacgagcatctggtcgccctcgtcgtcctcgtagacgagcgtgtactcgccgctgccgccgtcgaggagcccggcgatcgcctcctcctctcctgtgcagctctcgccggcagcggcggcggcggcggcggtggccatggttgggtccctttgagctgccaacgcgagcaagcaagcgagcaaacaccatcaagagaaagctcgagatagaaaactccgatgatatataatgtcgaggtggtggggtttaccggcgaggaggccgcggaagagacggtcgacggcggcggagagctcgccgtagccgccgtgcgccgccaggtcgaccttccggccgatcgggacgccgtccatgttcaccttgacgaaccgggccaccttgcctcccgtggcggcggcggcggcgtctcggcctccacgcggcggcttcgacgacgacgacgacgaggcgaggttccgccggaacgaccgcaccggcggccacccgaccaccggagccgccggcctgctgcgaatcgcagagaatttaggggcaaattttagcatctttttgctgcagattcgtcagaaaaatgttgttgcgagcaaacagactgctcccaaaaaaaaaaccagaaaattttcatcaccttgccttgaacccatcgtttcccttggctccatcagcagcagtgctcgtgttcccctgcaaacctgagaaatgaaaatccaccagaaatgtaaagcataggacaaaacacacagatatgatcaaacaaagcaggaaactttgagggcaagatgaatcaagaagagagcaagggaggtggtgacctgagctggagaagtatccagggagggcaaggctgagctcaaggctcctctcttcctctccatcctctccaaacctgccattccaagccatctctctctctctgtctctgtgattgatcaaacaagaagtgtgaagtgtgggtgggtggaggaggcaagggggaaggatatataggaggtgagggaggcagtgaagcaaggagaaggctgcaatgcaaggagaggagaggaagaggacacaggtggtggtgggcaagaagcagggcaggcagagaccgaaaagggcagggggggagctttggaaggaaggggattttgcaggcaaagcagcagcactgacacctttctacttcctccattcctggtctccactccaacccagctctctctctctctctctcttctctaccactctagtactgtactactcctagtactcctgaattcagcgatttgttcaagattcttgcacagcaagctctcgtctctctctctctcatgaacaatttttcaagtgtacagacgaattttctgtcttgctatcgagtatagctatgttggcacggcgctacgatacagtgaaaaggaagttcaggtccttgaagtaggagtagggtctggactctggagagacagaggagcaacaacattactggcgggagcagcactgcactagggagccgttgtctttctgaagccatgtttaatgagtaccctcaacccgtgtacctgcttaccgccgttactttgcccgtccgtgccgtgtgcccctggagaggcgcgtgttttctccagggggacgtgcccctcgatgacttttgacagagaaacgaagcgaggagccgcgttgagcacaccgtagcttgtggacactgttccccacacccgtatttcccgtaacacccttggctagagctcgaggtggtggaggagctggaggccgcgccgacgaggtggacggcgacgagcggcggcggggaagagagggggaaagagcggatccgacaccggcgaggtggaagagtcgtcgtcctccctgatctccgccggcgccacgtccgtctcgatgcggcgcggatctagccccggatccgcgcccagatccacccacgacggcgacggcgcggccgaccagatctggacaccacggcgacggcaacggtgcgacgggcggcggcggggaggttggcgacgggcaaagggagaggggtggcgacgcgcacccagatctcgccccgtgccccgtcgatgccgccgcttcgatgccggcagcggggtggggcagggccgtccgccgccgcgacccgcgtggctcgccgtccgctttgctgagagagagggagagagcagagagagcggcgacaagagagagggagcagagagacgcgttgccggcaggggtaggagaggaaattaatatttgtggctttttggttgggaaacccactgtgggatagcagtcttgtgtgagcacgcctgagcatggggtgatggcctgggcttggttgctgaagggatggtgcggtgttctagcaagcgtcgttgtacgggttggtttcatggtgttgaatggggaactgttggcgaaagccttgtcaggccattgggccagcttgacgatggtgacacctgaggcgttattaccgttcttggaggcgttgttataacatttccccatccctaccatcttcaggtgaaaaccttgtttcggcttctggacgagtggtggtcgtgtttcacatcatgtcctccgtggggacactgctttggagaagcttacccttatagcgaaggtcgttcgtggacccctgcatcgactctaaagctctacaagcctgggatgtttggtgaagcctttgccatctttgttccattcttgtttatggtgtagaaccagctttcttagtttgtttctgctaggtggagtcggagttgctttgttgttgagggtgtgttgaagcttggcaatgataacatattattctctctttctaagggtgctggtgctaaccatgtataggaagtggcacttgttggcttaggcttatgtccatggtgggaaatcggtggtgtttattcgttttgacaatgcctctggcaacgatgacacgatcactgtagagtcaaagctgttgtgtcgttaggtggcaagctcagcaacaatgacacatgtttgcaaagttggagctgttgtgttgtactctttacgacaagtttgatgttgatccttacattgggttccgtagttatttagttgttagtttagctagggttaagggttgtttagttgttccgtatgctgtaaaggccacgattctttttcttgaggtgttttgcgagtctcttctatttgaggagatgcttttctttttcatgtaaccccatttgggtttttatttccgcttaattgaaatataattttcttctcctacggttccgtttaaaacaacaaatacctttcatctacagagctatttaaaaatgctttatttgagacttcaattagagtaatttccactgtcatctattgaacatgtgaattttccttaacgctacacattttcaatttcaattttaatccagaaaatcttgtagtattctgttagatcaagagtaatagaggactcacattcatcctagagtacattaggaaaaaaaaactcgattttgcatttgtgagatatgactttggcaaaaaaaaaatgaggagcttataaaaatgtgtttatactcttagtgcaaaatggaaaaaaaagagattatattttcagagcatgcagaggaggagcttaaatccataaatttggaccgacctacttgctatagataagttgttgatttatatatgtgtactatatagagttaaaaagctcgtttcatatctaagcagagaaggctgtgaagaggacttgtcgccagaaccaggattgcgttgagagagagtcatctagtgacatttgagagggaagcacgcacgcatatatgcaagtagggtttaacactaattaataaaaatgcaagcttggatgggataagataagctcagcactagcatgacaactttacatgtatgtatgtcactttgttagtttatttaattaatctgtctccaacctcagggaaaacatgcctgcatcttgctatacctatagatatgcaactaaattactccatccatttaaaaatatatagcgtcgttgacttttcacataacatttgattattcatcttattaaaaaaaaacttatataaatattttttatttcattatgacttgttttatcatcaaataaaatataaccttaacttatacttttacactctttacatatttatactaaatttttgaataaaacaaattgataaatattatgtgaaaaatcaacgacgtcatacatcttgaaacgggggaattagtaatagatggaaatatataataatagatgtccatatggggaagatgcattgtgatgtcatgcaaatctctagcaaaaaagttgcatgggcaatagtggatgtatgtatggcttggctgcatgcttatttggttgctcttgacttttttatggaatcatcaggcattgctcatgggcggttagtgtgtgtagtggtaagtggtgactggtgactgtcaagaacaagcattgaatcaagacatggataacatggatcatgatgatgatatatactactactactaccttgtacagtttatcaaacgtgatgaattgtctgaaattaaccttgctagtagctgcctgaactggacatcactttgaggccaagtgacgtctactgtggtgggtgctgcatttgctggagaatggatagaagtattcatttaaggaaaatgcgccccacccagatttaacaagatgtctgaaagttttcttaaaaaattccatttgtcccattttaagtgtggttgtgagtttatgtgttcaacgcttgaccatccgttttatttgaaattttattaaaaaataataaaaataagtcatgcataaaatattattcatgttttatcatctaattacaacaaagatactaattatataaaaaaaatcaaataagacggatggtcaaacgctggacacggaaatccacaactgcacttattttgggacggagggagtatttcaattgtcaatcgactatcacttttgagggctaggattgttcgaagatgtatgcacacatttggccctgaataagagagcgactaaggatcaaacgtccgatcccagtcaaaacccaaatggtgtttcaccttatatatgaaaaatgttttcagatatttaccgcttagtaaatttgtttgagcaaaaaaggttttagatatttcattgctcaataaaaaaatgttccatcacttggtgaaaattattttaatcagatgcaatattgaaaaaaaattgattgcaacatcacgacccttctatgtccaagaaaatgtcttgtacatcatgtgcaacatcccaatgaaaaagagtgaaacactcaaataagcaacaaaagagatgaatggactgcaacatataattccttttttttatagaaaatataatcacgtgatatctttcttagaagatttagttagaaccaatataacagtgtaatttaactttccgatatgcacttgacagtgaagtggtaaaaggagtggtttcaaccgtgaggcccatatttaattcttttccaattttttcttcattactctttggttgtttagctttttttttaaccccaaccgtgatagcgaaaaaagtgaccttttagtaaattcccaatccaaatttgaaccttttgaaaccgtttgaaattctgaaggcatatctaattctggcccatgtcgagagggtcgaatttcacaagatttgaacccatttcgacaaatttgtgaaccccgtcaagcaagtaccctagcatcatctctcttcgtcgtctccgatagctcccgcagccaaatccagatcattttatcctcagagtagccttatctattttttttcatagatgaccacaggctgcgtttagttccccttcaaacttccaaaaatttcgtcacatcaaatgtttggacacatgcatagagcattaaatgtggacgaaaaaaaaccaattgcacagtttgcatgtaaattgcgagacgaatcttttgagcccaattatgtcatgatttaggccatgtttagttccaaagtttttttccaaacttccaactttctatcacatcaaacctttcatacacacaacttttctatcatatcatatcgtactaatttcaatcaaacttccaaacttcaatgtgaactttcaaacaatgtggtgctacagtaaacatttggtaatgatggattaattaagcttaataaattcgtctcacagtttatatgcggaatctataatttattttgttattagtctatgtttaatactttaagtatgtatccatataattttaaaaaaaattggctgtggacctaatacggccacagacagagaacactttggatgaagaagaaaacagggagaaattcaaacttctgtgaggaggaagagcatgtatttgttcctcgtgttctctcctgagcggacagaaagacgcctgcctcgctagaaatgattgcattcttcgtcctgctgttcgcagtcgcagggatgcagtagttgggcggtggcatacgtactccagtacagtacagagtaagaggtctgtttgttttgtcaggtttcgcaaagtctaaacttgaccaggacccaaatgtccaaaacctcttcttttgcagccttccagtaagacagtaattatacctactagatgctgcagaagccggtgctcctttcccagaggttgaaagggaagaaagagagcatcatgagttctacctcctgttgaccacacatccactccctctctctctgcctcatgcagaggtaagggcgttcacagtgcatcccgctgtcgttcagcctgaactatccacgtcggtgttcatatgcaattcgatgccacgtttgcaggtgggcccacaaaattgaggaccgcatgaccaaagatggtcactctgttcttcggcatgttcgagggttggcagtgtggggagagaaggaaggagatgcgttgtggagggcgtggcttcgcttcgcatcgtctttgcccacgtcgcctggaaacagagagagggagaagggagatggagggaagggagctcatcagcggtcggagaggaagcccgtcgtagcctgtggcaaggagctagccgtcatcctcctctccgcgctgccaagaagatcgcgacactcagctctgcgccaccgcggggctcgtcgccatcctcgctgctcgccatccacctcgtcgccgtctccctcttctccgccgccttgatctagaggctcccagcagaggacgctcgcaacgaggacaggacagccgaggcacgctggcgcccccgatctagtcgtcgtcgaagctccaatgcctgcctcgtggtcgtcgccggagggggagggtaaggcagcggcgatggggaggggaaggaaaagccggcggaggcgttggggaggccggtctcagctagctcgccggtcgcgcctagcctcggtcctttcccgccgatgaggcccgcctcaatccgcgccgctgggagctcaccggccgtgctaggcttgatccgcgcccgccgcgcgaggccactccatggacaccgccgccgccgacgtggggagtggggactggcgccggccggggaaggggaggagaggcgtcggccagggaagaggaggagaggcgccgctcgagggcatcggccagggaaggggaggagaggcaccgctcgcggcgccggattgaggggaagagaggtagtgggcgtgaggataagggaaagaggggaaatgggggattttatattcttttctggatttaagggtgttaagtgtaaattttggatctccacaaattaaagaaaatatgagaactgaaacaaaaggtactaggggctgaaatacaaaattaaagccactcgcagagccacttgtagtgtgaagaattcaaatttaggactcgtagctctagcctacgtgacacactgaggctcctcatacgagagtgacacactgtaaatgccctaagaaaggaagaattgaagtgttcgactgttggttacttgttactccatcggtttcataatatgtttatttttaactcattttatttttcttaaaataagtttacttaatattgaaagtagataaggggggaatagttatattggaatttgataaagtatggatgttgtagtatttttgttttgtattagtttgggatggatgaaaaaaaaatattatggaatggagggagtagtagtttttccttgtcacaaaaataaattacctatgtctacgaagtgtgggccaacgtaaaaaaaaagtatgtgtcagggttatagataccacataactaatagtagttgactaaatctcggcaggacccaccacataccttgtcctatacggaaacaacctgcggatatagaagaagttccggataaggaaagacaaccagagttctacatggaaacgacaaggactactcggattgtatccatattggtttccctagttctacttggacaaggggacacctatgggtataaatacaaggccccctaggaggagaggggacacacccaccatagaggacacggaacaacagaagccacaacatacaagccaacatacgtcaagacaagccgccggatatcgacatcagagatatgcctagatcgaccctatccggtacctacagaggccggccgtagggatctagcgctgtctctgatctcgccgagcacaaactcgaagaggaagactaccatgttgtcgactacgagttagaacttcagaccgccatgtcgacaacagttagataggctaccccaaatattgtactggtgtgattatggtgaataagagcaataccggcttcggccaacatgatgtagggttataacctgacaattcaggggctcgaacctgtataaaaatcctcgcctccatctcttttacctcaatctcgcatatatcatagtaccaacgatccccataccatacaaataccggaatcgcgacatcaaacatcgacagtggtgcgccaggtaggggatcttttggtgcttcaaagtttcgacgagatgggtttaagagacggattctccaacaacaagctactcgacgacttcgaaccagggagatccgacatgaccagagtacgtgccccgacaagatcagaaccatcgtcgtcagatctataatttattatggtcacctagagcatgtttttttatacaatatctattgtgtgagtgtttcggatgttaaattgactacggtttaacgctgggggctcgttctattttcttcagtataaatcatgcttgtttacgatttacataatccctgatatttacatctgctcgttatgtcctgataatactagaagatctatgcagttttttgagtacatactcgatattctctgctatatatcttgccttctagaaaatatttttcagaaacaattgagcacttgagtaggttgtggtcaagcacaccccattatcgagaacgttctcgacaaatacggagttgtcgcacccaacctaccaacgaagaccgacgacctatctcatagcgccgaccaaggctgggctattcgagaaaaggttgttaacgaataaattctcgtgaacgttgtcggcttgatcacccgacatgattgcgagcggacatccggatatgctataagttgggtatatgagtcatgctggctacatgagatgcacatgtaacaaaccaaatttagcacccctataggtgattaagaggctcctactcctggttctcaaaccagtaggacgtagcgatctctcgcacctctacttctagtggtcgagttaaggctacacctggttttcgaccagtagtgtagcaatactcccagtggctttacttctcgtggtcgagttaagactactacctggtcctcgaccagaggtgtagcgattctcccactatttctacttcaagtggtcgagttacgactactacctggtccttgaccagaggtgtagcgattctcccactatttccactttaactggtcgagttacggctactacctggtcctcgaccagaggtgtaacgattctcccgctattttcactttaagtggtcgagttacgactactacctggtcctcgaccagtggtgtagcgattctcccactacctttgcttcaagtggtcgagttggggctacaactggttttcgaccagtggcgtagcgattctctcattacctctactccaacaaagttgatatcaggtacataatatcgccaagtgttttacccagagatcccttaccacgacgacacctagagttgaaacctatcctcatgtccctttacgccgtcctgacaaggcctctgaggaacctaagggaacttcggctggggacgcccagagcggataaggccttgtcggatcatgtagagacaaacgaccatgtaagacctgatcatgtaagagttctcgccgtgcgtattaaccaagccgtgtaatcggaaattgagttttccaacttcatggctgggggctaggatcagtgctttttcaaccaaggcaggtaaagggtccaagagccttatcatccaagaacgattctccacggacaaggctaggagctagggagagtgtatgattcaacaaactgactgatcgaagtcggtaaaagagtagatgctcatatataaaacattggtctgtaaatttaattcattttcagttttccatacatattataacatgttaccctttgagcattcgctcgggggctatttctatctaatactaggtgaaaccccacgcattgctgcgggaatttagtatgataacaataaaaaaataacgtgtaagatagctagataacatcagattaagtaaattaatgtggtttatgataatttaaatttaaatagtatgtagaatggtgattcaaacgtaaaaagtaaggtgatataactttatggaagaagaaaagtagagagatactagttggtaccatagattaatcatctaaaggctaaaaacaattgatgtgatatgacttaattataggaaaaaaggagaaagataatttggaccatagattaatcatttaagcactaattaagtgaggatgaactatataggatatcataaaatataataaaaatatgcattgaaacattatgtgaattatgttagatgataatttaacatgtttgtattcgaaaagctcttaaattataaaaactataaagatatagcatgtttgcatgatgtttaaatgtgatgattgttagtggatgatgatgtggcatctttgcatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcag

SEQ ID NO: 3111 - DNA, 568 bp, Oryza sativa
tgtcagggattatggacttaccgatggaaatgtgcttcatcttgtcgtgcggttggctgacctccgtgcgataagcattgagactgccaatgggaagaaatttcagttccaggtggagagttgctgcaatgttgggtatctcaaggacaagctctcagctgagagtggacagcaacttgggagtctcaaggaccaaaggcttgtgtttgacggtgaagagcttgaggataaccaattgattgcagatattagcaagaagggtgctgcagttatccacttgttcatccgcaggccagcaaaggttcagacacagcagggtgataaggaaactgttgttacagttgttactcccaaagacaatgataacctccaaacagatgctttgaaccttgcgaaaccagctaagggtaaacctgctccagttgagccaatcattgctaatggaaaggtgaaattgtctcctgctgtgatggaaatgatctactcaacaatttctggtatagaaaacgggtaccttcccgtgatgtcacagagggttcagggggagtctatttcatgaaggactctt

SEQ ID NO: 3112 - DNA, 658 bp, Oryza sativa
ttgtatctgcctgttttttccttttgaagaatcttgacttgaaatagatcacttgcgctcaatcctgccctcgggggctcgggtcggctaaaaatcgccaaacggggcccagaaccgagccgtgcctcggggcgtggtgaactccgggggggaatcggcaaaaacccacaatcgggtcacccataaccctcggtcaccacgttcccggcctggccagtctcgacatgtggatctccctaggcactgtcacgtcctgataaattcatcccgaaataaaattcattttctaaaaggaataatagaattaattaaaattcgaaaagaaattggcaaacactaaaaatacgtacaagaaaaattcaaatgtggcccggagaatttttgttaaattccccttggtctaaaaggagccctcaaaatttacttgaattttcagagcaccggaaataattattaagcaacaaaaacaattaacaaagtttattaaaaagaaaaacctaaaaataatctctcttccttctttgggccaagcccagcccaaaagtctccctttcctccctctttttctctccctctccttctctccctccttctcttgggcctcctcccctcccggcccactccctcctccctctctctcccgggctgcctttttccc

SEQ ID NO: 3113 - DNA, 187 bp, Oryza sativa
ttagtgacaaggcatttggcgatttattgaaactcgtcaagaacattcttctggggggaaacaaattgcccgagacaacgtacgaggctaagaagatagtctgcccgttaggacaggaagttcataagattcacgcatgtccgaacgattgtatcctatatcgcggtgaggagtatgagaacctaga

SEQ ID NO: 3114 - DNA, 1298 bp, Oryza sativa
gttttgttctctgtttcagtagtcttatagcctgtttgcaatgtttgctttgtatgtcgctagattccgatccctccgacgctccggtgtacttcgagatagtcgccgaggtccctccagcagcagagcaaggcaagtcatgcctgtcacttgaacatgttgatcctatattgcaaatgctctactgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggagtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttcccccccaacctcagagctcgagtatgtgtccgatggcgggttctccgaggagtaggcttcgtccgtgccgtcgaggatgcctgtggagtggtgttcccgctgcagttcaagtcaag

SEQ ID NO: 3115 - DNA, 557 bp, Oryza sativa
caacacacaaaaaggagcctagctgaccattttccaccacacacaaaagcccagtcaccatgacatatatatccgaccggggcccttgtctagctttcttctgcgttaggttgttcctctttggcctcttccataggagatgttgcggaattcatcttggccctcttcatgatcagtgtttccactaaactttccaagcgttcatcagcatgtctcttccggttgtagcgcagcatgatgctatcacgatcgactggttcctcgtcgatctcgtcgagcagtggaccgatttcaccgttcctcggcatgagtttatcggccacgtctgccggagtggtgttggtctcgctcagcagtccctcaatttcactgaatagtgagtgctcggtgatgtttaggtagttcttggcgagcatcttgaaggcctcgaaccggcagtaggacatctcgatgtccatatccatccttccacgccgggtcagcgccgggtcgaggtggtcaacgtggttcgttgtaaacacgaagattcgttcactgccgcacgccgaccacagccc

SEQ ID NO: 3116 - DNA, 2569 bp, Oryza sativa
agctagggacaggaccttaaaggaactaactctttttgttgatgtgttgtttgttttgcttattctgcaagttgattaagcaaacaacctagcatggttacatcacaacccaccgatgcaaaccacgcgctacacacacaagcaaggaaacacacgacaaacgactctaccctagagggtggcttaggttctgcgacgggttctccaagatcttcactcctgcttcacagctggcttcactgcttccttcgcttcgctggcggatcctgcagtcttccggagcttcggcaaacaactgacgacatcttcttcttcgcaaagctgaccatctagtacttagttgaaatccgaagaaagaaaagagtaacccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcatcaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggagatgcacaattaatgcaaaggagtacaagggggtaataatatagggtttaagttttgcagtaaacagcatttaaaagtcacttagttgcccaaagccattttataaagacgatcctagcgctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgctgagcaaattttaagaattaaaacactgacttgggtacattgctcggcttgcccataaccgagggcgcggctattcgaatagattatactctaatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgccctggagaatgtccatcgacccccgacttcatccacctccatccgtgtacttttgtttataaccagactgagccacaaactaagccttacccacaagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatttcccaagtctaaagttgtgaaaccacctaatgttgtctaattcaaacagcgaagcatctacctaaattcatactagtggaaccatgaatagagtacccactagttgaggttttgtttaatctagggtgaacaagggaataataataacaatagcaataataaggtcataacaaaggtaaataggcatggctaaataaaacagtgataacgcgggaatttaaataaagcggtaatgcattaatttaaatcaacataattttataaactgggattcaatatgctcaaggatgatgtgacttgccttgctcagagagaacggacttccgaaccttcggcgacgaccgcgaaccacgcttcgggaacctccggaacgacagaagctacgcgaagcacacaagcaaagctacaagcctataaagaagcaataacagtacataaaaagaaagcaccgggttctttaggttataacaaacattaagagacttgaacgggtcgattcggagttcgtatgaccaagatatgatcatccgaagtttaatgctgttatatggagatttgcggattattataattaagctttgcaattataaaacatgtgtaagcgctagcctgggaaaagacaggaaggctgcgccgttgacatgcggaccccacatgtcaacaaaaaggaccacggtagaccgagtacacagagacggtccacgggtcgatggaagcggatcccgtgtgtcaaccgaggcgagtggccgacaacggactccactagacaccacacggactgcacacgtggaaaccacgcggctaccgagcggacacactaacacggt

SEQ ID NO: 3117 - DNA, 1209 bp, Oryza sativa
agtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatacatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagacacgaaccaaaacagcgctgttcgtgtcgatgccatgggacacgatggaacaactgccacatattacggtgccatcgaggacatatgggaacttgactatggtcctttcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcagagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtgtcaatttcatatg

SEQ ID NO: 3118 - DNA, 714 bp, Oryza sativa
cttggtgagtcgatttacgactacccacattgaatcatgtcccgatgatgtccggggcagtcctgttataaagtccattccaatctcctcccatttccattccgggatttggagaggttggagtaaacctgctggtctttggtgctctgctttcactcgttggcaaacatcgcagagtgcgacgaattcagctatttctctcctcatgctgacccaccaaaatttctctttgaggtcttgatacattttagtgctgcctggatgaatggagtactgggtctgatgagcttcggtgagtatcagatccttcaattccttgtcgtccggtacacacaatctttctcccatccagattgtgccatgctcatcctcaaggaaatcccgagcctttccgactctcatgttctttttcagttctgctatttccggatcatttacttgagcggctctaacttgatccacgagcgtaggccgtgcctccagagcggctacgaacccgtgttcaacaattcccatgttgagatgttcaagctcctgtcgcaattcctcacacatgccctcgatgcatagagcagtgcagtaacttttccggcttaatgcgtctgccaccacattggctttacccgggtggtagtgaatactcatgtcatagtctttgattagttccaaccatcttcgttgtcgaaggtttaggtctggttgggtgaagatgta

SEQ ID NO: 3119 - DNA, 473 bp, Oryza sativa
ttttctccggccaccaaccatggccgccggccgcctttaccgccgccgttccgacctcccccgtggccgtctccctcttctctcctataaaatgcaaccccctcgctccgttctatcgctttagccccctcccgcggtctcccatggtccctagccacctccccaccgtcgccctctctctcccgtgccgctggacgcctccagccgcccctaccgccttgcccgtgcgccggccggccgcgccgtcgcctcctccagcgtcgccgccacctcctccaccccggcctgccctccgtttcccgcggagacccccggagctgccttcccgccgtcgcccttctctttcctccgtgctggccacctccagccgcacctcccgcctcgcccgtgcaccctccggctgcgccgccacctctcccggcgtcgcagctgcctcctctttcccggcttcgcctccgtttcgcggggaaatc

SEQ ID NO: 3120 - DNA, 611 bp, Oryza sativa
gtcctcctggatatcgatgtgttccgaatcagcctgctcttcaggtacccttaagcacttctttaactgggaaacgtggaacacgtcatggatgccgatcatattggatggaagttctagctgataagcaacttctccccttcgttccaaaattttgtatggtcccacgaagcgtggtgccaacttgcctttcgtctggaaacggtgtactccccggagcggagtgacacgaagatacacgtagtctccgacctcaaaagttagctcccttcgacggttatccgcgtagctcttctgtcgagactgagcaaccctcaatctctccctgatgattctgactttctcttctgcttccgctaatacttctgttccgaacagttgacgttcgcctgtctgatcccagaaaagaggtgtgcggcacttccggccgtatagagcttcaaacggtgccatctgtagactggcctggtagctgttgttgtacgagaattccgcatatggtaagcttttgtcccaggctccaccaaaatcaagagcgcaagctctcaacatatcctccaagatttgattgacacgctcggtctgaccatcagtttgcgggtgataggccg

SEQ ID NO: 3121 - DNA, 366 bp, Oryza sativa
caacggaagcggaccccgtgtgtcaaccgaggcgagtagccgacaaacggactccactagacaccacgcgggctgcacacgtggaaaccacgcggctaccgagcgaacacactaacacggacactacacggtcaccacccgcacacgtgaacgactaccgacaccggtacacgggtaccggggtcgacgaccgcacaacgggtacggggcgacaccgaaaggacgaggacggggcagcgagggagaggtccttaccactacgcggcgaggcgagggaacgacttcggcggcgatccttggacgaaggcgagacgcggccggcacgaggcttgacgatgcggagccgaggacgaagacgatgacggg

SEQ ID NO: 3122 - DNA, 743 bp, Oryza sativa
tgaccccaagaaaatgcagaggaaatcaggataaaaccctaagaaaacaatgcaaacaataatcgggtttgacatgtggaatttttcttgaattctacatgtcgaaattcattaacaggatttttagtggaattttcagagctctagaaataattttaaccaattaaaaatcactaaagtgcaatttttaattccagggaaaatccttttcctttttctttttcttttccctccctttttcctcctttctcttttcggatgggccgccggcccattcccctccttcctccccctcctccttgctgggccggccgcaggccgagggcccagcctggcagccgccgcccgcctcctctctcggggtcgccgacaggtggggcccacctgtcgggtccttcccccacctcccgccgatcccggcgcgccgccgcgccgaaaccgccgccgcgcccacgcctccgtctctcccgggccacgtcggccacgcccgcgcgtgcgccgcgtctcccgcgccctttcccctctccctcccgttcgcgcccgcgcccgagatggccgggattcgaaaaccgaatcccgcctctctctcctccccactcccccacgtcggccgtcgaatcccgccgctcccggccacgtccggctccctctccccctttttaagcatcgccgtccccctctctcgctttttccccatttcgccgatctctcccgagctccccatcgcctccgcgccgtgcaac

SEQ ID NO: 3123 - DNA, 759 bp, Oryza sativa
cccctctctccgtgggcaaggtcctccttttatatcttaaggggataccacatgcaccatcccccccttttttatggggacttaccctaccttttcataaatggacggagatctgcatggttgccgttcgagtcaccttctgatgggacggcctgcacctacctccactttcgccgggagcaggcgcgacgtagaatcatggctgtctgctggcgacatgaccggtgtcagaatggtcacaaatcggtcattcttgtccacctcgtgtcagcttagcaatctgcatgttggccctccttcacactacattttgcctgtaatggttaggatgaagcctggcatatatctgatcaggactaacgtgccatctctgggaggtaacacgctagctccagctggggacgagcgcctagaagccctcgtcctgacgggatggggcgaggcgtgcgtcagaccgcctgtcgccacctaatcccgcgatctgaccggtctgtgactggtcacagaccggataaatgagtgcaatgcactacattacatgcgtcgtgacacgctcagccaagccgcaataaatgtggttaggtgagccccactgtgctcacctaccccatacacgcggagcgaaatcccacgaggggtcggggcgcctcggccctcggggccggagggggtgcagcccgacccccctcgggggactaaagagagggcgaacacaccacccttcggcctgacgtccccgaaggtgccagccacgtgggc

SEQ ID NO: 3124 - DNA, 901 bp, Oryza sativa
aaaaatcctcactagcccattctgctggattaatatccgtctcatcatctgacgaatcaccttcctctacacgctcgttgtcagaatcctccctctccatttcatccacaatggcaccgacagtctccccctcgtcagccactccacctggttgaatgcccactggagctactacacccccatcctctcgtgcgttgacctcctccacagaagtctcgtttacttcagcacttggtccctcgccatcatccatgttcgtctgcacacctggatccttcgggtgaacaaacggaaccaaagctagaggccacccacgttgcaatgtattttccaaataccatctccacactcgagagttttgaactggcattagttcccaataaaaactctcagttgcccgacttactataacattgattgttatgtcacttgtctgtggatcaactctcaagcccctcattaaccatccttttatagaaggtacactcctctcagccggtctctcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttatcgatatctacaatacgcacttctagattagtacaactaaaaccctaaaaatataatgcatttattcaaacaaaattttaaagaatacacactatttaactcaatagtcacatataggatctatgaatattacctgaaatcggcgtctgaatccggcaaggctt

SEQ ID NO: 3125 - DNA, 1419 bp, Oryza sativa
cccaccagagggcggcaagggttttcttgcaaaaaaccctccctccgtcaccgcccgttcctcccccgtttgccacgtcagcttgccgccccagaggtgggcggcaggggctatttctgcaatttttttggtcgatagattatttctgtaaatatttaaaaataaaaatctaaatccgaaaaaaattcggtctttgtccatgagcaagagtatacgggcccattttgggcccagttgggctttcaatcattggaggattaggcccaaaccagctcttatccattgggcccatggttaccgtcatccacctggcctcatcccataaagggcatgcttgattgcgtactttatcatgaaagtctggcaagtgatcgttcaaggctgtagttgttttgtgttagttctgtgagcattttatgcttaataatcttatagacagattgctttcctttttttaataattgaatataacatcccggcctttactcaagagagctacagccaataattacatagtactccctccgtttcacaatgtaagtcattctaacatttcccacattcatattaatgttaatgaatctagatagatacaatgtaagtcattttagcattccccacactcatattgatgataatgaatctagatagatacaatgtaagtcattttaacatttcccacactcatattgatgttaatgaatctagacatatatatctatctagattcattaacatttcccacactcatattgatgttaatgaatctagacatatatatctatctagattcattaacatcaataagaatgtgggaaatgttagaatgacttacattgtgaaacagaggaaatagcactcaaataagagtgtagttcaacaaatcattgaaaacgcccaatgaacaaaataagtaacgaaactaaaataaggagaacacattattgaagtctatttgtaaatctccatccataattgacaaaaagttgtataattgtcatctcaagtttgcaacatgcaacttttataaactctttgtcgtcttcaaacttttgtagttgcgcccagtatcgaaaccaatatgttgccctaaaaattacctgcatataagagatgtatggtgatttatcaaaaaccaaatcattcctgctcaaccacagagtccaacatattgcataagctcctacaagtacaaacttgctccttttcttgtccaccccaaaacccaaccatcaaaaatgtgggttatgctactaggaaggtaaccaaaagagaattgaactgctctccataaaaacttttgataatgacaatcaataaaaagatgttggatagatttaattttcatgcaaaaacaacatctcaaacaaccaattcaaattccgtcttgccaaattatctttaggtatacacgacacc

SEQ ID NO: 3126 - DNA, 1808 bp, Oryza sativa
  unsure (1)..(1808): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcccacccaaccaatcagatccatggtgggaccaattcggttcatagatcatgtagtgtcccaagactctcctttcctttccatgcagtaaggccttgtttaattcgcgaaaagaaaatttttaggtgtcgcattggacgtttgaccggatatcgaaaggggttttcagacatgaatagaaaaactaatttcataactcgcctagaaaccgcgagatgaatttattaagcctaattaatccatcattagcacatgtgggttattgtagcacttatgactaatcatggactaattaggctcaaaagatttgtctcgcgatttccatacaaactgtgcaattagtttttcattttatctatactagaaaaaaaatccccgtgcattgaaatgggtgaagtctattttaatcttattattgtcatatggtttagctaagataaaattcactgtgggagttcgcttggatatatatttttttagaaaatcatgagctgtagttaggagtccgatcgtctcaagttagcatgcaagtttttttaaacagattccttatatgattccttctgtattaccaaaagtgaacgatcttaaaaaccgactcaaatattaatatgtatttccaaaagtaaacaaacttaaaaattgactcatacacgaatgacatactaaaataccggcaaaaacatctttaatttttgtaatagtagagatagagaagagatatagattaaaaccaaaacataaaattaaaaccgactcaaacacggatgacgaacagcggaaacatcttcaatttttataaccgactcaaacatggatgacggaccgcggaaacatcttcaatttttataatagtagagatttaatgctccatgtatgtgtccaaagattcgatgtgacgttttttggaaaaaaaattaggaactaaacaaggtctaaatttcatatttgtcgattgaatattgctaaaaagatactttgaccattaaaatttagaaactactaggtacatatctggcaatgaattcaatcaaaatttaggacactacgtcataaatgtgtatgtcttgaatgttacgtgtgcctcgcgaccacgagctttttacttaattaatccctggttgattcaaacgaaagttagggtgtatttagttcacgtcaaaattaaaagtttgattgaaattgaaacgatgtgatgaaaaagttgaaagtttgtgtgtataggaaagttttgatgtgatagaaaagttagaagtttgaagaaaaagttgggaactaaaccaggccttacataaattttggagaattttatttctatgggatttttttcctagatgatcctttcaataaaagcaagaatgctctgtatcggtcgacagggggaggtgggaaaatcggtcgctccccatccccatgcacgcaccccgctggatccacccacttgtccctccccttgttccacaaaagatatttcatctnnnnnnnnnnnnnnnnnnnnnnnnnnnnnnnnnnnnnnnnnnnnnnnnnnnnnnnnnnnn

SEQ ID NO: 3127 - DNA, 779 bp, Oryza sativa
  unsure (1)..(779): unsure at all n locations
nnnnnnnnnnnnnnnnnnnnnnnnnnnnnnnnnnnnnnnnnnnnnnnnnnnnnnnnnnntttgctcgttcttgatttggtttctccctttaaacttcactactactgctcacctttagttcactgcaatcaacagttaacctgacgagagcgtatgaccgaaagcttatgccttgctcatcgtcgctcctcagaactggcactgaaatcatgctactctggtgacaactcctgcaatttctgttgaatgaatgaattgaatgaaacaaacctttcctgaagttctgaacaagggaataggacctaaaagcatctttccagttatctgcaggcaccagtgtgtgagtactagtggtcttttccaagcattttcaagctgtgtgctcattgagatactccatgcaagacttgaccctctccagaattcagagaaagctacaactacaagtgagtactctgtctactatcatcatttctctctttagctagcactgttctcaaagcaatgggtttttcctttctcttgctaatcatctacttcctccgtcataatatataacaacttaagaatggatttgacatatcctagtactacgaatctagacatgtatttgtccaaattcgtagttctagaatatgtaaaaatcggtcatcggttactatataatgggatggagggagtacttcctgatagtgtgatattaccatggcatgcaacacaagcttgggagaaatggataatgattggttttgccaatgtgccatagcccagaggacagg

SEQ ID NO: 3128 - DNA, 1841 bp, Oryza sativa
cttttgtagttgcgcccagtatcgaaaccaatatgttgccctaaaaattacctgcatataagagatgtatggtgatttatcaaaaaccaaatcattcctgctcaaccacagagtccaacatattgcataagctcctacaagtacaaacttgctccttttcttgtccaccccaaaagccaaccatcaaaaatgtgggttatgctactaggaaggtaaccaaaagagaattgaactgctctccataaaaactttgcataatgacaatcaataaaaagatgttggatagatttaattttcatgcagaaacaacatctcaaacaaccattccaattccgtcttgccaaattatctttagttaacacgacacctttaagcaaataccacataaagatctcaatcttaagcagcatcttgagcttccaaattatcttatttttctcaatatagccattattaattaaagcaagatacattgaccttaccgtgaacataccattctgattaaagttccatttaaaacaaccagatgagtgattcaattggatatgaacaatagaagcacacaaatcatgccaagaaacaagattctgacccactaatgctcttctaaaatacacattaagaggaacagaattcataacactagcaattgaagaacatttccttcggacaatggtatacaaggaaggatacttatctttaaaaggcaaattaactaaccatttatcttcccaaaatcttatttgttccccattattcagaatccaagaacccatattcaagaaagtctccttaactttcattagaccggaccaaaaatgaaatcaccatgtttcctatcaacttgggttatagacttattataaagatattttctcttcaacaagtcttgccaaactccttcctcatttattaacttaaataaccatttactcaacaagcatttgttttgaatttccagatgctttcttttttttgaaacacataatagtacataagcatgtgctcctatgagcatttcagaatactagaccggtctagcctatcactgaaagaataattaattataaatatgagcacatgtgctaagtctaaaaattgaacatactccctccgttctaaaaaaactcaacctagatagggatgtgatatctcctaatacaacgaatttgaattcactatactagaaggggtcctagattgtttttttaggacggaggaagtaggtcggtaggatcaaccataagggaccttaccatctaagctaacctcaattcgccaggcaagcaattagacattctgacgatatgtactaacctctgttgtacgagtaaagaatttccttctcactgataatatgaggttttcagatgaggtgaatcccacccaaccaatcagatccatggtgggaccaattcggttcatagatcatgtagtgtcccaagactctcctttcctttccatgcagtaaggccttgtttaattcgcgaaaagaaaatttttaggtgtcgcattggacgtttgaccggatatcgaaaggggttttcagacatgaatagaaaaactaatttcataactcgcctagaaaccgcgagatgaatttattaagcctaattaatccatcattagcacatgtgggttattgtagcacttatgactaatcatggactaattaggctcaaaagatttgtctcgcgatttccatacaaactgtgcaattagtttttcatttttatctatactagaaaaaaaaatccccgtgcattgaaatgggtgaagtctattttaatcttattattggcatatggtttagctaacataaaattcactgggggagtccg

SEQ ID NO: 3129 - DNA, 6380 bp, Oryza sativa
tttaggacactacgtcataaatgtgtatgtcttgaatgttacgtgtgcctcgcgaccacgagctttttacttaattaatccctggttgattcaaacgaaagttagggtgtatttagttcacgtcaaaattaaaagtttgattgaaattgaaacgatgtgatgaaaaagttgaaagtttgtgtgtataggaaagttttgatgtgatagaaaagttagaagtttgaagaaaaagttgggaactaaaccaggccttacataaattttggagaattttatttctatgggatttttttcctagatgatcctttcaataaaagcaagaatgctctgtatcggtcgacagggggaggtgggaaaatcggtcgctccccatccccatgcacgcaccccgctggatccacccacttgtccctccccttgttccacaaaagatatttcatctagtgtacttataatatttcacatgtatagatctaatgttgcagtgaattaaaatattcttttgcaacaaatcacctgtatattttagaaaccatctattatgggaatttgttttattttttgttccacaaaaatgtttcacctagtgtagtcacaatattttactgtgtatagatctactgttgcagtgaactgaaatactccattgcaacaaaaaaaaatccacatttttggaaccccctattaaggaaattcgttttattttttgttctaccgaaaaatatttcacctaatgtacttagggcattcccaacccaatgactaggatgatgtccatagcattaaataagttgccacctaggacaaaaaatgatgtggcaagtgaataaatgaagaaagagaaggaaaccatgtcttgcatgagacatggtttctacacaacatccaagacatcatgtgagataagtagcattaaattgaagtatggaatagtggtgtttgcattggaagagtagtgtctagtactagtttcttaatgatgtggagtttatagaaaccatgtctagtgttataggttgggactgcccttataatatttcactatgtatggatcaaatgttgcagtgaactaaaatattttttcgctatttgctgaaacattgtttttatataaggtgaaacaacacccgatttaaacgagttaaatattttcgatctacttagtgaaacaattccgatattcctagtggaacatcgtgcaacatttaaaaataattcaataacaagctaaaaaaaattcgtcggaatatatccatgtatggtcttgttttgaagatttaattgcaacgaatttaatagtgcaatcggatcatgatttggataagtaatttaagagaaaattcaatttaaagtagttttgcacgtaaatcgggctgacgtcagcgcctgatttttctccaaaccgatcgggcgcccgaaccgtagactcgtccgaataaaaggagtcgataaaattcctatggaatgtactatgaggtagaacctcatggaactttcctttgagacattatctctcctctaactactgctattgtcgaatgacaactgcgtcacattaaaggacgtggaaacccgttaggtgtttggaataataaagcaatatattaattggtaaaattttttgggatccccccattatatggccctagggggctatttatagtcctaatacaggctcataccctatagagtttggttagtacaggggaatttacatggttcctcttatgatagggacattacaatgggtataaaacgtcttatacattcatgggccctaaggtgatcttcttgggccagcccattaggtgacgaagggcctccatgggccgccaggccttcttaggtccttagccgaaggcctcctctactccagatgacggctttatgcttcgcttgatgtccttcgcccttagtgagccttcggtcggtcgccaagcttggcggcgaacctattgatctttatcgtcaggcttcgtccaatggttggtagcgaaccccatggtcttcgccctacggcttcgcccaaaggacttagccgatgctttgatggattaggtagtttcggcaggttaaccaaaggccctcatgacattcctccaacaaccgcttttcctgcggtccaataaaactgttatatttgtgttttgtaattctctattttatactagttgtattcatgtcaaaatcctttgttttctcaatcctgtaattcaagaggccctattccactccgtattccaccacctgacgtactgatccaaatcaattccactccctattccagcacccttttcgaggacggcatgctgcgaggcgtcgggtagcggatatgagctagcagagaagggttgtgtttagttacacgccaaaattggaagtttgaagaaattggaacgatgtgacgaaaaagttggaagtttgtgtgtgtaggaaagttcgatgtgacggatgaaaaaaaaagttggaatctaaatagggccaagagcagcagctggcgtcctagctcgtggcgaccttcttggggttcagcgattgtgagagagtagaagagaggatttatggtttggtttactttatatatgagtccagctactgatcaatataattgtgctttacattttacattttgaagtgagctattttcacatgactacacataggggtgaaaacggagcggaatcggatggatagtggtcataccatatcctagaccatattttttaagcagattcggagcgggtgcggatagtgtacggatgcggagcggattgtttcagatgtcagaaatggtgtggaatcggttcggaaatggattaaatttatcgaatgttatgtttgtatgcaatcaatataacaccaagttagcaatgcaaggaacaataatacaataatcaataaacgacataaatacataatataaaaatacagctacacaagactaagaatacataaaacagattaaaaatacatgagatgaagaaatctagattaattgatcaattaggccattagatggaccaacttatgttatatgcagtagatatagcggttacatgtgttgataatttccgattatcaacacatgtaaccatgtccttcttgtgccccaaaacagttataagcatcatctttacatcctcaactctaaaattttgaaataatatggaaatatttcatgataagacaaaatagtgaacttattctcacaaaaatctagaaagagtttatcacatttttcaagtgttttttaatgtatgtctccctcttcatgtgatttgtagttttcatgattttaattataactaacattatccaaattcttgttttagattcatgtggcaactgcttgtagcaatgacaactgcaatctacattcctaaatttctgctgttggtagaatttgccataggattatagatttatgaggtttgaccttcttaggcaaaaaaatacatatcatacaacatatacagataaacacatggacatcttattgaggacactaccactagaagtctcaactagtgatactttatttgccaaggtcataacgtacctaacgtaactaatgtatggcctcgcacaatgctcacttgagttaaatcgttcagagtgccaaacttgtttgggttgtataccctctgctccacattttaacttgtaaacatgtgagataagagcaacaacatggtgcaatttgtgatgtcagggatatcctttcttcatataccttccaacgttgaaccaactcatttatcaagctacacttaaaagggatgcaaaaccgatctgtgtttgaaagtctattatgcatgatggtctattgctatacattgattataatattgttagtttatagttcaaaactagcttttaggggtctaattcccactccgtgtaaaattgactgggggccaaagcccccacgctaataactttttttggaaaattttcaattaagcaataaaaaatagagaaataattaaggaatacaatccttgtcaaattagcaaggattttggttcgaaatcctttcattttagtagcttacccaacttctttctattcaatttttttttcaaaaatgagatttaccaaaattttcatgactctaaggtccaatccaatctatcttcctttcttttcctttcctatactaaaaaggattgaaattcatcactctcttatagttcattgtttccagtgtgctagcttagtccctccattttttctgttggtcgatcgatcaactcgtctccgttgttatgcgttgcccgctacaacctccttgtcactattgtattcattcgctgccgattggccggatcaaataagtaacacatactagtttttattatttgcaagtgtgacacctttctaaaatctaatttttttatatgccactagagcttgtaatattttaccctcactactaccattcactaatatcaaccgattttactccatacaccccttttgcaaaatcacaaaaaagtactcatttttccacctcaaacccatgtacaagtccttttgcccatgtatcgtgttgtcttttacctttaaaacttttagaatttagataatgttagttataattaagatgatagaatgaactatagaatttagttttagacggtaatgtggttttagttactagcattttgtctcaaaaaatacttttcattattttaatttgaactaacgttgtttaatattttatttaagatttatgtgcgatgatgaaaaacacattatgcatcgttggatttgcactggtactaggatttgccacaggattatctattgatctctcatatttttgggtgcaagaatgaaatacatatcgaacaacatatacagaggaaacttgaattattatatcctgatctcttgtatttttagggtgcaagcaagaaaaatacttccaacaatatatataaattgtcggcatgtgggccttggcaggcaccaagcgtcttggagagatcatcccacaatttgtatagcatacagctttccttgttttttgctttttctttatccctaggggttgtatttttctcctgctatattcgatgaataagcacattcttgtgctggttcctttcaaaaaaaacaatatatataaataaaagttggatttcttatcaaagtcaatgctgagtaaggtcttcagtttgttttgctcttaaaaagttaatgtatggaattggaaagtgtcgagtagataccaatactactagttataagagatatgttacccaagcaatatggggcatccaggtggtacgtatgtgatcaaaatatggataccagtgtttattatgacttttgtagccttagatttagaatttctagtgaaaatattcaatttagtattctacatgaaatggacatgttagctatacttgtcaactagtctcaagtcatttataaatggttactgaataaggctgttgtgttacttatcgctactaatgtgttaagaaaagtagtgaaattatttacaagatttgccacatcacaacttaatataatcacaaccaacaaacctatactacgacaattgccactaccaaagcattttgcatggtaatttgtgttactgcaagcagctatgtggttgcgtttcagcggctgtaatgtgcagccgaacacaccctgaattccctcctctatctccgcacccgcccaattccgaggcccccgctcaaacgttccacggaacgaaaatttcaccacgcccccgtgggaaaaaaaataccacccgtctgatcccaactccccaaaccagtgtttcacggtctttgcattggaagcattgcccccaccgtgcagaaacgggcgtgtacagctacagcagcagtatggaaaattccttgcacccaccgaggctgccctgtagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggggccgtgcccgtgccggcacggcacgcccgcggcccacgggccgttcgggggcacggcggcccgtgaaggcaggccgccagcagtgcactgtgcacagtgttttttttttttaaaaaaaaggaaaggaaatgtataaggaaaaaaaaattaaaaatggaaataaaatgtttaaaaaaagtaatgatttactaatgttaaaaaatgaaaaaatggtatttaaaaaatggaaataaaagttttttaaaaaagtaatgatttgctaatgttaaaaaaaaagaaaaaatggtattttcgctacagtaacgggccgcccgg

SEQ ID NO: 3130 - DNA, 1462 bp, Oryza sativa
tcggccagcggcccaagcacggcacggctacacgggccgtgccggcacggcccgttactgtagcaggccgtgccgggccgtgcctgctacaggaacggccgtgccccgggcggcccgtttggcccggcccatttggccagctctactgccctgcactgcatgtgtctatgggagcatgtaggcagttgtaaacatattttaaaaagataaaagagaagagataagagcagcgggctatatagatttatagccagctgcagcacaaagcatttgtgtataataagtgagaccaaatattgattgtgtagtatatatttataaataagtattgtatgaattggctattaagttgactacatatgttttgaagcgagcttggataaaacgcgctctcctttggataaatacatcaccgtactccgtagtactagtagtagacgacgtgttcccacctgtccgtacgcccgagcgagaagagcgcgaaaaagtcaacagtgccactcatcacccgacacacgtgcgcccgctctgacaccccctcccgaaaccccaaacccctttcccactctctctcacacaccacgtcccatcccgtcgcgtcgccgcacattcacccccacacccttgccgcgccgccccgcctgccgtgccgtccggcgaacctacctagcctagcgctagcctagctgaagccagcaagcaagtgcaaacagtgcccaggaccaccaccaccgccattgccgccacctctccctacagctgttcgactacgccattgtcgtcactcactccaccgtactacactcgccttcttctctctcctctccgacacgacagcgacttctccctcccgccaccttttccctccaagaaccaccccccaagaaagcccagaccagagagacagtgtgccgatggcgatggcggtggagggtgcgggtgcgggggtggtggtgagcgagccggaggtggtgtcgataccgccgacgccgagggggatgtcgacgccggatgggacggcgacgccgccgccggcggcggggaggggcgcggcgacgccggcgaggcgggtggtggaggggctgcggggttacctggaggaggtgggacacctgacgcggctgaacccgcaggacgcgtggctgcccatcaccgagtcccgcagcggcaacgcccgctacgccgccttccacaccctcaacgccggcctcggcttccaggccctcctcctccccctcgccttccccgccctcggatggtcaggcactttccctctgcttgcttcttcagtttcttcctcctctctgctcctcgcccttgccatttccctttctttctttctttctttcagtttcagagtgaattaatgcaggttttctgactgtctagtttttttttatttttcacttctgcttttactgatttggtctgaggtgggtaccgagctcgaattcgcctatag

SEQ ID NO: 3131 - DNA, 6724 bp, Oryza sativa
  unsure (1)..(6724): unsure at all n locations
nnnnnnnnnnnnnnnnnnnnnnnnnnnnnnnnnnnnnnnnnnnnnnnnnnnnnnnnnnnnnnnncacaccctcaacgccggcctcggcttccaggccctcctcctccccctcgccttccccgccctcggatggtcaggcactttccctctgcttgcttcttcagtttcttcctcctctctgctcctcgcccttgccatttccctttctttctttctttctttcagtttcagatgtgaattaatgcaggttttctgactgtctagtttttttttctttttcacttctgcttttactgatttggtctgaggttatggtttttgttgatttggtgatctgaggatgtaatgtgcatcctgtgttacttcagatgttatgcagtttctctggaagtgttttctttagttctacttttacttctttgatctgagattatggttcttcttgatttggtgacttgagactgaagtgtgcattctgtgttcttcagatgcgatgcggtttctctgaaaaatgtaattcttttacttttgggtttactgctcgaatgtaattcttttacttctgggttcatcttgctctcgaaatctgaagctgtaattttgcattctgtgttcttggtaggaggtaattggattgggcgtgggatatattttgattttactgcatcagtttgagcttgtgattctttgttgcttcagtgatttgagactgtaatatgcattttgttttcttgattggaagatgtaactggattgggtttggaaatcactgaagatttcacatattctccatcactgcagtgcatattctccgtgtccattcaaaaaaaaaatctactgaaagcctcatccaagaacaagacattgttgctttaatcatgctctgggtgtggagctaccccttttgctacactttggactttgttgtccaggattcttcttccttttttaaaaaaaaatcagattctttagatggatattcagtcccaaaagttttaaagcggtggtgaaattgtattgtttatttgtttttcagattgttccagcttgggatttcttacatggttaggaacgaaatgttttgatgataaatatatttaacaaaaaaaaattacaacactttttagcaaatgtagagaaaataactgaaactgaggggtgaaaatacagatctgaaacatcttttttttttttcagtttcaaggatttattcctgaatcttcagtttatatatgagttgattgagttcttttgttagcacgtgcaacggcctcctgtgaaaaagcatgctcagcactgaaagaaaaaactgtactatgattcaatacaatcatttcaaactgaattttttcggtgccaatttgtgccttgcaactggacacagtatcaactagtagtattgatactctgaagtgcattgttttcagctgaactgttgtacagtttgaaaacacatcctaacaaatggttctttgcactgtaggagctggggaataatatcacttactgttgcttatttctggcaactgtacacactctggattcttgtcaagctccatgaagctgtaccaggaaggaggtacaacagatatgtggagcttgcacaagctgcatttggtgagacatgttctctagtctttaactattttgcatgtccattacaattagctttctattccaagctggatatctctgacatgatttctgctaatagtagcactgagttatgagtaatgcaatgtatataatcatggccttaacaagatctgtgtcagaaagatagagagaatctcctaacagtataatgtgctcttccaataggagatttttgtgttttttggtgggacagtggctagtcaaatgtactaacaccctcatgattgggtcacatctggatagcttgaactgtctccattgatggataatagatcaccctcatgttacagtaatgcaaaatgtggaatcttttttgctaccaccattaattactatgtcatcattttaatcaaactgttgcatttgacagctcaagtaattattgcctctggttacaccaaactcagaacatgcaatgttgctaagattctctctgccgatctgatccatttgactggtgaaatgcaaaatcagcaagaatgtctgattgctcttgttttttttttcattcgttcaggagaaaaactgggaatgtggctatctcttttcccaactatttatctgtcggcaggcagtgcaactgcgttgatccttgttggaggggagaccatgaagctcttttaccaaatagtttgcggcccaatctgttcaccgagtccgatttcgacgatcgaatggtacttggtgttcacatccttggccatagtcctttcccagcttccgaatctcaactcgatagccggcgtttcactcatcggtggcaccaccgcaataacatactgtaccatgtcctgggttctctcggtcagccaaccgcagcctccaacagtctcttatgaaccacaagcatacacttctcttggttcatctttgttctccaccttgaatgctcttggaataatagcatttgcattcagggggcacaatcttgcacttgaaatacaggtttgtcctcaagaaaccaattcacaagagactttttgtactctacagttaccatttggtggttcagtgtttgaatgagctggaatctgtaatttttttcaggcgacaatgccgtcgactttcaaacatccagcacatgtcccgatgtggcgcggggccaaagtcgcatatgccctgattgcaatgtgcctcttccctgtcgcgatcggaggttactgggcctatggaaacatggcaagtactacttgatcattagacccaattgttgctgcacttaacactcttaagtcctaacagtccttggaacattctccctgttgttttccaatgcctgcaggtgccacagggagggatgctgacggcgctctacgccttccacagccacgacatcccccggggcctccttgctgcgacgttcctccttgtcgtgttcaactgcctgagcagcttccagatatactccatgccggttttcgacagctttgaggctgcctacacgggccggaccaaccggccttgctcggtctgggtgagatcaggcttcagggtgttctacggcttcctctcgctgttcatcagcgtcgcgctgccgttcctctccagcctcgccggcctgcttggggggctgacattgccggtcaccttcgcctacccgtgcttcatgtggatctgcatcaagaagcctgagaggttcagctcaggatggtacctgaactgggggcttgggctgcttggcactgcattcagcctggctctctgtgtgggtggtgtctggagcatcatcagcagtgggatgaagttcaagttcttcaagcccccaagctagattgaccagcaatttccagtatcaaacttgcaaaatcagtacaaattctggtgtgtttgtgatattttcagacaatggaaaagcatatcccagctggcctccgcattgtgggtgtgcttgtcatatggttatatgaatgatatatgatgatgatatatatggtttatcttacatgccttggcaagaacagaattatgtattttctattttgaacacaagaaaaacaacaatggaatttcaccgaaacaattataaatgatccaagattctttgcacgattcctagcaagaatcaagttatcactactaaggctctaggacaattcaaatggttttgggctgattattaactcttttatgctctgcttagctactaagaaccagttaggaacataataatttcattggagtgttttttttttgaaatgttttctcaaaagacaatgggcactatctagcaggaacttatttaatcagagtcaatgttgcgatcaaatgaaattattgcatccaaaataggggtaataatatcaattttaccatttttagttttttttaaccagacaaaaaagatacggtaacgtcacgaaaataaattatcaagatgactatgataaaatagcttcggatagcatgaggcagcaccaatgttttgttccaaaatatagcaactttaagctctcaggatttgttccaaaatataacaacttctccaccaacattctcttctcaaccaatcacaactctctaccatttacttttcccacatacctccactacttatccagtcacagccctccaccatttacttctacctatttttttaataaccatgtccaactctaaaacttcttatattctaggacgaagggagtataattttgcatgccattgacaaatatgagtattgtgacatttaaagcctatctttgtatggtaaggctgaggttaagagcatctgagttggtgacatacggaattttactttctttttattctcgtgtgcctacttatctattggacaggagcacaaatactaacagttgaattttttttttgttattataccagaactacacatccaccctaactgttcactctaaggtcattgacggccagccaggaacactagtgattgagtcatttgtggtggacattccacaggggaactccaaagatgacatacgctattttgtcgagaacttgctcaggtgtaacctaaggaccctcgctgatgtgactgagagccatgccgaactttgatagactttgccttcttttttttaggggaatctcattttccttctttgcttatggtcagaatagtcgggatttcaaattggtagaacttgttaaaactctaagaaataatggagctccttgatcagcactaactactaaagcttcttccaaagaaattaattaccagtgcaatcatagcgctcacttcagtttactacatatacatatgcaactttctggtttagtgtgctctagtgtttgaaaaatgctgaactgaaataaaataaaaatattccgaaggattgttctcggacttcatgtgcaatcaagtgtgttattcttgggtattcaactaatgtttccatatatgcatgtccctcttatcatcatgttccctaacttatttgagttcaacataaacacttatttaatttaacattatcttaactacaacaccatatgcccaaatgcaacatgtacattgtattgactagaaaggctaatttgtatttagaaaaaaaaacaaatcatgatataagctttcaagaaaaaaaaccaatcaacttgacaattatgagcatgatgtacctagtatagacatctccgccctttggatgctgaagagggcactcctcagccaccatgcatgtcctatctctacctcttaatcgaagacccaacatgcaaggtgtcgtccaccaagttgggcatccatccagtggcccctgcctccccaccgttggatctaaaggtctagggataagggacattacacgtgggccttagagccatcggcatcacacgcaataggttaaccttagagcttccgttgctgccaaagggcctcggagaccatgtcacgtgatgctacaatatgagagcttaccttccttccaatttgggctgcctgagcttggggggataacggatctggctactcccaagctcataacagctagatctggccacctcagatctcatgctggctggatgtggcatttcctatggtcgggttgaatggaagggaggaaggtggcaaaaatacagaactagtggcatggtcgggtgaagggagaatgagcaggtggtacgtcatccagagaagaggagggagggctagagggggatgaatggagatatagggggtatgaaggggacctcacgtggacaatgaacttagtgtgggatcgaggaatctaattcagcttttttttggctgatttcactaaaaactggtaatgttgtttcaaacatgatatatggtttttaacataaaccggttctttgaaaacaatgattggagggggggtgttgattgatgttttagtgctaatggttccttctgccacgtcttcataatttgattcatgtatgttatgatctcttccatatgatctttattagcaatctctgtggctttttgtgtgcagtactcatcacttccttgctgatcacttggtccttccatccttatcctctcttacctttaatttcttgtcaaaaatagcttagctttttgttaaatcgttcccaaatgtgtaaaaccatgtttcatttgtttgatgaaattgtgtttattaagatgcatacatgcatagaaaaattctgaacaagaattaccttaattacttgatcattggaatgtcctaacgtccaacataggatgaaaatgatatactacatgtggtttaaattacatggcatctggtagcaccaagaggaaatgcttgtatgtacttcatgcatcatttgccatatgtttatgccaacaattaatgtatttcacatttttagctttgaactgatattctatatacacctactttgaaagtgtgatgaacacatttttttatattttttattaataattctctacaatattggttggcataacttatttgagttgataacattttggagcagcctgggtgtgttttggtaaaagtaggactctagctctcagattctcatctcaaggagttaaataccctgatcagatttttaaaaatggtgtggtgtagtagaggttttttttttttggggggggggggggggg

SEQ ID NO: 3132 - DNA, 497 bp, Oryza sativa
cccccccccaacccacccagactcccacccccaacctgaactctaacctcaccactaccacagcaccattgccagagaagaggacctcgtcatcgctgttgccaccaccggtgagttcctcccctcctccctcctcaatcccagtgttaggttgaaggtgactgaaattcctagcaatttttttagggaattcctagcaattttaagtcacctaaaaactagtaattccctttcctatgtaaaaggatccgctatatatttaatcaaatgttttgctatataaggattgagtatatgcattcgtggatcttttgttgagccatatttggatctgtaaaagttagagccctaaatgcaccccttaaatacatttttcttttgaaaagaattggtacagaaatatttctgcaattaataggcgtttacccttttaagaccctcggaaattggctacttacacagatataaaaatttgaacattttccgctgtgcttggt

SEQ ID NO: 3133 - DNA, 544 bp, Oryza sativa
  unsure (1)..(544): unsure at all n locations
nnnnnnnnnnnnnnnnnnnnnnnnnnnnnntttccaggcgagttatgaaattagttttttcattcgtgtccgaaaaacccttcagacatccggtcaaacatccaatgtgatagccaaaaaatttcttttcgcgaactaaacaggcccataatatgatttgtctggtctctaaaatgtttttaaaatgtcactaaatataagactaagtacaatagcaaactataagctagctataaatatatgtggaggggataaaacaaagagagaagagaaatgaactatggatcttagcacgttatgtgtataagaggtgggactagttattaatgatgtaacatatatttataagtaactactgtaaaaatagattattagattactataaatgatttgacttttgaaaaaaaagtagttgattataatattaaacttgctctatagctctgtagttagtgggactgtttctaaaatnnnnnnnnnnnnnnnnnnnnnnnnnnnnnnnnnnnnnnnnnnnnnnnnnnnnnnnnnnnnnnnnnnnnnnnnn

SEQ ID NO: 3134 - DNA, 1390 bp, Oryza sativa
  unsure (1)..(1390): unsure at all n locations
nnnnnnnnnnnnnnnnnnnnnnnnnnnnnnnnnnnnnnnnnnnnnnnnnnnnnnnnnnnnnnatttttttttttaatatttacagaaataatctatcgaccaaaaaaattgcagaaatagcccctgccgcccaaatggtgggcagcaagctgacgtggcagacggtgggtcgaccgcgccgtctgccgccgtcggccaaaattgcgagagggcggcaaggggctaattgcaattttggccgcccattcagagcttgcggccgtacttttcatctgggtcccgagggcggcaaaggacccagatgaaaaaagtacggccaaaagacttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctaggtcgtagaaacattatatggacttaaacaaggagaattatgtaacatgaagaaatagtagtacaatttgaacatgatacaactatttacattgcggttacatagatgatattagattcgaactaggagggaggtagtgcaatagttgaacacaacgacgatgtaataatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggaatcatgtaatcaaaatattcttaccatgaaatcgtcgtcaagaatatttggacaaacaaagaaccttcgacccaatgttgtaagatttatggaacgaagaacctgacaacgatcaccacacctgcatcttggacgggcttcccatggagggagtgccgtaattagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacgatcatagttagggcacc

SEQ ID NO: 3135 - DNA, 870 bp, Oryza sativa
  unsure (1)..(870): unsure at all n locations
tctgcccgagcaacgtcgtctgcacgacaggtgagcactcggagaatcgagcgcatcgactccaccatccgcgtgtacgtcgtcaggtgctcctctacgggtaccggaatccccgcgtctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacaacacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgctgacccttgcgcgagtacctgcgaattaatgtgtaatattagtgtgaaacgacagatgttacaaattattgtgaacaggcagattttaatgcaacaacggaaagcgtagagcaagatcttaccggtgaacagcagctgggacggtggtcggaaacggtactggaaagggctgacggaagccgaacaaccgcatcacgcggaaaggggcgtgaggctcaacgcagatgtcgaagaccatcggaaccgtagtcatccagtacgcctggtccctggtgcagagtgtggacagacccaacggcgnnnnnnnnnnnnnnnnnnnnnnnnnnnnnnnnnnnnnnnnnnnnnnnnnnnnnnnnnnnnn

SEQ ID NO: 3136 - DNA, 583 bp, Oryza sativa
tcaaagacttttctcatagctacttgtatataccagccaactatggaaaacagaaaaaaaaaagagtagcatggtcactttttagtttttatccactcctcgtctcaaaatttttggaactaatatttaacaaaatgttttcctatagggacagtctattcccacttcctgaaaaaaaaggtcaattttttgtacatccaggattgtcttgagatttgttcatgaacagttaatcttatcttctcctctcgttttcccatcccaagcacgaccgcactaatgggcgctcacgggcgccatcctcccctagcccgactgagccgccgccgccgccttgatctgaacagttggctgaaggccatcaatagtgccagcacgttccgaccaactaaccgcctcctgctgcccccctccctctctttcctcctcccaaatccggcggctgcaccattcccctgtgctggtgtcttcaccagctcgcaccgccatcaatcaccatctccataccctcccccctcccaccggaacccacgcccccgctgccaactatcaccctccggctaagccccggggaataacaacc

SEQ ID NO: 3137 - DNA, 5607 bp, Oryza sativa
gaaggtgactgaaattcctagcaatttttttaggaatccccagcaattttaagtcacctaaaaactagtaattccctttcctatgtaaaaggatccgctatatatttaatcaaatgttttgctatataaggattgagtatatgcattcgtggatcttttgttgagccatatttggatctgtaaaagttagagccctaaatgcaccccttaaatacatttttcttttgaaaagaattggtacagaaaatatttctgcaattaataggcgtttacccttttaagaccctcggaaattggctacttacacagatataaaaatttgaacattttccgctgtgcttggtttgttgctgacttgtgcgtgtcatcactagctagtacagagcaaaataaacgttgaggcatgtgacaaccaaatttgacacaaggacaaagtcatagtaagtttggccagatttggaataaaccggagttttcacatggggaccggtcagaccaccactgtatggtcggttggaccaaatggtgaactgcggtcaaaccgccattgcggggctggttggaccgacagcctcgagtccgagtccaattaaggttattctcgtggttccttgcttggttccaaggtttcttatatcctaagtctaataggcatggagaaggtctatggaggcaagaaaaactcatttataaggacgatggcagattcaattctagaccaacccctatataattaaatcgttcttttacctttactttttagccatgttttctactttaccctttatcatctatctttatcaatttgcatcgtaaatcatccatcttcactgtgagaatgtgatatcctttgtaggtttgtcctgtaaaacttccgattcatccatgagacgggtggttatctccttattgatctaaatcggcctagagaatggttttgatccctcaattggctctgctaaccaatttaatatctgaaacccatcttggtttagagttttctaatcaaggtggttggcgactccgttaacactaaatgtatgttcctattcttgaatgatgaaattttagccgatataatgtcaaagtaatattattatctaatgatatatcttgtcatgcactcacactagatgacaaccactcttttatatttttaatttttaaaaattttgagctggctccagttgaaaaactagtaaactactagtcaaattcaaaaaaaatagaaaaggtaaaccaatctgttaacaatgaaatttggtaagcccctaagagaataatcatgtcgccaatagtcagattccttctatattcggttaaggaaattaatctattaaaggaaactaatccagatgtgaccgagttcaaggagaatgcggcatggcagtttatctattaattaggtagtatttgttagtttccttttatctttaggaaagtgtgtttagtgtcccataagtactttatgttttccttttatcttttaggaaagtttttttcttgtcttacaagatctagtatctacccatggatataaatatgtacacccggggtcattgtaagagctttccacgatcaacacaattcggcacatcgccacctttttatcttttctactttttatcatccggcggaacttggcacctaacgcggggctgcatcggctttcgatctccggcgaaggggtaagccctacgttccgtcggcgcaggcaattgtattggctatattggcgtcgttcaatgctgcatcagtacattcgacctcttggatttctctggtttggttgatatatttacctacctatttatcatatatcttagttaatctagtttagaatcttaatttacttgtatcagctgagatttgttttagggtttatgctggtgtcggctaaattatcttgctagattagattagctaaggtatccaccaccatgaaaattagtcaaaggcttgattgtttagactttatgcttctttgcatacttagtgctatatcagttgagtttgatctattaagtcgtgcttagaatcataaagtctagcatgtctttggttataataagggtttcatcggggtttcagccgatgaggtatctggacgttacatcggcttataaggattgcacatataagttggattcagccgatgataacaaatgtttcactgtttatctaaatcgatttgatcttatgacatcggacctccagctgatgtatactttaaccatcggatcagtgcttgttttaccatctcattgttagccaattggtttctattggatttatattgttattatattatattatattatcatcagccgattgtctttatatcattatctacattagacatatagccgattgctcaaaaccctatcgctatcgactggtatcagcatcggctggaatcactccatcggcttgtcagccgatcggctatttgatctactgtttacatatcttgtcagttgcaggttcaaactaactagcacggccgcatctcattaacttttggacctgcactagagctaagcagatctcccaggccagtgtgtgtttttcgcatcaacacaatcaaattaaaaaagtaaactaattttttaataacatttatctgaattttatccatttccaaaagtttttcaatgtttttcttttcgaaaaccgctagtaatggctttgtgaaccctgttcatacttcatatgttttctagccgagccctaaagcttcactctagggttagtttagtcactagcatttggctcaaagtagttcttcgatccatggaaaaggccatgtgagtgtgccatgccatcctcgtatgtaagtgtaatgatcaaataaccattctattattatatatatagtattaaaaaagaaagaaaaaacaaaaataagaacctataactcatgatagaaacaattttgagctgtcccgttatttctgttttgtttttctttatttttctttaatatggtgtgtgtgtgtgtaagggtagaatggtcattttgttgctataattatatatgagtatgatatgtcacacccacgtggccttttctatgggtccaatgactacatttgtcggagcgaggatcttctttagtgggaaggcatgataccccttttagagtttgaccagggtgcacattccgagctcgtgcactgggcacgtatgggagtgagtacacatggtttatacaggttcaggccgctcgggaatgtaacaccctactcctgtgttcttactctatgagatagtgtcaatgttacagtggaggatgatgatatgttctaagtggaagaggatgaaccctattgtaacaaggagataatgaaccttcttcactgagtttgatatatgaatctaacttatagcctatttcagtctgtccaattccaactcccctctctgtggcatggatcctccttttatacatcaagggggtccaggtgcctatgtatgcatacaaaagtggggcccaacccaaaggggttggtatgctagcttggtcttgtagttgtccatccaagcaggctgaccagatgtgatgaactcacctaccggccaatatatggagcggggcaaccgacgtctttgtcccaaatgtcaatggacccgcccgtcagcctccgatgctagtgaaaggggggcccgtggggtagatgttgagcatgtgccgcgtcacacgacctcttttcgaggcaacatgggcaagcaagaggagaaatgcacagtctcgttacccccacaccacccgtgatatgtccataagatgcgtatcactacgcaattaatgcagaatgacatggtaaggtagcgcataagaccaggtcaaatctccttaatatggtagattctcttgaagagtcctcctggcatagtcatcggggccttgatccacctgtagtggttctcaggcccccaaggtaatagatgcttgtcccaggcaacggttgtcccctagtcgtcttcaacagctcaagacgacacttgttacttcacttcatcttctactttgtacacggtgggtcctatggtgccccgagcattcaatggatcatcgttcccatatctccaacaaagttgaaccaaataatagattttagacaaattttgctacagaacaccgcaattgtgtgtatttagctcagggacaccgcgaaagtgaacttttgggggaagacatcccataatcgtggatatttgctgatggacactgcgccgtctcctctccacttgacgtgctgacgtggcaaacgggaggctatttttttgacgcggtcggacgtaagtacccctgtgccttatctcctcacatgcactcggtagacagacagcggcagagccgatggcactcggcgacgttgtcgccgacgccggcggcgatcggtggcggttctgacgatgcggctaaaagagaaagtggagagggcatcctgcgaatctataggtggtggttttgtgcaatatggtggccggaatagttgtcggcggcgacgcgagcggcagtgactctcggcatgccgagctccggctcgtttccatgtgagtgagtacatgcgtgcgtggctacaaggctcctggagattcactgaaggtcgtctgaggttcggcgatggatgggcggtgatggcgacctttgaaatgctccagcagcggcagagaacggcaggtcgacagcgtcggctccttctggccttcgggctgtcaaagggaggaaggaaacgattcaaagaccatatgaggatgctacatgtgtgaggaattgcgccaaagctcacccgggagcgaggaatcgaaggaaagagccggcggccggacttgaggaagaaaggttcgatctccttaacggcagtgcctcggatcgattcctccggcagacctccttctaggatgccggcgatgcttttggcgtagtggctcggtcaacgatggcttgagtcgacgggaatggcgaagcgacgcacggcggcgccctggacaccgagaacgccgacgagcgcatcttcatatgcttgatctgcggttaattaggatgcaaggacatggctagatcaggtagaggaagtagttcacgttcccatggataaaatgcgacgaagctcaccagaggtctctaagattggatcaaacaccttcgagcagagaaatgaggagggtgttcttggagataaggcgcaggggtatttacgtccgaccgtgtcaaaaaaaagcctctcgtctgccacgtcagcacgtcaagtggagaggagacggcgcggtgtccatcagcaaatatccacgtttatgggatctcttccccccaaaagttcactttcacggtgtccctgagctaaatacacacaattgcgatgtcctatagcaaaatttgcctagattttaagtacttgtttggaaaaactgaattatcaaggaccaaattgatcccgcagaaaaaaaaattatttaccttgttggctatttaccattccatttacatggacaccattgaccggtaccactcaatttttatcaccaataattttcaagtcaacaaatttgaataaacgaaaatcaaatggttatatttaacatacaccaaacttcgctaaa

SEQ ID NO: 3138 - DNA, 1293 bp, Oryza sativa
  unsure (1)..(1293): unsure at all n locations
ctataggcgaattcgagctcggtacccctcgtctgccacgtcagcacgtcaagtggagaggagacggcgcggtgtccatcagcaaatatccacgtttatgggactcttccccccaaaagttcactttcacggtgtccctgagctaaatacacacaattgcgatgtcctatagcaaaatttgcctagattttaagtacttgtttggaaaaactgaattatcaaggaccaaattgatcccgcagaaaaaaaaattatttaccttgttggctatttaccattccatttacatggacaccattgaccggtaccactcaatttttatcaccaataattttcaagtcaacaaatttgaataaacgaaaatcaaatggttatatttaacatacaccaaacttcgctaaaatagtagtagtcatagttcggaaataatagtgcagggtgttgagtagcagtatttaggaacagaggaagcaactgtctatttttttttagagaaggctttttttaacccagcctctatatccaaccagatatatatagccatatattgggaagcaactgtctatactttacagtgaaaacataagcaatttttttcactattattattttattttcctattatctgtgcagcatgagtgattttaaaaggagaaaaatctgagctttcttgcccctggatttttcaactttttgaaaacttattttacaaatatacccctagaaaaatttattccaacgatggatccttttcacagcgccttgttccaatatgtaacggcccgtcctctagaaccatgcagtccaacccatccgacaagcaagcccatatacacatatcatcccacttacactttcatcatcgcttcgggtaaaaggttgaacccggaacaagaagtgatatggctggaggtataaccccttataagttagttccaccattgctaaactagcattgtgatattaaacatgcgtacacaactttcatgggtcacacatgccaaatcataattggccagaatttcacacaacatgacgtcgccaatgatattggcgttgtctccctcgcactcccgtggaagctaagtcactgatgtgaaagggatcaacgttatgtacctatttataaaaagagtaaattgcatccacggtgcatcaatttggtaggtaggtgcatttggtacaacaatttgagaaataaacgttctagtgcaacaacttggtaggtaggtnnnnnnnnnnnnnnnnnnnnnnnnnnnnnnnnnnnnnnnnnnnnnnnnnnnnnnnnnnnnn

SEQ ID NO: 3139 - DNA, 2353 bp, Oryza sativa
catcaatttggtaggtaggtgcaatttggtacaacaattgagaaataaacgttctagtgcaacaacttggtaggtaggtgtaatttagtataagaactttataaatgattgtataaatgcaaataggtacgattttgatacagtaaactaagaagttatacgacaacttaattatttgaagcaatttttttatatagattcatttttaagtaattattttgacaatatactagcgtggatttgtataagcatatttatatttttatcgtaataatccatagctgaaagtcaattaaactggatgtaaaaattattatatttcggttaatatttgagaagataaagaaaacaaaaaaatcttaaagataattggatgtaaactatatgtgcaatataattcttaaagattaaattcaatatttaaggtaatattcgtaggattactatgtaatggcatattgacatcgtgaaaaaattcatctagcatatgcttagccaaattgatgcaccaaaatatcgaattatcaagttcttataccagaacgcacccacttgtcaagctattgtactcgaacgttcaattcttaagttcttgcactatatcacacccacctaccaagttgttgtactatgggtacaatttactcttataaaaatttcaaaaaagatatatttgtaataaaaaaatatgtataaatatgtcctcgatgctaataacgatgtcattaaaaacctattgtatatattttttttaatttcaaatagatcattggtgtcaatgtcatttgtaaaataagtttttaaaaatgaccaaaaggtaaaaaagattcaattctcgacaaactaagaagtattaggctgtgtttgatagtagagactcattagcgtatgattaattaagtaaaatacttaaaaatatatattaatatgattttttgaaaataacctttttataaaaaaaatttaaaaaaaattacaccaatttgaaaaatatgtgcgcgtggaaaatgagagtaagttggaaggatgggaaatgaacagagcctttagtatatgggtcgatcggatcggatccgacggctctgattgcatccagtcccagcaccgcccggactcaggaggagagtgacctacctacctatacatctcctaccaacttggaagagagaaatcgtgtcaaaaaaaacaaccaaaaaacagccaaaaaagaaaaaaaaaactcggagagcggaatagaggccaattccaaatccgccatcgcatccttctctccatccaccgaggcggcgccaccacctctcgtccggcggcggcgcggcgcgacgctccatccccggcgaaaaggccgccggattccctgtgggggcggcggagaggcgtcggaggaggctggcgccggcgcggcgacaaggttagctgataaacttttttttttttggggggggggggggggggggatggcctgtggggtggggaaggcggcgaggtgtgtgtggcgcgcatacccgcatcaccgacctagaagttagccatctttcgtgcaattcctctcgttggggaagaataggcaaccgggtcgtttctttgacagcaaatcagacgttcttgttcttggtcaaaagaataatctaatcgatgcccctgtttatcagactaatcatttcaggtgattcaggtgaggattatttggtcctttggttggttactagatgcgtagtaaacgccaagagaaatcctcacagatgtcaaacaatttcatcttatgtctttctgaaattacctttttcagctagtacatgtaaactggagttgtatatatatgtatactcgttggcgttgattgctttctccatccattatgattttgcagcttaattaagcaaattggattcggatcacaaaggaggcggtgcctgtagaaaagccatggcttcttcggtgttcaaggcgatggcagagaaggcagggccgtctgtccgaaagcaggcccttacgctgaccgatgcagcggcgtcgagggtgcgccagctgcttggcgtacggcagcgtgcttatctccgtcttggcgtcaaggcccgtggttgcaatgggttgtcgtacacaatgaattatgctggtattcggtttccccgacgttttagatcttgtttatcatcttgatatgcgaataagctctgggtctcttgttctactgttgcgaggaaaaatttagattccattgtcactcttcctgaaattcctatttgggtgctccctgataatgtccattgcaaattccttttagagccttgtgacaagataggtcaaaaccataaaagaggtattagcttgagtatgcgaataagctatttgg

SEQ ID NO: 3140 - DNA, 11037 bp, Oryza sativa
  unsure (1)..(11037): unsure at all n locations
nnnnnnnnnnnnnnnnnnnnnnnnnnnnnnnnnnnnnnnnnnnnnnnnnnnnnnnnnnnnnnnattcggatcacaaaggaggcggtgcctgtagaaaagccatggcttcttcggtgttcaaggcgatggcagagaaggcagggccgtctgtccgaaagcaggcccttacgctgaccgatgcagcggcgtcgagggtgcgccagctgcttggcgtacggcagcgtgcttatctccgtcttggcgtcaaggcccgtggttgcaatgggttgtcgtacacaatgaattatgctggtattcggtttccccgacgttttagatcttgtttatcatcttgatatgcgaataagctctgggtctcttgttctactgttgcgaggaaaaatttagattccattgtcactcttcctgaaattcctatttgggtgctccctgataatgtccattgcaaattccttttagagccttgtgacaagataggtcaaaaccataaaagaggtattagcttgagtatgcgaataagctatttgtctcttgttaaactgtggtcaagacagatgtaaattccattgttaccctttcttaaattccttggatgcttcctgatatttgagcttgatgcaaaattgtcatatctgatcatattcctttcaaattccttttaatgccatgcccagcatcacagttgtcttgcaagcagtagcaagagagagtgttctttggtgtatgtctggagccagggctctcaatgagttattgtgtgatcgcttcctttggatggttagctgctcctaggaggtctttttgttgcacatcgctttttgtgatgctttttttttcctctagagggttccttctttatggatcacctctgttgtacatatttctgcttcttgatgaaatgaagcgcaagcctcttgcgttttcgagtaaaaaaaatgtgttaaaaccgtcaaatttgtttgtcactatccacaaaagagttattagcttgagttcataataccagtggacatttgttgtgtctacaaaggtcatgcttccctaataatatcaggtggaacttaagcgtctagaaaatgaaattagttctcaactggattgagcgatttggctttgtttgttcacatccttgtcttttcagctctctagcattagcacatataagttagccttttaggatgttggttgattccatatatgaactttatattccaaaaggtacctttgagccaaattaacaatggtttacctgcacatgttttagggtgtctctcttttgtgactgggcactgaaggaatatgtatgcatgtttatttggaatgacacctattcttcttcacagcttctgagattataccatcttgctaaaatgtgtagttatttcaatcccatagtcacttgtttgtgccataattaacagatgggcttatttctgtgcttaattgtttggctacaaacgatccagttaatctgactaatttatgaaacttatactagtattgtaatttatgctcattatttctcagatgagaagggaaaattcgatgaacttgtggaagataaaggagttaagatactaattgatccgaaagctcttatgcacgtgattggaaccaaaatggatttcattgatgatccacttaggtatggttattttaacgtcttttttctttttcttcttttgcaaattgccattagtgattctttgtcttgtaggtctgagtttgtgtttatgaaccctaattccaagggagaatgtggttgcggcgaatcatttatgacatcaaccaaaaacaaaggcccggcatagtccaccaagttttggcagcgatttgttgattatttgatgtatagaagtatgttgctaatttgctatacacttcagtgacccattgtagaggaaaatttcatttcagctccattgagctgattatccttcgtcactcagcatggttggcacttgttacctttcacctctggattggatcatctgcagcaaaggaggatactgccattcccctctagcacgaaacatccaattgcaagatgcctcctgattgcatactctggtgagaacaatggaggtcagcgttccagcaactcgcctgagggatcatataacaggattttcggcattccatccactcgctaagggatcatataacagaggtcttgtttacatcttgtaagatggcatccaaggatagatgtggcattgttttttttcctcttttgcaccatgatctgataatcaccttgctgcatgttcatactgagattttgatctctcatgtaacgggattttatgccatttatgcttttcctggttggaagttgatgttaaatttaaccatgattattaacctacgagctgtcctgagtaatcatcatatcataggattaggttgtgaatcatattgttccatgttgatgagataaaaatcactaaagatagatgggtagatcaatgtcctaaacatgacacttaagctgtcgtcataagctaccatagtttgtattagtaatggtttagtagtagtttaatggacaaatgcaaagttggctgatgcctcctggatgacctaagacaacctgtttccaacgatagggtttctcctcgtagatcctcgggtctacatgtcagtgagggtctattttcacatgtagagagcagtactgcatctcaattggtttcgaacatgaacccagttatccagccatcatcatccaacagaagcatgtaatctgatagaacatataaaacgaggaaaatagaacccatttcattaactgcaccccatgcacatagttcgatagaacatttgaacgccattccattcgagaatccaggttcaatgttgggaagaaaccgccacctgaacaagctaaaatatttcaaagttatgaaccaatgccaacttctcgagctagttaaggggcagacagcctgcaaaagcatattcaattcatctagtggacaaagttgaaccctagctaatctacggaacgtcgctgaaaattcgcctaaaaacaaaaaaagaaagaaagaactcaacgcaaatggaactagaggctttctccagtgtatttactccaatacttgttgaaacacagattttatcatcatgagtttcttcccaaactgtcccccagtacaaatcgagggcaaaacacccgttgcagtcagttgcgaggttgtatacagctgggtaaaaacatgagcatccttatgcctgtcactccacagcatatgcccactttgatgtcacatggcagcgatctcaggcagaaaatgcatatgttcgagtaacatatgctgatcttaatatgttaagttccaagccaagtgctcactttccagcacatcgctcaaaatcacaaatgatctctcaatgtcatcaaaactaaccttcaggccgaggccttttatagtctctttcacctcgctcatgagcagtatcatgactgtcatggtgctttgagccatgggaattgcgctgttctttaatgtcgtccattggggcatcttgagcagtctctggtgtattctgcttgccaaggtgcccattgcctgtaacttgatcagcatttctatgatccccccgatgcataacatgaggggaactctgcttcctctcctgctttatcttattatcctcaacagccaattcaatgtcatgttctagttgcctctcaagatcatcatcatcatctattacctctaccttcctagcaacatcacctttcagtttcctttgcttttccatttgtgctttcaccttatccttgtcaattttatttaccatcaaggatgtcacattcgtaccatcattgccattgcggttgacatctctgatttcactggagttgccatgtgatggaagattcttattttctgtcatggactgtttgtcatgatgtaaaccatcgttggcaccaaaatcaactctacttccactctgattgcttcttgttttgttgctcccatggtcaccattgtcattttgaagcattttctggtccacagtttgcttttctagatttgagtgctcgacaccatgatgacttggagcacctgttgaatgctgtgaacttgactgtttcgactggtgaggaagaggtgtttcctcggattttacagagactcgctgattaggaacactagcagagctcccttcagcttcatttccatgggacggttgtgcctgtgctgcacagttttgctcatacagctccaacatttgattgctaacttctgcaatcaagggagacatgcattattatctgatttaacaagaacccagaaaggaatgtgtcatgatcaaattgtattatcaaaaagttaaataagtataactagtgcaacaagaataaaaagacttaaaatatacagcacctagtcaatgtaaatttggattgctcatagcaacttagcaagcacaaatcaggttgcgcaagatgacacgaccaaaagaaaccggtttctggaccctatcaaattttcgaaaactggccacaattaggcttttccagaatttctgtgtatcctggtcagctttcattgtaatgtttatacttaatatatagtttggcaggtccccactaagaaaaataagtgcattcagccagttcagttaaccattgcacatcagcaggccaaggtatgaagataaacccttgtgaactctaaaattgacccctaatgcagtgcttatgccaactgaccccaaaaattctagccatcagatcgaacacaattagcacataaaccctcagatcctaaccaaccagatgctttgattagacagattgcaattgaaagcgtgtgcttatgaaaccacgtgaactatttatgaaatcacacatacccatggagagatttttaatagctccctttagaaggtagaacatacaaatagtaataacaaagatctgagaatctgtatgctagtaattcattagaaagactactacataagctccacattatgacccaaatttcaatcaatacagcagaaaataagaaaacaagaacatgctaatgaaaggcacaattactattccaccaacacccactacgaattaatccactacgtaaatcaagcctttcgcaagcaaccaattatctgttcaaagcagggcatagcagatcagtaaagaggcgaggatctgagcatggcatcacacagagagcaatgccaagatggtcgtgccagaggtcaggatggaaaccagcacctcagtgctgcaggccacagtgtagacctcagacagcatcagcctcagcaggccacatgctttgctccaggtacatcattcccagaatcagtgaggggatgaagaggggagaagaaagaagggcaaaaatgatgaaatggtataggtaagaagttttagcccaagttgtggtattactacttggtacccagaaaaaattaatattttttggtacctggccaaattcttgtgaacttttttgtccttgcctttctttgaaaaaccttgtgtatgacggtatgtcagtcttaacccatccccccagaatgttgcagaaagttaatgtagaaaacaacggggtgtaaaccttttagaaaaaggacagctgacgatgtgaaatttaaaatcgaaaatctgcacaagttgaatacaaatatgtacttttctgaaacagaggattatcaaaaaggaagccgcgtagtgtgaaaagtatttctacaaaccatgaccaaacatagcatctgatgattgcaagatgatgctgaatactttagacttatattccctgctcttctgatgattaatttctatttcctagtactactatggaggcatggactaataaaatagaccattctaaatccataacaaacctaaggaacaatgtgttcttttctagatgtatattaatttttgtgcaaaatccaggaatgaaatctgttgatgaatagagtaataaactaatgcatcagaacagattctccattgcttcaactagtatacaaaatttaaataagctgcagcgcaacattaactgcttcagcagccagcagtaaggtaccaaagcaacctagtcaacatgctcgttaaaaaaaatatgcggtttaaaactcaggagattgttgtaaaccgtcatatggaccagatagaagtatagaacacaacattatctaggcaccaaccttccagctgtcttggagtcacatcaaactcctgccaccaaaccttctcaccatcagatggaagcttcactttgagaaatttagcagccaaaaagatagcacctgctgcaatatgatgaggcttgaactgcaggcaaagcgaagtacgcagcctgtacaatatacgccctttttaacgtgttatatacatgattgagtgatatctctaaagataataagggtatcaatagcatacccatcattgacaaaattccatgcaacctgagcaagcgcattttgagcaactttaaattttcttattgcttcaaccaaaggcttgtatggatgatgcacattcaaatcaaacccaagagttgcaagtacaactcgctccgcaagtaaaataagttctttttgttgatcatatacttcctgcagagacaattacagaccattcattaaagcatcccagtggaaatcattgcctggtgcaggaagaaaaataactccgtccagacaatctcccaaagcaggaaatatcacgtgcagggaaaaagcctatactactatcaggagtcataaacgctataaccctatatgctagccttggattgttttcaagaagcattagctgagaatagaagcatacaatggtgactatttacttccatttttttttacatatgcacgcagtaaaaccaggacggaagtaattatcacaggcagatgccttgatggttaacttaatcacaaccaacatgatataatacaatgaataactgtcagatgttgaaatttgtttacatgtaatttaacctcacattcttgattcttccattagataaattctaggattcaaaaatgccgcaaaaaaatcaaaaaggcgatgggtaatagttgccaatatagccagtaatgtttaccaggaaattgaacagtcaaaatacttagaacatcaaagaaaactaaatatcaggcaaaacggatggtcctgctgccaaatgcagatcagagggatttttttttgcaagaaagaaaacaaattcataaaattaaagtatatagcaaaagaagcatctagtttattgttaccttctgcttgattctctgaccagcagcaggatcctttttatgaataatctcataagaaaccagaataacatctttcaaaggcctaggcgtctcttcaacttttccagccaagaacatgcaaactgtggcaattgtctgtaagaacggtcagtacaaattataagttctctcttcaaacaggtacagatctataggacaacacttaacataggagtaaaattaagatcatgcaatcaaaagtttgcgacacgagaatgcaaggaaaatgagaatagaaaattatttcgtttgatacatggtacaaaatactaaacaatctcaggacaagtaaaacaaactcacatgcactacaatactgtctctttccattggcagtaagaatttgtattcatttctctttctggttatagctctgagcttttgacactacaatactatagacatagcaagttctacattatatttgttccagttaattccaacatttaaggcattatccggaagcatctcccactttttcatgtgattttcaatgctttcatgtgtattagcttaaatcaaatatgaaagtgttgtattatacatgtgatggctaaaagcattcaagattcgccagctggtctgcacacagatagcgcagaagattgaggtgttccgtttgagaatcccgtggtagctttataaatgctttaccgccttagcggtatcatatccttgcttggtttccattcacattggttctctcgttcattttatagcaaaaccttgggaaatgtaaaaattttccaatgttacagtagggacaactttttcacaccactcaccaatgctcccctaactcctaactacatagaagattgataatggggcaaccactggtcaactttaatctggatcattaatccgtaacctccaccaacaactatcaaatatatgtggtacttttatctcataacaaacagtgcagtcaaaagcacaaaaggcgctcgcctagatgcaaaagcaagcgaagcgcagggtcgcaactaaagcacctagagtagcttaaagcacaatgccgttggtgagccaactttaggcttaagaacaaggcgctcagacgcctgctgccttctttttttctgccagcttgattcaggactcatattttgggcatcttttgttgaaggattaggttattaacttcttagcagaactttattaatgtggcacgctatgtatattatagcagccaaaaactacttgaattgcagtttgctagtctcggaccttatccgttatatatttcttaactattagtttgtttttggtcagctgccagaatcaggcatggagcttcctacttaggggtagacatttatgtttttatattgtgctccatgtgtctaaggcacacactttttaatgctttgtacctgaggcaatataatactattgcgtcttagtgtacttttcgctttaactgcactaataacaacaacttcagtccctataaattaagtaatgaagtccccatagctcttgtgatcgtaaaatgcaaatgtcaaagtatgtacttccccgcgacacaacttctatatctataaaatattgcagttttcatcgctcctacattactatccatacagaaggaaaccattttcttgttaaacatgttttagaactagataaaaaatgcaaatatgtcgttgtaatataaaggctactaactaaaagagaaatagccatccataaaaccacaaaaggaggaacgaaccaagcattgaaagtacttactcgtctatcattttttgcatgggactgacgaaggtaaaaacggtgacagaacacaatagctgtagcaatagtgacttgtggcctaccacagaacaaaaggcagtcattgattggaagtagacagaatgatattatactccataaataagaaaaactaaacaatatgtagtattcacatgaccagaacaatttgcatggcaatcaagggctaaaatcaatgatataaagcacacattctgcttccatattttgataatatacacattcaacaagtcgaaaccaaacaattaccaggtcctcataaatttgaaagagataaaaaaacatcttctgcttctatgttgattatatacacataaatggatctcacatggatgtccaaacaaaggggtaaatagattgatcaagcttattagaacaaatcagaccaaaaataagctaacggcttacaaattacaaccacaatagatatacttcagttaagtttagcatcctttgaaaataataaagtagaaatgcatgcatcatggtaattgaagatcataataatgattgaaaggaacaagttaacatcaacaatgaaaaatataagttaaatcaactatgatcttacactttaagcctcatgcccaaatcttgtagaaaagtacaatatgattttcggaggtaagactctttcttcaaatcaatgccatccctcctggatggagaattctcttctatttcctttctactgaaataccatgaagcaccaagttcaccagtctcctcattcctgccctgggtagttctgtatgggctattttctacaattccatgatgtgatgaatcacttggcatcatagccatgtaaactcgctctcaactatattgagaaaggactgatgaagatattacttctttatctattgaaagtggcctgagcagcactgaacgaaaaagatacagtaagtgtttataaatttactaaggacaaaggacaggataataagatacagtacaagtaatgattaattctaaagtactaacatatggctttatgctcattccaatctgtaagttcgaaatagaaagagcaataggatgataatcatgctttacaagtcactagacccattaataccccactaccagagaaaatggcaaaaagccaagaatacgtctagtagtacacgttgtcgaactatgaatgcagggaactaatacagattatggtttataacattatcgggattatgctgtctaaagtttctaaagcatagaactagacaagtaaaatttaatcagcaaccctcgttacttccctaagatgcaaacctcattcaaaagcataaatcactttagatcaattccaatgtctatgtacgtattggtcctgatacaccaatcaagggtggtcgcctggttaaacagaaagatttaaatcgattattgatttatattatgtttgcaggctaacgaagccctatccccagtgatactcatcacccacaaaatgcatcatacatctcctaaaattgcccatccagtcaggctctttacacgaaacctaattacagtcttacacatacacaaagtggggattcaagatcttgcaaaaacatgacccccaataaacctattcgagcatggcaaacaatcatcgattcattctgacccgcagcctggctagctgcgaaccccccatagcctggctgacgtcgtccacccgtctagctgacgttctttcctattcacgcagatccgcgattcgaccctactcttctcctaaaaaggcgatcttgagcccaatacatcccgcaagatcacaccttgaatcccccatacccccgcacgaagaccatatatcgagccgaaatggcaccaatcgcgacacctagggtttcggaattcattgaaccgcacagctatcgaaaaatggcaagaacgccgcacctagggtttcgattcccctccccgctccgcgaatgagacccgccatcacgagacgcgagaatcgaaacagagagg

SEQ ID NO: 3141 - DNA, 1490 bp, Oryza sativa
ccccccccccccccaccaccaccaccgagctttgcttgcccctctcgcgcggcgtgcgtgcggccgccgccttctcctcctcgtcgtcggcgagggctgagagggcggaagggggaagagaggaggaggggcggcggcggcggttcgggtgcttctcgcggataaaagcccccgcgttgcaaaaaccctagtctttcatgtgatttttttttggttcccctttggtttcagagtttgtttttctttgttttttttttcctataggttggggttttgattgagaatgataatttattttatgtgttttatatgaccgtagtgatattatatcgattgatggtttggtgttggtgttccgtataaattattattatgcgattggaagttttgtttatctgtttatgggccatggcccatcagcagtgacgcggtgcatgttctatttggcgttacgcttttcttactttcctgataaacttcttctgttttttctacatggcatgtttcggtacatgttctatttggtgttacgcttactttcttgataaacttcttctgtttttctacatggcatgtttctaaagagagtgaactttttttctctagcgctgcatcaacaaagaatggaagacgtcactaccatatggcttcagctctagccactctcttgtgtaatatactttattaagtgttttggtgagcaaatattttgttgcatcaaagattattattcatttaacagaagctttatttcaattgtaacacgttttttccttgttacacaaatattttgttccaacgagattttcgtttgttacattaagtatttttttaaatagatacttttattttctacatatgtagttaaaaagaagtgttcaacaaggaatttaatttcttatagaggagtgctgctcattttgtgtcatagatattttttggctattgctttattgtattgtgtgatatatgaagatcactgatgtaattttttgaaagaaagaaattgataaatggatgtattattctagggataatttagttgttgattattgtttaatagaggtggaaaaaccatagcttggtactggttgatgcatgggcctatcgatcaatttgacaaaatatttgtgctatagatgaaaatatgttatatgctgcatatggcgtcattcctaccccgcgtcatatttttgttgttcctattcttttcatacctcatggtcttctttccatcatatcattattcctatttttaccataaagctttgtgttacctttggaatctttcatgcatgataactgcccctcctagacaaacagtcacatagatggaagtgaatgtgcaaaatccattcatcatatcgttattcctattcttaccataaagaggccacatttgtaatctttcatacgtgctaactgcccctcctagacaaatactagtcacatggatggaagtgaatgtgcaaaatccattggaagcaaca

SEQ ID NO: 3142 - DNA, 9302 bp, Oryza sativa
  unsure (1)..(9302): unsure at all n locations
nnnnnnnnnnnnnnnnnnnnnnnnnnnnnnnnnnnnnnnnnnnnnnnnnnnnnnnnnnnnnnataatttagttgttgattattgtttaatagaggtggaaaaaccatagcttggtactggttgatgcatgggcctatcgatcaatttgacaaaatatttgtgctatagatgaaaatatgttatatgctgcatatggcgtcattcctaccccgcgtcatatttttgttgttcctattcttttcatacctcatggtcttctttccatcatatcattattcctatttttaccataaagctttgcgctacctttggaatctttcatgcatgataactgcccctcctagacaaacagtcacatagatggaagtgaatgtgcaaaatccattcatcatatcgttattcctattcttaccataaagagggccacatttgtaatctttcatacgtgctaactgcccctcctagacaaatactagtcacatggatggaagtgaatgtgcaaaatccattggaagcaacattggtaagttatggggtttgtaggcaagtgaatccacctaattgggttcatgtcctcaatttggataggacaaagtataaattttgtgagacgtcctctagttgttaggcaagtgtcacagagacacatcacacactgggatgtattttgatgtgtactatatctctcttcccaagaaaataatttgtaggttgcccaaacaaaacatcaatcggaatagattttattcggtttccatttcaatgtacgactaacccaattcaattttgattcccattttcatttctagatggacttgaataacccagttcagtttatcctatgtaatcgtataaacaaaacggaagcttgtagagacaaagggctctaatacaatcactatttgtagtaacaggttatgttctagatgtttaacaatgttttttggggtatttttttgacaaagcagagttttatgtttaatttatagtattaactgtttcttctgctgtaatttgtcatttaaagcttaataacattgcatcccttgaaaagaaatatatcataactaaaatcaacgtcatgtttgtatattggcttctggactaaaaccatgtgcacctaaggctattttttcaatgaaaaattattcaccgtattattaaaatggcttaattgttctatactttggaaaataaattttcttctactatattatttagaacagttgtttcaagctatttgctaagtttatttcttaaaatatttaatttattcttaatagtctagtgaaaattaataatctatttcacacgaacctccggtaggaaatcaagagggaaagcccgtttctaccacttgaccaaagaattacatttcatttcttttccacttattttgtacagctagcaattctaaccagcaagcaccttctctagcaccaaaacagctatcccaaattcaacaaccataggagtatatgtagcagcttctagcaccaaacttacctgaactcatgatcacatcttctcatcattagctcatcactactcagtactcactcctctagaatcatgtcatgtggttgatgccaaccctgatcaatatcgactgactcttgtcatctctgttcctctactttgtcacctctgtagctataagctgccgtattgggaggctctacagcaagcaagcaagacattgatggacattggacaagatgccatggcaatgcagcagccatggccggcatttttggatccacgaggatactgttgggcaccctacgagatacacaagcgagcagcaacaagggtaagcaaacgacggttcgtgcagtatctgtgaagatgtgtaccactcccaacattgtacagttgcaggcacttccatcaatggccgtgtttagttttcccatattctcaactttccatcacatcatatcacatcaaaaacttttatacacatataaactttcaattttttttccaaactcccaactggccgtgtttagttttctccctattcccaactttccatcacatcatatcacattaaaaaacttttatacacacataaacttttaatttttttccaaactcccaactttcttcaaacttccagattttttcaggaactaaacacaatcaatgtgtatcaacgcaccctgtggtatctcgtactccccctattttaaaatataataacttctatctcttaaaatttatctcaaaatataataacttctccaccaatattattttctcaaccaatcacaatctctttccatttaattttacatattctcttaatagtcatatccaactctaaaaccttttatatgtgatttaatagtatgttcttgtgaagaattcagactgcaacccgacgcagttgggcacgctactgcctgaatgcagtgtccactgtccaatggaggtttttgcatgtacggcatgtaaaatctatgaattaggagtactctgctcaatgaatttatgatttttgtgttaggcgtccggtatgtctataggaaatacatgccactcagtgacataacccgaaatagttttgaattcaggcaaattttaatataattagtatttgctaaaaaaaatttcatcatcaatttactaatcaatattaaatcttaatggagttttcatcgatgagctcagacagctgctcgggctagctagccgggcagtggctccacgtacgtacccccgatgctacttgacttaaagctgagtacttttgagcagctcctcatgataacttttttttttccgttaacactttttaattgcttaatgatatgtttctatataaaagtttaataaaaatatcaaataataaatcctttttaagtttaaaatagttaataattaattaatcactcgttaataatttatgcatgaaacatactagcccaaaccaaattgttgaatggaatagtactaccctaacacttaacacgaggacacatgcagagaataaacctcaaagattgaaagtttgaaactatccttgagatacatatatgactaggggtggacaggaagctcgtggctcgttagctcgctcggctcgtgacacgctcgactcggcttggctcgtttaaattttgtaacgagccgagccaacattttagctcgttagtcatagcgagccagctcgagctggctcgcgagccaaaacgagctgaagcccaccagtggacagcccatcaaacgaggcttagtagcagcccaatcatccacgaggcccaccacagcccttgatatgccaaaccctaggctaaaacaagcacacaagcaggttaagcaacgccgccgccgccacgcttcccacgcgcagacctgcgcgctagcgatgcgtcgtcgtccttcccatccgcgcggctctcgtccagcgcccgacgccaccgcaaacgccgccgcccgcgccgctcttccacggcgcccgacgcggccatggacgccgccgcccgcgctgttcttcctcggcgcccgatgcggcagtggacgccgccacccacgcccgacgcggccgtggaccttccccggcgcccgacgccgcagtggacgccgccgctcgcgtcgctcttccacgacacctctccaccctttgttcgctctctcttgtccagttgtccccaaagctcacgagctagctcgagcttacaaacgagccgagccgagcttgatttctagctcgttaggaagccagaccgagtcgagccgagccagctcgacatccacccctatgtatgacgtatttcatccgtcctaaaaagagccactcctatattccatatgcaagtttagtagtagcgtgaaaatactaaagtgcccccaataactacttccgttccgatactgttgtttctctaaacccaataattacacagcatatacgaagaacacaagcgacatcttgcgaaaaaaaaatccaaaaattcaaaattttcacttgccgaaagaaatataacatctccaatctgaaaaaagaaatgctttggacggtcaaatgcaagaattagcaagaactaactaccaagaacagagattaatcgtttgccttcaccaccgtacgctcgtgcatcctcttgcattagatcctctgcctccgccactgattgcgtcgcatccacccgtagcctccacctccatctgcaaaataacgagatgcacctgcctcaaccaccaccgccgccatattcgagccgaatccgtccgacagtgccatcatctgtattggatccgcctcctcaaaagcctctgcctctgcggccacatccaagctgccgcatcagggtgcaggtgtcgcatatgagctatttgcgaggatggtgggagggaaggaacatgggtagagcggttcatcgccaatgggaggggtaagagatgggtggaaggaggagagcgacggacgagacaagacgagaggaaagaggatgagtcaattctgtttttggttttttttttttaatcacgcttgggtgaggagagagacaaaggataagactgcccgctatcgctgtttctcgatgtatggagtagaaatcgttttttttttttggacaaagcctccaccccagtgctcagaaatcgtttttttaagatggaaggagtgcaagttttatgtataagaaactacgagactgggtttctttcaaagttggaaatttggattgaaattggtacgatgtgactgaaaagttgtatgtgtatcacaggttgatgtgatagaaaaagttggaagtttggatccaaacacagccaagattgaaaagttaatttgaaccagtggaacacaagaaaactcacaagagcaacaagtgcagtacactggtcctactagagcaagtgaagtacccggtaatcggtgccccggccggccggacaccatggcgcaaagctctgactgcctcagccttttcacctggcgatcgactggcgacgcaacacgacggccggcgagaaaccgatgcctcgtccggtcccatccatccatccatccatccatctcgctcgacagacacggggacgcgacgcgatggttcgacgacgacggatggcgcggggaagaaaggcatatatggcgtcgcagccagcagagagcacccacgcggggaaacaatcgcctgcaaaaatgcaaagcaaacctttgcctgctgcgctgcctgcgcgtgcgtgtgtggatcatcgatgctcgacggctcggtgccgtttctgcatgcgtctttggcagatgcgtagattcggcgacaggggtaccacaggacatacttcctcagtcaaaaaaaaaaaaaaaaaaaaaagacaaaccctgatatccgtgtccaatatttaaccgtccatcttatttaaaaaaattatgaaaaaaattaaaaagataagtcagcataaagtattcatcatgttttatcatctaacaacaataaaaatactaattataaaaaattttcatataaaacgaacagtcaaatgttagcatgtaaacccgcggtttgtcttttttagggagtatacgcttcagggggtgcagaatttttggcgcagaaaattcctgttcgagcttgtgaatatcttggccgtttaacgcgagtttcagtgccgctgctgggtcagagatgagttatgccttaggacaaccacaacatgcttaaaaaaaagtaaaaaaggaataaatatattgatgaagtgcaccttacacattgtgtaagccagcaatagaaaaaagtttcttgtggtgcacctcaaggttacaatcggccatagtgaataaataactatttttttctcctctacttactctctctctccccactatcccaaaaaagttagcagccatctcatatttttattttatagtggacctacgttaaagactatatatgttgtgcatcatactataacaaatagctaactatttatggatcataccttaagatgtgtatgcacattatacactgaccttgccattatggtacaagcttttatttactgtaacggatcaatttcgtatgcccttatggtacaagcttttatttactataacggatcaatttcgtatgattagagattgactgagttggtaaattaaggacaaagcacgggctgagtccatatatttgggattagttgggtgtgtgggttgggaataaagcacgtgtcagtctcatataattagagattgactggatgggtgcattgagtataaagtatagggtagatccatataattagggattggttgaatgggtggaatgaggagaaagtagttaggtggtgtttggttggaggggctaaagtggggctaaacttcagttcatctcataaaaacataagtctatgagagaaactaaatttagtttctaacttctaaacacccccttaatcttatggtggttacacacgtacgaaggagcgcacgacctcttgcgcatgatgagaaggacaggatgaatagatgagctgtggagcactgccaacatgctcgaaagtacagttattagtagtagtataaaggactacctatttaattacttctagctaattcaatgagctcaattttcttatcatcttgcatgccagcctatatgttttaaaaagaaatagaagtctcctttaattgcaaactaagaaagaagcccgcgcagatgtgcgggtattttgtttaatgtttatgtcaaaagcgtttcctagattcaaacataaatcactatgtcccggttatatataaatttgtctaatatcgccactacttattattattattattattttattttattatggatacttattatcgttcttttgaaacctgagtgattatttaatagatgaaactgtatttgtaatatcaaaataagaacaatacatcattaatcgactaaaaaaattatctccactactaacctaactgttcatgtcgatctgacttatttccaaatctatgtataaatattccaataatattttatcaaaaaaatatattataacaatatcgcttgtatgagttaataggataatactgttaaaatttgatatgaatgcccatctaacggatgaagccgaacatactaccaaggctttcttcctcgataccttaaaacatgggtcacatatcgacatagtcgtgcccatcaagaccatcgtggagaatagttttaacggctaattcactattagtaccctcataaaggattgcatcgttaagtacccatggtggcttaactcatccaaatgtatgcctttgctatatcatggtagtatagcaagctttattatctatgcttggcacccttttgagaatggaaaaagagaagacagaggtgattacaataatcctttttaaagttttgtggtatatagtagacacaatttgtttatagtgtaaatcaatattactcaaatttcaataatacatatacaatattcttatttgaaagtgagtgaggttatcatgttagtagagtgtatgacatacatccatcaactatgcccgacacatcggaattcctgaagtataagaaaatatattatgggtgttactggattgtttatttgttgccaaaactatatgacaaacaaaaaacctacatatatgaccatagttctcatgatggattaaggggttgtagtatagccatatcactcgctagaagtatttttaataaagtttatcatgtctatgtatcatgtgtgcttctcacttttcaaataccaatcaaatagttttgaaaaattcaaaaaaaaatatttgagaatcgtaatatctcacatattaaaattagataagatctacttgaaaaaaatataactaaattctgttgttttcatttttcatttttacatatgtagattcaaattatttgtcaggtgatattgtacaccataattatttgaaaaattattatgacattaattattatgtgccattatgtatttatcagttagcactaactactataggtcaataatagttcatttaattaaaggaatacatcagaattattgaaattgatatatatttaatagatgaacacttacagaccattgaattcatattacatctttgatctagtttaactgcgtatattggttgggtaatattttttatatcatggaaaatcatagtttagagaccattgattttctctgatcatagtatgtatgtatatttttagctatatatttttacttgtgtatatatgttactttgctttttcttacatgggagattttgtttttttttgggggggggggggttgttttttcaatagacctaatttaacggtataaaataacgggttcactaatttaaagtttgtagagtaatatattttagctctatatcatagaaaatgcaaagggtgatggtatggctcacactattttttaatttataataaaacatcaatatatagatttaaattattgatttaattgtcaagaatataaagaactaaattgatcataaaaccaacttatagttttcaaaagttaaaacatgcatggagccctccacgaagatgacactgacctaatttaaagttcgtagagtaatatattttatctctatatcatagaaaatgcaaagggtgaaggcatatatatggctcacactattttttaatttgataataaaacatcaatatatagatttaaattattgatttaattgtcaagaatgtaaagaactaaactgaccaaaagttaatacatgcatggagccctccacgaagatgacactgaccgtgataaccatgaaagtctacattcaatcgaagatataaatcaaatgttgtttagattttattatgctttagatatctcaacaacctaaaaataagaagagcagataatgcatatacgtgcttgagccgtgagctgatggtgattatcttggctggtcgtttgggctggtgcttttataattaatcttggcagtgatttttttcaatcatagttatcaatatctttggtttttatttcgttcgtacatacgtatagcttttgcctttttttttttcccggatgaattgtacgcaaggattttctcttgtatgtgaataggatattgggagtgagagattatttttttagatttaataatttaataatttaattgtctaaaataatggtctcttagctttaagtgaaaatcgaggattaaatgttttattttctctaagaacttctatgattttctttaatttattatagcgctacttagcaacgtagaagcatttgtagagtgacacatggtgacgtgagagcgtttgtaggaaatt

SEQ ID NO: 3143 - DNA, 24408 bp, Oryza sativa
tggacagagtataacaaaataaatgataattacatatttctttagtaaataaacatatgttcaaacaccaataatattatggatgtatattaggtaaagcaaaataataaaagaaggtgtataagaaaaggaaaaaagtctagggggtatgttacgttcgtacttgtacgtacgtacttgcaggtggtgagggaggcatacgtataagggtctatttttaatctaatctaatagtgcaaaattatggacccaccaatttaaatgaaaatcgagggtcagatgtttctaatatattaaaacgtcacatggcgacttaggagcatttatagaattgtcacgtggcggcttaggagcgtttgtaggaagtttaatggacttttagtatataataatagatagatagatagatatatagtggaaaaatatatattatgctctcacatagtaactagataaaatcatgtgcgttgccgtggggaaaagtttgtatgatagtgatatatagaaataaggtgtacgacagatttgttttgttactcgacgatataatatgcatatttgatcgatcatgttaaaaaatgataaaccatttagaaggtattagtttatgacaatttaaatcatatatagattgcaaaattaaagtgatgccacttcacgatagaagaaaatgaaggaactaatatatatggatcatccaaagacaactatggtggtgtggttatacgggagaagaaaaaagaggcaattttcaccatagtttaattatttagggttataaatattgaagtgttgtggtttaatgagagaagagaaaaaaatactacctccgtcccaaaataagtgcagccatagatatccgtgtttagcgtgttgactatccgtcttatttgaaaaatttatgaaaaatattaaaaaaattagtcacacgtaaaataatattcatattttattatctagtaacaataaaaatataaatcataattttttttcaaataagacgaacggtcgtacgttggacgtgaacagtgctaaaactgcacttattttgggacggagggagtattaactacactaattatataggcatatataattaactgggtataaagtatatctcaattttattaaattatggtgtatattttactgtatattttatgttttggactatatatagatatctgagaaatatctctcatcatacgtactggttgttaggaacttcagttcttaacaaatgtccttaatgattttagtgatgtatatttcacagtttacaattcaaattgaccaaaattatatataaaaatattgttaattgctagtttgagcggtatgctagctattgattgtcttttaataaagaacatgtgaatcatgaaagaactctgtttttttgagtgtgctcacctttgtagaacatgatttattcgtacgttgggaggaagcaaatgaaagtacgcagttaagctgttgcatcacagttacatctttttttttaaaaaaaaaacaaacaacacagttacatcttacttttcccaaaaattacattgcaaacatgaggaggattttcattgggattctagtattcatagaaattgatagaaaattttcgatatgattgcattcatatggctcaatttcatatgaacataactgctttgtttcatatttttcattcttgtaagattagagaaacatacaacaaattctatatttttcatttctttttttaggggatatctgttttgtatttatgtgtttcccaatcctacattacaaagaggacctaactatttgaggggtgtaccatatttgctaccgatagatgatgtacgatttgctatgcctttagacctcaaatgtgttaatttttcattaatttaatcagcccgctagaaaagaaaacataacacttcgaattcttacggccttttaagcattcttgttaaatcttttgttagtatcgagtttagactgctgagactgatagtaaaaaaatataaaattcatatgctagaattattttccgctgtattgaataagtctctcgtattataagccggttctatgcatactaagagtaaacatatgaaagttatatataatactatttttttctccagatacgtgttcggatacaatccaaagctcgatatataactccagctttagcaagtaatcgtcctatctctttccaggggtgggaaccagaatcatcagctcagctcctaccaacctctagatagatgccaatggcaaccaaaagcaaccacctcttcctcctccttttgttctgatgccattggcaaaaaagaaaggacggcattgtatgtgtgacgggtaacgacgacggcacatagtacccacactactttcgaaaaccgatggaccaaacaaagctgcctattcacctgcaaataaaaggagtacacattcatgtaatcatgtataggagtgatgtgaaattccatctgcagacagcctaaagatttttgcaaacagcacacagtaccagtaccttgtaccgatcttaaaagtgatagttgatctccccagtgtcactttctcacctctatgtacgtatgatcgtatatatgggtatgaccaccataaatacatacgtgaaacagaagcaaagctagggtgtggatcggatatgatgctcatttgtccgatcacgaaaagcaggttgtctgggcctatggggtatttgtaattaattaaactttttaaaaccattaccattagtatctttttaatatttatactactagtaaccatagtccaaaattctggaatgaaatttccaaagtttcaacccactccactttttttatgttagcacaatttattaaaatttgatcaaaatatgataaaatgttaaattatttcggtccaaaatattccaaaatttcggttcgattggtccccgtcctcccaaaatagaagggcaaaaccaaaaaattcaaccttttatagtatagattgactttatactttactagcaaaaatacccgtgcgttgtaacgggtaaaaaagttctaataataatatgtgtttgtattttgatgagtggcttgtttttttataaacggtgctttttttcttgcgcgattttctcaaactatttttcagaaatggcgcatttctttctaatagttttttcctagcatgttttttttttgctttttttactgacgatgaaaaccatatttttctcccttttttgcttttattttctcgtgtgttttttgcatgttttttctaacaataattttctcgcgcattttttccttttttttcaaatgttctttttttgcttttttccaatacaggagaatatgtgatgaaataaaagccgtgtagtagatggcaaaaaatcgatggattctatccgactcaagcgtccatcaatttagtgttttttctgacagttttgtcagagcgatttgttttttaatagatggtgtttttttccttgcgtggttttttcaaaccattttttttagaaatagcgcatttttttacagttttttcctcgcatgtttttttaaaatttttttaccagcgatggaaataatttttctcgcgctttttttttgttttatggaagatgtaaaacctttttagcgtgttttttgcgcttttttctaacttttttctcacgcgttttatttgaacaatttttattttctcgtgcattttctatttttaaattgttagattagattagagatagagaagagatatatactgattagaaatcggactttatttcgcccttttcatttttttgcaagattataggaactcaaatgtaaatataaaaattacagggactcgaatgcaaaagtacaaatccaaaaattaaaatcatataaaaatggaatgctctcgacctgtaggttctatttttgcaaacagatctttaattcggcacatcaatttttttcaccaagatgtatgagatatcatggtatagaaaggagggtgcctgtgatctcagactcaaaccgagaggagtggtgacttttatttttcctttttataagggggaatcggatagagccggatttttttttttggtttctgataggaataggagtcggaccagaggaataggagtcggaccttttttttttattattttttcgctattttttttgtttttgacggacgaaggaagcatatcttattttttaagtagtagagaccttttttttatttttctgctattttttttgtttttgacggacgaaggaagcatcttattttttattttttaagtagtagagatttacttatcgtttaggatattgccatagtcttagtacattaatatatatattttactaagaagtgtcgtgactgtgattttcaaaaattttagtcggttttcttatccctgtggtaacagtccactggtttccatcactcctccctttttcttacatagaaagtttagcaataaattattctaacctgcaaaatttttcaaaaaacacataactaaaaaaaagaaattacaattcatattacacaagtacatgcacacaatattcaaacttagctaaaagtaaagcaaaaccatatagaacaggaaaaataaagctaaaaagaagtaaaattgcacattgcatacttctgcaattttaggcgtaggaaagtgtaatttttaggtggctaaaattgcacctctgaaacatagcaatacccattttattattactagccacatatccatgataaatctactaatataatttttacaaatgaaatcttaacttttcttttctaaatgtattagtgatctaagttgtgaaaggatgatgtatctataaatcatttttataataatttgagaaaacgtccgaaatacccactgaactattgtggcaatatgaattaccctccttaattcaaaaaccagatatttttcactcttaactttttataccagacaaattactcatttgatagactccagagcggttttaatcctaagtgatgcacatgtggcaattcatacaacataagaaaatatataaaaaaaagttaagggcccaaatgtggtgaccgagagaagaggcagaattgataagtgggccacactacttattttcttatgttgacttatgccacgtaaaaccaaaaccgcttcggaattagctaaggggacaatttgtccggtatgaaaaattgagggtgaagaatgtctaattttgaattgatgaggtaattcgtactgtcacattagtttgggttggtaatttgaactttttttcataattttatagggttataaatatagtcatatttttaaaaaagttcagtagcttaaagtatattttcatgacaaaaggagatatatagtttggtaaccaaagtagacatttcagagtctcagattttcaatcttctttcccccacctttataagcctccattcatccatccggcgccgtccacctacctcctctctccgacggtccgaccccccatggcgaccctcctctcgccgtcgccggcgtcgggaagcagcagcagcagtgatggcggcggcgcccgccgcctttcagagctgctggaggagcagcaggagcccttttccctccacctctttctcctcgacaagggctgctcccccgccctcctcgacgccgcctgctggccggccgccgcgcgggcgatgaggcggcggcgacggcgaccggcgagcgcgcttctcagcgtcatcctctccaagtttctaccgcgtggcgccgcggcggccaagaaggttggcgggaagcggcagcagcagcagcagccggctgcggcggcggccatcggcgaggacgacatggaagacgaggaggaggaggaggaggagaagcagctgagccccgtctccgtgctggagcagagcccgttccagccgccagcgtcgcctgcctactcgaaaagtaagcaaacgtgtacactcacctcgcgtctccttcgtctccggcgcggcggcgccattgctgccgccacgtggatagctcagagctcactcgctccacgtacttcgtccatcgcagaggccatagtcatcttcagggagctcctggcggcggcctacacgccggcattacccgaccaccccgtcaacaaccacacagcaagctcgccgtcgacgagctcctcctcctcctcctcctcctccgccgccgcctcacgctactgggaggaggaggagaagctcgaggcggagatcgccaaggtgcacggcctcatcgccgccgagatggcggccgggtggagcgtgtgccccgtcggcgacgcgcggcggcgcgtcggcgccgagctcgccgccgccgtgctggagtccctgacggaggaggccgcggcggcgctgatgctgacgtggagcaacggacggccgcgatgcgatgatgacgacgacgacgacgccatcgacgacgatgcgaggtgtgtggttgttgctgaacagagttgctggtgatgatgttgatatgtgtttacattaattttaacttaaattaatcttaattcttttggtggtgatgatgattatgtagttgatgtgtattaattatagtataaaatatgtttagtagtagttgctgctattaggactgggtagctacctctgtttcttggcatgagttctcttatgccaaaattatcaagttaggagagttgtatatatggtactatatttaacacaagtgaaaaattgctgcaatgttccattatgaaaaaaaaaacaaactatgtaacatataattggattgatgtggatgtattttacatgatttggtatcagccaaatatatttgagtataacatatgtttccgaaaccaaaggcatttgattctgtagctttcccactaaacacacagaaaagaaaaatattaggtgagaacatgcattatttcctctctagaaaaatatgcattattttgcctaattaacctgctaaataattttgaagagtgggccatctctcagtttcattcatttctttgaaagacaagtttcaactatttaaaccagcatgcatggtggtttgatctggaagttcatatggcgacatcaacacaagcatagttgatccgtgctatcctctctcctgctatgtactccagtttataagatccatgaagccatttctttcgattacgtggatgatccattggtacatgcaccatctatacagtatacacacactacacttacacattcacaagcacaatatctaacacatatttaacgtcttttttttcatttatatttatccttatcagccaaaatttaaattttttaccttaaatttagagttgattttgagaattttcatcgtagtttattttctatcatttacttttaaatcatttacttttaaatcataagaacacgtatataaaagttttattcataaattatcgtttacaagtatgcttttttttttatttctcactaagcctagcgatgaggctgtaaatagaggagatagaggttttaagacttgagatcattaacaattccctataagtcaggggcacatcactacatcagtagcgcttgtcccccggtcaaccatttctattttagaaacagtcccactaactacagagctatagagcaagtttaatattataatcaactacttttttttcaaaagtcaaatcatttatagtaatctaataatctatttttacagtagttacttataaatatatgttacatcattaataactagtcccacctcttatacacataacgtgctaagatccatagttcatttctcttctctctttgttttatcccctccacatatatttatagctagcttatagtttgctattgtacttagtcttatatttagtgacattttaaaaacattttagagaccagacaaatcatattatgggcctgtttagttcgcgaaaagaaattttttggctatcacattggatgtttgaccggatgtctgaagggtttttcggacacgaatgaaaaaactaatttcataactcgcctggaaaccgcaggatgaatcttttgagcctaattaatcaatcattagcacatatgggttactgtagcacttatggctaatcatggactaattaggctcaaaagattcgtctcgcgatttcccccttaactgtgcaattagttttttaatttatatttaatgctctattcatgtgtccaagtatttgatgtgatgtttttgagaaaaaaatttggaaactaaaccaggcctgcatcatagaggaaatgtgtcttattagtaacacctacaataataccaaaatttcatcgcgtattcgacgactaccaaggacgccgggccatcgatcggccattaatatatttgtattcttttgagaggattcatgtgcaaaaattttttcttctggccaaccaactttttggtggtacaagtacgtaatcctacgacgcacacgtgtggcagggcagcaaaatgtgtacggatgggatgaattgtatagcgctgtgacactttgggttcaagcaaagggaacatatttcttccattccgttccgttccgtccttggctcgtggccaatcaaccctcacggacgcacagcgccgttgtccggttactattggggtacgttgggctcgacaaggacgtccgagctacttctacctttactccctcagttttaaattaattgtcattttagttttattataagttaaaacatttttatctttaatcatcgatataaaagttcgtatagtttaacaacgtgtagattatatatgttatgaaagtatttctcatgatgaaactaaaaacataaaaattaggcaaactttgctacaggacatcaagactttgtgattttaccagtcggacaccgcacgaattcacttttggggaaaaacactatctaaacgtggttatttgctagtagacattacgcccattaaattattaattttcaggtgaatatgagagataaatagcgtgaaaagtcaaaaatgccctaacccacttgtcattttcttcttccttcttatttccccttttctcccagttccacgatgccgctgccgacggtgtctagaccactagcttccggaacgacaaccgtgttgggcgagcaatgctggagtcggacaggatgtgaggcaccttgaggcaacacggcccgccgcggggagccctcaccgctatgtgacgaggctgctgctgctgctgctattgtgactatggggcggtggcggcggcagcgccgggtggtgcttggagagcagcggcgtcggtgacgggagcgaggaaaacagaggaggctaggtggttgtggtgaggagcactggcgcagtgtggtgggacacggagttagtcggcgtgggccgaggcgagctgctaccgcgacgccaccgtgtccttcatgtgtcaccgccgctcctcgcaccaccacaccatgtcctcctacttgtaacgccccgattttcgttcgggaataaaaatcaattaataatacattttctggaaattaaataaaagttaaatcaacttaatcaagtgaattattgagggaattaaaaatttcctttaaaaattattggccgggaatattttgtaatattctttgtgccctaatgtactctccggaattttccgtgaattttcggagctcgagaaatagttttaatagcacaaagatcattgcatcaattaaaataaaaagaaaacaaataaaatcctccttcctctctttgggcccctttcggcccaatccctcctttctctcctgcgacccgcgcgccccctttctctccctctcgggccggcctcctccctcggcccgtcggctctctctctccctcaagtccgttctgcctccccagccggcctctccctccctctctctccgacaggtgggacccgtggaccccacctgtcatccctttcctccagctccaactgccgccatggccgcctgagccaccccacgacgctgcttcctccgcgcgcctccacgctcccgcgcgcgtgcagacgtggtccaccccacgtcctccccttcctccactttctcccccatttccccccccaaaaaatcggcgccgttcgagccccactcgcccacgtcgtcgaagctccatccgccggccgttgccgcccgccacggccacgatctccccctccggggcctataaaaatgcaccccgacctcccctcatccgtttcccccaactcattgccccctcccgcgcgctctctcgagctccccacgccgctcccgcgcgccgccacactccggcgaactccggccgccgtttcccgtcgctagggtcgccgccgcactgctccgccgccaccgccagctttgccgccgcccgggcaagctcggccaccgctccatttcccctctccacctccgtagcgccgtagccacgcgaaccacctctctccgccaccgccgccgactccagccgcgtcgcgccgccgcttcggtcgacgccgacccgcgccgttgcctccctcagctccgcaaggacgaggaggacctcggccgccgcccctcttcgccggaaatccgtcggagctcctccttcctcggtcgccggtgagatccttctcatattgtcgcggtcggccgtcgttaccggtcaccacgcaccagtcctctcctctctaacccctcctttatcttcctcagatcgaggccgagcccatccgccccatcctgagcgacgcccgtcgccggagctctgtcacatcgtcttcctgaggagccccgccgccaccgttccttgccgtcggccgccccttcgccgtcgtgcatctcggtgagcactcccctccctctcccttttcctccccttcgtcggccgcctcccgggcgtcctcgcgacgcgctgccgccgccgcgctccgcgctccgtgcccgcgccgttgccggtggtgccgggcagccggttgccgcctcccccttgccgcgccgcgccgctgctcgcgcgtgcgccgctttcgcccgcgggagctgtcgccggccgtcgccgcgggtggccgcgccgccgcgcgccgtcgtttggccagccggctttgtgccgtgctgtgccccagccgcgccgcccctggccgcccgatcggcttgggccgatccggaccgtcggttcccgtggaccggtggtggaccgcctcggtggtcccggtccacggtggaccggcgcccttgtgccgctgaccggtggggcccgcttgccggcgccgcccatctcctttgctgacgtcagcacagccttttcctttgagaaaataaataataattgcgcaataattcgtgaataattatagaaattcatttaaatggctcaaaacttctaaaattcatatctaattcattcgaactccgaattgagccgttcaacttgcaaaattcatctaaaattgagctctacatgtttgtttactttttatgtactgttttcttggtctttattagagtttttcctcgttttgcgtgccagcgtgtagttcccgtcgtttcggaagatcgcattcgcaaggataagagttcagaagatccaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgttctttgtcaaccttgggtaatgaatcgactagctcatgttacttatgtgacctagctagaactatatgcttagctatgcttaattaccactagctcagttgatgggataattacagtattagacctttttagtatcagagtgagctgcgtgctcgagacatctggccatgcttcgtggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagctgacgcatccaggcaagggtgggcgtgatggagcggggcgggccctgcgacggcctctgtcgcttccggattcacctaggcacgagaggggactgcccgttgcccgctggggacgggggtgaaacctgagatgtggtgtgcttggttagagggggttatgcgaagggtcctgtcacggcctcttttcggtatgtcgtggtgacatgtcggcgcacggtaacgtgtcgtggggctgtgtcttgtgggtacagttgtacacctctgatcagagtaaagctattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaaccgtctttatgcaaatagccacaaaccatccttgtatccccttgcacatctgcatcgttggtgtggcttgctgagtacggtggttgtactcagtcttgctattattccccctttttagaagtgtagtgcttctgagctgaagatggagttagaggaccaatgctcagaccccagttgagttttgcctgtggagtggagctgaagctccgctaggatcgcctttttccgctgctgtcgttctgtttcggtgtgaggactaggtgcctcttttgtaagtattttacgctttatttacgtttggaactgtatattacttgtcgttttgtgtaccctggctggtcctagacagggatttaatacacaaaatagtctcgaaatttgggctaaatttctgggcgtgacactactccaccttggacgccgtgcaccccatcgccccctactaggcctgaaaacggtacgaaatctttccggattccagacctattttcgaaaacggaatctgtcggtcggaatttttcggaaacggaaacgaattcggaaatattttcttgggaacggaatcggaaatgataagggcagtttccgtcggaactcgaaatcggtcggaaactttccgaaaattttctcggaatttctggaaattttcttggaattagtagaaatttcgtgactgaaatactctggattctttttttaagcactaaatagtgaatgtttggctgttaattttttaaaaaatatttgttatgcaaatctaaaattacataagaatatttttttgtcctacattgggatttatcaacaacattactcttttaaacatagataatttattcaattggatttatcagtttgagaggttttttattccgataaattttcgttaccgtattcgcgccggttcgttttcgctccgttttcggtttcgataatattcgattccgttttcgtatccggggtttccgattccgaaaaaaaatatgaaaacgaaaacgataaagatggtttccgtccgtttccgtaccgttttcacccctaccccctacgaaccagtgtcgctgccgcaccgcacaaattggaagacaggaaggaaggaaggaagaaacggaaaatgaagagaatagatggaaaacgtgacggtagtgacacggttctaattttgtgaaatttcagtggcaaggctacaaatagacaaattgtagtgttatttttctgaatagataaatttgcaatggtatggatccaattaaccctttaaaggacaaaggagtatgcacttttatacttttattatgagcttaacatcacaaagaatttgtgtaccctactatagtaataatacaaccaaatgccatcatgcattttcgtcagtaattttttttctttagacttttggaaaaaggaggcacacatgtgcgtcggatgcaaaaagatcggtgtttgttgagagaccccagtgtaacccgagctagagtggaatggcggccactcttctccccaccttatcgccgccggcctcccgcgccgccgccgccctcctcctccggcgagccccaccgttcccctcaccccttcccgctcccctcctccgactcctcctcgcccccgccccctcccctccgctacggtcctctcctaccttccgctccctcgccacaatgccctccgccgccgccgccgcagacctcctcatgctcggcatcgagaccagctgcgacgacaccgccgccgccgtggtacgcgcggctcactcccctatttcagaccgcttgtagcagtggtggagtcggtgtgtaggatttgtttgtgcttagtgcctggctctttgttgtttttgttggttggttggttgcaggttagaggcgatggcgagatcctaagccaggtggtatcttcccaagtgagatactatactatgccccctgcttccctgttcagcccacttacactttgtttctgtattattggtcatgctatgctctgtgcgctgctgattgtattgttttgtgcttacaacatttggaaggaagatttactcgtgaggtggggaggcgtcgctccgaagatggccgaggaagctcattctcttgcgattgatcaggtttggctttcagtttcagagtttctgttcaatcttgctgtttttgacatttatgttatagattttgtattttccttgcaggttgttcagaaagcacttgatgatgcaaatgtgtcagaaaatgatctttcagcagtggctgtcaccgtaggaccaggacttagtttatgcctcagaggtatcagcttttgtatgtttactcctgatcaataggattagctggtatttactgttattatatcttatatgctggcatagttctgaattttcagtttgttacagaatcttgtttgcatctttcaatcattctccccaccccaaaccctgtgttctcactattagttcgctgagtattttagatgcagggcatttctcatcattaacttgtttgccctttagatggtgttacttgttagtagttctttatcttgtgcagtcactcgcaatgtcaacctgtaaagtaatcgattgttgaaatgatacattgcatatactactatttacacagtcagagtgaactttattgattttactttttaacctcgctgagtctctcttacatttctttgaaggctatttaatgaaccatataaattgcagttggtgttcacaaagctcgaaaaatagcgaaatcatttcgcctgcctattgttggagttcatcatatggaggcacatgcattagtttccaggtatccaaccttggtttttatttctgagttatgaagatgacattctcaactgatgaaacataagttcctttatcagttcactgccaagcaatagtagatttttttagctgaaacgatgatttttttactgtccatttgtaagggattttatgtttttctctttatttttgtggatttagttctagagcacgactggtttctgttatgtacttttgcacttccactttttttctattgtatatttgtaatgtccattaggttggtaaattagcaatttttgaaccgaaaagtgaatgatttctttttctactggtattacttccgaacatttgaccaacatcttgctatgtaaaaaccacataacgatatttgagcaggaacaaatttgcaactataaattatttttcagtgctacatgttttgcaaaatgaatgtattgtgatgaaatgcaaggtatgaaatttaaattattattacagaagagctttttttaccagaaatgctaagaccctaagccctaagactattgtaatcatgcctatacttaaagtaattatataatcctaaaaatgctatcatagccacctaacctattgttattgctataatcgatgcatttgtattaatgtagttctattgatgtcaggttagtgaacaaggatcttgatttcccatttttggccctcctaatttcaggtatatactaatcaaagtgttttatgactttatccctatattctgtggcactatcaattttttgttgagttacatctctacagtaacaataaggctcttttgaaaaatatttgatgtttggtagactttgaatgtataacatagattccattggaacttgcataaatttatttatatttccagtttgaatacatcatcaatcacatggttttggaagtagtgccaccatgttgtgcagttcttttgaaatgtagtgctaattttgctaatattttcactaaaatacataaaaacttcaaatgtcaagcaattgaccccatgattgtgtgcatgtcctctacacgcttcaaaattatggagttgcccaaagtccgctaagcatgaccattcgctttaccactagacgtagctgtactcataaaattgatggacaacagtgcctagtctaggattgaaccctattaggcttgtccttacacctagtcagtcagcttttgacctgatggggtatttgttccgtccctgccacagtttggaagtactatctaaacacccgtgctttatatggataaacactaatcatacattccctagtattgtgaaataaatgaatgtgattttcttcataaaggcacccttcgcatgttcacacagttataattgtaacattagcttgtgtacatgtacatgtgaatcttggacccttccatgttaaatttgtattttagaaggccaaataataagataacaatatgtagaataactttcatatgatattgaagaactactaggggaaattcataaaacctataacataaaggaggtggagtagatattcacaagctccaccaccatacccttcttttcgaaggactatgtagttttttatgttctatgtacaaatatacgaggtgtgtaatgaacaatcttcatggttaatttatgtctctatagtcaaactacaatatagggaaataaacatttttaagcagtgctagttggcaggcaactccatttgctacatctcgatactttattatatccagttttgaaaaactacttttatttcatttatttcctcctttcagaatgcaaaatcaatcttatgatggcccattgcaatcattgatacaatatgcgagtatggaataagctcaatcaaatagaaaatgggataacaaatactccctccgtcctaactcccaaaatataacaacttttagccctcagaatttgtcccaaaatataacaacttctccaccaacattctcttcccaaccaatcacaaccctccgccattcacttttctcacctacctccactactcatccaatcacaacccttcaacattcacttctacctactttcttaataaccatgtccaaccttaaaactttttatattttgggatggagggagtaatacccaaacataacagaaaaatttgctacagggcatccaaaaaacgtgcaattagctggtagacaccgcaagaacacgaatattctatcgggcaccataaaaaacttgtaattagctgttggacactcgcggtcttattttattatttttggaggaattggagagagaaatactcattaaagacaagtttgcccttggtcgaacttattttaactcgactgggtccggtgcaaaccaaccacaaggccactcgcagtaaatcgattccatcgcaaaccctagattttgattctttttgggacagagggagtatgtgctaatacaacagatatacttatgttgaaacattacgtgtttggtgaattttcttttatgacgttcgggcagctacctaaccagttaatatgttcaggaggacacaatcttcttgttcttgctcatggacttggtcaatatgttcaactgggaactacaatagatgatgcaattggtgaggcttatgacaagtcagcgagatggttaggtcttgatatgcggaaaggtggcggtcctgctcttgaacagcttgccctagaaggtgatccaaatgctgttaagtttagtgtaagtttgccgacgtagatattttgcatccactgggtagatatgttgtgttatccacctatcatgactgttaggtcaacatgatgtttgcttgccttctctttttgtgaacttccaggttccaatgcgacaacacaaagattgcaatttctcttatgctggtctgaagactcaagttcgattggctattgaatccagaaacatgtatggctgttttagtccttgtgccattgtcttcattgtaagattaatatgcctgctggtgtgtcaaataaatagtgtattttggcatgctgtttgctctccttgactataatattctagattaacaagcagagacttgactttaactctcaataatctacaatacttgttttttaattttactgaaattttttttatgtcaagcactaggaaattaacatgaaactattgcaaccatgcaaggtcgttgttctttttattaattaaagaacacccacccaggcattatgctatagcgtatatacaataacctgtgcttgaaatgcgctagatcaaataacaagaacgacaaagtgggaacgataatgtttaacaaatagcaagaggttgcaagttgctagaaaactggttgttagaaaaggtatagaatgtttctgtttctttattggcgaaggaacatttttaattattacatgaaacagacatggcagtctcatcggtagtgacatttggtctcgtaactcttctgttgtttttgtgctatggtagatcaacagatgatattcctatttcatccgcgacaaaagatgacagacaaataagggcgaacattgctgcctcttttcaggtttttacatcataggcaatgtattttcattattcatgaagattttggtagttttctgatgttgacctctgcagcgagttgctgttttacatttggaagaaagatgccagcgagcagttgaatgggcattgaagatggagccttctattaaatactttgtaattcagatatcttgatgttgattcattttagaatatttacatttttacattagttcatccagtgtgttattgactcagttattaaaggttgtttcaggaggtgttgcatcaaaccagtatgtcagaactcatttgaatcagatcgctgagaagaatggcctacagctcgtatgccctcccccaaagctttgcactgacaatggtaaaaagtttatttgcatgatcaattgaatagtaaatcagtaatattcaatcatattattaacagaagtatttatgatttaatgccatttttcatgccactcatttcatatcttcattttttatctcaatctagactctacattatttatttatttttgtgtcttggttctatgttgttgttatactgtttattttctgtccttttgacttgttgagaacttatttttgactgtttcttccatacagggtacagattcctcctaattcccttagttattcttaagcagtttgcacataattctggcatcttcttttgcaggtgtcatgattgcttggactggtattgagcatttcattgcaggcagatttgatgatcctcctgctgttgatgagcctgatgatatgcaggtaacatgacaaattaatatgctcagttgatgagttgaacaaaacaaagtgcaccatcaagcacagaaagctttttttgcttcttataacttggtagtttaaaaatgcattgatacatgatcaactctttgctgctacaataaaaaaaggtcttgttaaaaggcagttggtgttgctactgataaggaggaagagtgtaaagctaaaccgatggcatttcaacgaacattgaaatgtgagacttggatagattatatcgtgttcttgaccttaatttgggtaaatttggcatatatgtccttttaatcccaagtaactgcatttggcactatagttgaagttcgataatttcgtttacatcaagtcatccagagtcttttttttcacccacgactcccaaacctcaatactcaaatctcaaaactagcaaattacctgccaaatttggttttggtggtattttcatcttgcggcctaccatattataagcttagagccatatggtcatcgaacaggtgagcttgtgttatgtcaaaattgcatccaagccagtcaaacaatccacattttcaccatcttccccattcctatagctgcctttatattcctcatgtctccttcagtttgacactctggggggattgatcaaataagcttggcctgtgagcaaagctagtcaatatttatgatatcagtagccatgtgatggtggcagatccaccacgaagatcagtttatgagttattttttatccaaatgttttcctataattaatatcatggaagatggaattcgcacattgtcagaactcagaatcaggccgtctaattttcttacattaaaatagaacacacttcagatcgacctgttgtgtatttatgttatggaaggaatcttgtacttggtaattttactctactcctgacgttaatacagtgtaagttctatgttttataagactgactggctattatcatgcctgataattgtcttaacacagtatgacctgcgtccaaggtggcctcttggtgaggaatattcagaaggaagaagtgcttctcggtcaatgaaaactgctcgagtccatccatcactcacatcgatgatacagggttctgttcattagtagtttagtggaaattgcaggagcatttgcccattgaagctagtgctttcatgtgccatgtggtttatcagtttcagttttagtgattactgaggcgcggcttgtttcgagtgaataactcgcaattttcagtcgcagtttagttgaaaaccatggggcctgtgagcagtacaatttgtgtgaaacttcgatgatggttttggggctttgggcttgtgcaactgatgttagtgcttaatgcctgaaattcaaaatgctttgtatacttcaaacagaggctgtgtttagttctacaccaaaattaaaagtttgaagaaattgaaacgatgtgatggaaaaattgaaagtttgtgtgtgtaggaaagttcgatgtgatggaaaagttgaaagtttgaagaaaaaaaattgaaatataaatagggccagaatccctaattttgttttctttcgagtcatccttatccagtccttgatcattggataggcatggaaaccagtgattaggaaagtacgaccgtgcttgcttcccatagccatttcagttttcagaagcttgaggcactattgaagatacctttcttttgtgtctaggatcggtgcccaatagaatacaaggacgaaattagaccaaagtgataatgtgtgcggtgttgcatctcctttgggcagagttgcatgtccttgcatcaaagagcgcgagcacacgcatacctataccggtagcgcaaaaactaatcggcgaggcatctcgatattgctttattgcgcgacgtcaaccatgggagtggttccaatagcaaccggtactaagggtgaggtaactagttatgacaatccagctatggtcatcgtagtcacgtccataggtaaagattttctctcctctccttgttttctgatctctctatattaataaagggtgtggtagtgttttagtctgttgcttgatgtgtgtttgattttctaaaataaccgtcttttttttttttttggacacggagagagatcgatcgcctgggctttttcggccgaaagcccaccacaattaggcccaaagtctgcttgctagcctcagaccgtgcttggatggcccgctcgagcctcctagctagctacagacgtcctgctccctttggaacttgggcgagaaatttcagtatttgccatcaatggtagattgccacttcattagcaagcctttcatatttattgcgaatttcttcgttccgtgccactccgtccgcccgtccacaccgtccgtccgcgcgaagccgacttcgatctcggtagcacccttgtcgtacctcagtttgtccccaagctcgtgtctcgcctccgccacgccatcttcgagtttcgtggccactgccactgccgcttcgggataccactaccgtcaccttccgtccgtgccaactaatcatgtactaagtaccttcgattttcatgcgtgttggagaagtttccaacccttacatttgaattaggggtgaaaacggttagatatgatatcttttttattatttttcagaaagggtattggtgcggtcagaaattttctatatttatgaattagtgacaacttcaacataacacagacagaaattagaaattagaaaaactaaattttacagtaataacaattggaaacaatatatttttttagaaatggtatccgtacggttgaaatccctaatttgaatccaccagaattgttgcaagaagttaaaaaaaaaacaaagaaattgtggcaacccagctgtaaggctgcaaccagccaaatgcattgaacggaatttcgcaagtgtttcctcccttactgatgggtattattagttagtgtgaattttactttgggccttttttattgtcggtgttttgatttggatcaccctttactttcactttggaccggataattttacctttgtagcatcaacttttttactcatctccaccgaatttattatttaacaatgttaaatgaatgaatggtctacttataagttacaacttcatatacttgagaagagtcgagtggtctaaagtgaaataaaagcaagactatccgattcaaagtgaaatattagttaaaaagtgttccaaagcaaaaatttgacaataaaagatgtcctaaagtaaaattaagtaaaatttactctattagttattacagtgttatatttaggaataattttttttaccccaacttcccagtgagatggatgaatgaggccttccgaggaaagccttttaaacaaaatgatttaatcatatccttttctttaaaattccattgaatttttaatggacggattttagatataagttagtaatagctctaaactcttggaaaatttcctttcagcctatctctctcgtacaattcgtatgttttccgacagtctatttaattgaaattgccattcctacatttttttgtgttttgaaattctttgttttgtatttacatttcttaaaatcatgtgattttaattcatattcctttatcttttcaatcatgtgttttgaagtaaccctaaattgttttcataattaggagtacaaataaactatgttacagttataaaacagtggactagcgcatacacccttgagttttttatgtaataaaagaataacatttttgggctacttttgaacgagggaaaaatgcaggaatgggatgtcatgacatatgcataactaaaaaacaggaattagtccaatcaaccatttccatagaaaacgcacatgaattttagaggaaaaaatattattagaatgagatgttttacaatagtatctgctggtagtagaaatcagtctagactattcatcttttctaatctaataatgcaccgtatctatttatactactctctccatctacttttgatagtcatatttcatcttaacatacagaccaaggataagtaattctacttatcatccatttaaacatgccactagtcattcctcgtaaataagcgattaattaatattttacatttctcaatgcccatgcagccaattatgtatggaagaatggagactcacgcattaaattcgagaaaatcattaataggttcaaaaataaaattttcagattttgaaatatgactatcaaaagtagatggagggagtactatcttaactatttgtagtaaaataattatttatactggtagtagaactgatcaatcaatgattaaggttagttctactagtgataataccgattgcagaatattaccatcagaaaccattgtaaagacgctctattaggatatagttgagaggagagacgatttatttctactggtagtagaactcatcaaattaacaatgattaagattagttgtagcagtgataataccaatagcataaccaccgccgtaaaggtactctattagactatagttgagagagagaaaaatgccatcgtttcgcttatacttattatatgtgaaatatcttattaacaattaaaaaataatttatgagtgaaactttatatatatgtgttcatagttatttaaaagcaaataatgaaaaataaaccatgataaaaaattccccaagaagcaactctaaa

SEQ ID NO: 3144 - DNA, 17017 bp, Oryza sativa
  unsure (1)..(17017): unsure at all n locations
nnnnnnnnnnnnnnnnnnnnnnnnnnnnnnnnnnnnnnnnnnnnnnnnnnnnnnnnnttgcttctctattaccctgtggactgcagaacatcatggccacagctgttcaaaggctcctcctcactgcctgcaagctagcagcagcagcagtagcagcttgcagcaactgccacagtgaagtccactagctcctgtcctctgggctatggcacattggcaaaaaccaatcattatccatttctcccaagcttgtgttgcatgccatggtaatatcacactatcaggaagtactccctccatcccattatatagtaaccgatgaccgaattttacatattctaggactacgaatctggacagatacatgtctagattcgtagtactaggatatgtcaaatccaatcttaagttgttatatattatgacggaggaagtagatgattagcaagaggaaggaaaaaaccattgctttgagaacagtgctagctaaagagagaaatgatgatagtagacagagtactcacttgtagttgtagctttctctgaattctggagagggtcaagtcttgcatggagtatctcaatgagcacacagctggaaaatgcttggaaagaacactagtactcacacactggtgcctgcagataactggaaagatgcttttagttcctattcccttgctcagaacttcaggaaaggtttgtttcattcaattcattcattcaacagaaattgcaggagttgtcaccagagtagcatgatttcagtgccagttctgaggagcgacgatgagcaaggcataagctttcgctcatacgctctcgtcaggttaactgttgatctgcagtgaactaaagctgagcagtagtagtgaagtctaaagggagaaaacaaatcaagaactatgagcaaagttaccatgttgctgtaaatccaataggttaggctgtgtttagttcgtgtgccaaattttttttttgaagtatacggacacacatttgaagtattaaacgtagactaataaaacaaattacaaattccgcctgtaaaacaaattacagattccgtctgtaaactgcgagacgaatctattaagcctaattaatttatcattagtaaatgtttactgtagcactacattatcaaatcatggtataattaggctcaaaagattcgtttcgcgatttacatgcaaactatgaaattgttttttttttcatctacatttaatgctctatgcatgtgtccaaacatttgatgtgacggaaaagttgaaagtttgaagaaaaaagtttaaatctaaacacggccttagtctgtttcaagattgcttgttctctggttgaaattgattatggccgttgatcgcctataatccaatgcactgggaaggtggaaggttaaaattgtaatttactttgatgatttatttgtgcagttaagggcaaatatgtataatcatcttttacctagatccgggatttcagaaaagtcactggtagattcggaatttcagatcttgtttcagacaacagaatgagaccaggttaagcagccatgacaaaaattatgacaattcagtcagcaacatagaacaaattccacaagaaactgagatagtacaataccacattaccgctcgcttaaaaacggagggaactcaaagcatgaagtgataaagattaaagaaaaataatacatgagctaggaaatcatacagggtgtgctctggggacaaaaacatcagtagatagcctcatggctgttccctgatgatcagaccggcggtttcacagtgtttggacagtctgggcattcaccaggcctgaagtgagcaagccattgcagaggctgcctgcaggactactaacagtgctgctgggcactgaactgaagctagtcatctgcaggactccggtgggcgattgcagctgtggacttgtagtatgtccatcagctaagaggttcaaagatggcgggtggcggcttttgcctttgtcgtctgatgcgctgctggtgttggtgaagaactcacccagaggtccacctatggacgcttcccaggagcccggtatccaacttgctcgcgtgttgtttccgccattcgatgaaccgcctactacatggtccatttgagccttgttgtagttagtgggtaagtcggagttatccacgggaatggatatcgacagctgaatgtcatcatgctgtatccctttgccaaagagtgactgcttacagcgttgttgctggggaattggatttaaattcgccgattgcggtgtgttcatgagagagccagcagggattactgcatagtctgcttgtgaggacatctcttcagaccaattatcaccttttgtgttgttctgtaggatgttgtgttgctgattagtgtagtcctgggagcgttcaataagatttgctttatccaacatcatcctacaaaaataaaaaaaatatctgtgttagaagacagattacattaataaatctagataatcaacaaaagttaaggcaactaccagcataaaaaataactaactcatattttgtaaaaaaaaaaaaggtaaccagtcaaattatgtcaaaacttgcagaatgttttttcttgtcagatgcattttgacactactatgatataatacgatgtagcaaaaacaaagcctacattgttccactcaaataattagataatttccagtaaacaaggtaaaaacagtgtcaagtaaaaacatacttatgagacatccactaaaaagattactggtatcactataatgtcgcacttcctaagatacattgtattccctcctgtgaatataacatgtcaccctggaatgtctgcaatcaaattacggtaatttaactaaaaatgttctctcagatatgtatttcttgtaaatgaaaatcgtttgagcaaatttgtgaagtaaaagtccctccctcccaccctaatgcattcactcactcactggatacaaaagactagagacatgatgaaaaactgtccttcaggttaagagttttgagtcaaataactgttgtgtagtactgtagtgcaatgaaatcaaattaggtaagagtctattgggcagcagtcacaatactgcagcagcaccagctagtattgggtatcaagacataagaaattatctcattaccaaataggacataatgattaaaccatgtaagatcagataacctcacctgttagtagccaaggttttcgtgagctcatttgacacaccatggctgcctgacaatttgccattagatgcaccaatgggtggttgtgctatggcgggaaccgttgcttttgcggcatggctagattggccttccacatgctttcttgaacggtggcgaccccggtttatgtgccgctcgcagtacttttggtcgacaactgcgtctctcgagcaccgccatttcttgccatcggttcgacggcatctcccgggctcggagtcagcactcccagaatagcccagctgaaatgacccccatcccactgtaaaatgaaagaaccatgatttaatatttggatgtgcagacctataaagatatactccctccgtttcgaaatgtttgacgctgttaacttttttaaacatgtttgaccattcgtcttattcaaaaaatttaagtaattattaattattttcttatcatttgattcattgttaaatatatttttatgtaggcatataattttacatatctcacaaaagtttttgaataagacgaacggtcaaacatgtgctaaaaagtcaacggtgtcaaacatttcgaaacggagggagtatatctctaacactaatccatcagtgtttagcaaagtatgctcaagtgtcacatgttctctactaaatatttaaatctctaataatgtgagtgtcgtttttaagatccaaactccaaagcctttgcaggatacaaaaaggatccctgaataaactaatagcaatccccaataagctaatcatagttaacaaacccacacctttccctcaaaagacaaaaccaaaatactaaccataacagaatcccaatgtatcattgctttatccaggattttaaaaataggtatcacattgggacaaaccaaaactaatggcacaatagcttacaggagctggagccaagaatgccaccagaggagaagtgtgggaacactggtggatggaggcttctcctgatggggaggagcaagccggccggtaccggcgcattcgccacaatgtgcttgtagatcagagcctggtgctccagctccatccattgtgttggtgtgaatggccccctaacccttgctaaaaccccctgcattcttgccacatctgagcttccacaatccaaccctgcaaaaaatggatcgatgacaacaaaaaaatgcaatgtcaagaccacaaagcaaatgaaaaatgagatgatatgagtgatgaaaagtgcaaaacagcattgcctgtaaggctgtgtagcatgcaagatttgaggaagaaacagcatctaggttcctgagttcagggacactactctagtgctcctagcttcactcatggttgctactgaactagctctctcctctttcctgacctctctcacttgaagatggaagtgtaaaaagagtgagagccatctccaaaggatttaaaagactctgcatctttggtgacaaggggcacatctctgcagtgccaaatgcagaaaagcaaaagttggggaagcaaacagctcctccttttgcacttgacaagaccttaaaaccagttatccttttttttcttgccacgatgccattgggagggtcaagcaaccaataaactaactgaatctgccatcaaggtgaccaccacaccaccaatgcaacacccccccccccccccccccaacagatgcaacagtcccctcaccacccaacagcatgaaaaaaaatccataacataaaaaaaaagaacatcattttgaacgataagaagaagaaaaaatatatgagcaatgctgaagaacatggattgatttctctaccattgccgctgtgacctgaggaggagaagcttagaatctgggcaccgggatagccacctgatccaagaaggaagctgccgttggtcctaggggtcgccattgccatccttcgtcaagaatcaagaaccggggtgacctgaccaccgcagcaacccagcagctgcagcagcagcatctggctgtactgtcttggagcaaaaatggctagcaggttcccgaatcctgggcttgaggaggaggtggagggcattaaatgggagggtggttgaggaagagtggcatctgtgagtagtttggatggatggatgcagctgagctcagagaggagaggggagaagggacatggtaggttggtgtttgcgggggagggggaggaaggaggcagcagccaagtcaatgcactccccaatcttggacatgggagccaaagttttaggtgagaagatggccatagcaatgcagctatgctcactctttttaaagtgcaaatggtgcaaaaacatcgataaaagggcaactgatattttttttggcctcaaaagtttttcagtttttttttgttagataatggaatttaacatcccaccctatgctaaaatgagttacagctaattattataaagtagtactccaaaaaagagtgtaattcaaataaaaagaacacaccaataaaaaacattggaaaccaggccaaaataagaagaacacatttattattgaagtctatttgtgaatctctatccataattggcaaatagttacataaccatcgactccaacttacggcatgcaacatttaggaactccccatcatcctcacatctttgtagctgtgcccataacaggagccagtgtgttgccctgaaaattacctgcatatataaaatagatggtgatttgtcaaaaaccaaatcatttctactcaaccatagaacccaacaaatgacagaagctctaacaagtatcagtttactccttttttttttgtcaacccccaaaagccacccataaaaaatatgagatatactagttggaaggttaaaactaaaagaaaactgaactgctctctatataaactttgcataatgacaatccatgaagagattttgaatagacttatttttcatacaaaagcaacaccttaagctaccattccaattccgtcttgccaaattatccttggataacataacccccttaagcaagtaccacataaaaatcttaatcttaagcggcatcttaagtttccaaatatacttgtttctctcatcataagcattgttaattaaagctagatacattgatcttactgagaacataccattctgatgataattccatctaaaacagtcagaaaaaagattcaaataaatatgtacaatggaaacacacaattcatgccagtatacaatattctgaccaactaaagctcttctaaaagaaacattaagcgggacacagtggcaataaaggatgatttccttcggactatagtatataaagatggatatttatccttgaaaaccaagttacctagctatttatctttctaaaagtttttcagttggtgtttagtttttatgttaagggtgtgtttagtttcttgggtgtaaatttttcgaagtatacggatacacatttgaagtattaaatgtagactaataacaaaataaattacagattccacttataaactgcgagatgaatttattaaacctaattaatccgtcattagcaaatatttactgtagcattgcttgtcaaatcatggcgcaattagacttaaaagattcgcctcgcaatttacatgcaaactgtgcaattggatttttttttccatttaatgccctgtctaaacatttggtgtggcgtatttggccaaaattaagttaaaatggtgttttctcaatattgatatctcaaaattcaaaacccgattatctagggctccccgtttggtccaccacattggcttcagactcagccgatcacttgcactgcaccctatccatatgacattggtttgccacgcagtttggtctcatcgtacgtgcagaaactcccatgtgctacattctttaccaatcaccatcaaacctcatctcccatcccaagctcatatggtgaagcactaatctagtttataactgagcataaagatacatatgttaaatgtttatgctagaattaaatgttggaggtcaagcggggtatatcgtgttaatggacggtagaggtattgtgaacaaagaactgagatgatttgaaatacagagtaagatattccaccttgatttttgttagcacactttttaaactgctaatcagtatgtttcgtgctaaacctttcttatattaaagttgccttaaaatattaaattgattctttttcaagtttataatactaaaaacttaattaatcagtactaatggttttgttgtactccgtgccctaactacattttcatcattgaaaactaacgggcctttgttagcgaaatgtgcgtgtaagtttggtccatcgtaaaacttaggtttacatcaatatggatacctcaatataaattaattaatacttttttgttcacgcaatcgtacatgtgagaaatagcaatacggtatgctgaattatattgggattcctctaatactttttgtcatttcaaatcatctcagttctttgttcacaaatcacaatacctctaccgtccattcacacgatataccccgcttgacctccaacatttaattctagcataaatatttaccatatgggttaaaaaaatgatttcaactacctatccagggatgaaaacggagcgaatacggacggataatgctcttaccgtatccgttttcatattgttaggcggatacggaaacgaatacgaataactcggatacggaaacgaatacgaattatcgcggatacgaataaggatcgaatatgatcggacacgaatacgaaaacgaatatttctcggaatacaaagaccactcaaactgctcgtagatacaaatgcaccacatatatttatctaatttaatataaatatcatcgttgtaggacgcatcacagattaaacaaagtgtatcgtgttcaaatcgaaacacgttgaaaagttcaacatatattgagttcgagttctataggtaacacagataagatcaaaatagtaattagcccaaaagcaattttcagtacacttgcagtccgatgcatgaaagctgcaacatcattattcatccatttcatccatcagaacatcatcctgttccatgtcatcattattctcctctttttcctacaggagtcgaataatattgttgttatattaagaaaaatattcatagaggtaaaataagaaaatagctcaccactatcaataagtttgccagatgcctctctacgctttcaatgtccaactcattgataatagcctgagtcttataacctaagaatgatgccagatcagatcatggatcagctatacatatattgatatatacaagaaggaatggccaaataagcaatgaacacagacacaaagtgtaccattgttagctgctttaatccaatctttggtgcaaactaaagcttgcacagcctctggatcaagacgggtgcgaaatggatcaacaacacggccaccagcactaaatgccgactcagaagcaacagttgacacttgaatacataagaaatcacgagcaagtttgcagaggataggaaattctgcttgtttgagcttccaccaagacaaaatatcaaatggatctttggaagtccatagtaacagtggttgttccatgtaaatttgtaactcggttttatcactacaaattggctgacttctctcaagcaaaaatctttgaagatgttgctcatgatcatggctactgtcattctcattaaagatatcatcaaactcatcagtattatgaacaggatcagattgaatttgaagttgatgcacatgcatttcagcacctttcttctttgatgttgcacacgcactagtagcataaacatcaaacaattttttgataaccccattgaactcatcaaatttttctgcagcttctaaaccataaatcttcatactatagtactctattgaacttgttttgtaacgtggatcaaggaagcatgcaacaacaagagccatattcgacttctcccagtacttatcatatttagtttgcatggcgtttgccatggtttttattgttccatctgtactgttacaccaatcagcaatagaaagcttgatggaacaaaacttcattaccaaagcaccagcagcaggagaagtgtcctgcgtagctgccgtagcatggcttggaggtgctgggagttgcaaaactggagatgatgcagtggtacttgcagctgcacttgcactacttgcactaccagactccatcaccaatctagacacaaagtaaaaaaaagcacatccaagatctacatcagtttatcgatctcatgaaaggcacaaaacaaagggtacaggagaagaacaaatcaatggattacctaagagattagtgcatgcaagaggccttgccgccggcggtggtgacggctcctagcctcccactgtcccacgatttagggagataggaagcacaaacaaacactagggggattgaaggccaatgcccagcaactccagcaaggagccaaggtgatctaagacagccgccgccaccgtcgccggcttgccgctgccgtcgtcgccgccgccgccgccgccgtcgcctgtctagcagctagggtttagatagccgagagaaaactatgggctgaaattgaagggatgggctggaggctggagagacatcaagcgttacgcggatatccgcgcatcttaatctccggatattcggctccatattcgtattcgccggaaactgtgttaccatattcgtatccgtatctggagaaaaatatccgtattcgtatccgtattcgaaatatctgaaaaaaaatccgctctgaacactatccgtatccgtttttgaccggagcggacggaaactatccgctccgttttcaccccttccattccatatatatactcaacaagaccacacatgcttaaatcattaatgtcgccctatccaacgctccatccaccatttagctgtttaagccaaattttcggcttatatgaatttataatttgatggctttcaagcattatgtttagttgtgaagtcctgtattcattgtgcttagaaaaaagattattccaacttagctcttaatagtgcagaaacttatgagtttttttttaaaaaaagctgaaaaaaatatgttcttaatcagagctaaaagttgttatattttaggacggatgtagtatatttgtttagacttagacttatcatctcattgattagtttatctataccttctataaagtttcaacccactacacctaaagctcaacacgtaattatggtatttattaatactcctaaagatcaacatgcaagcatgcaacatcaactcagtaagtactcaaagctcatatacaaatatattaattatgtttataattttatttcattctaaaactcaacatacatatgctaaatcatcattccctaatcattttcacaatattttacaaattcaagtaatttcatcatttctataatattttacatatatcccacgataaaaagcgagacaccatgaagtaaacctgacaactgcacctagattttggggcatttaacaatttgccacttttaaagaatcaccaacagtcctcatatttcatcccaaaaccaattctgagggatttagtagaaaaaaaacaatccaacagatctcctactctattgcatgatttttgaagttctcccgaaatattcgctctgttgatgtgggagaaagcggcgccctcgtccactcccaatctcgcctctaccaccttgctcccgcaccgtgcttgggagattggcgtggcttcagagggagcgcaagaggtagcgtgctaatggaaattctgttggtagtttaatagaatagcccatttttagcttttggggatacaatttaggttttctcctgaagagatcagttattttctttcctatcttcagtttagcaaaccaataataatttttttgggagattatacacagtttggtgatgctctcaagatgcggtaattaaggatttgtcactcacaatcaatgatatgatacatgatatgtggacgcttatgtgtctatgacatgtgagttcagtggtaaatttttaattatcacacaaattgcatcaacggtacaacaacttagcaggtgggtgcgatatattacaagaacttgagaattgaatgtccgagtgcaacaacttgataagtgggtgcgttctaatacaataacttgacaatttagtattttggtgtatcaacttggctaagcatatgctaggcgagttttttttcacgatgtcaatatgcaattacatagtaatcctacagatattaccttagacattgaatttaatcttgaagaattatactgcacacagagtttacatccaattaccttaagatttttttcttcaccttctcaaatatcaaccgaaatataatttacatccagtttaattgacttttagttattagttattagaataaaaatataaatatgcttatacaaatccacgctagtatattgtaaaaataattacttaaaaattgaatctatataaaaaatgctccaaataattaagttgtcgctataacttcttagtttattgtatgaaaatcgtacatatcttgcaagttgttacatttatatgattacttataaagattttatattaaattatatttgtctaccaaattgttgtactagaacgctcacctgctaaggtgatgcaccatgggtgcaatttacttcctagatttctcacaaaatcttgctttgcctcctatgatatctcaactaaccctcaacaaaaccgcgcctttaccgtcatcatctcacctatttcttctcccaaactccggcgactcctccgctaatcccctccggcgccgcctcctctccgctccccgcgccccccacctccggtcacgcccgatcggttagtacttactcggaaccctccctttcacctccgtgttcaattcagtccaaacctcccgatttctgcttctcccctcttcccgcaattcgggggttccaagggttcttggaacccaaagttcttggtgaaatttggggtccctagttcgattcctctttttttattattactagccacgagatggtgtatgtaattcgcgtctcgattctttgcaggattggttgagttgcctcgagggatttttgctctcgaggtatggtgttcatggcggagctggtgggtccgcgggtgtacagctgctgcaactgccggaaccacgtctgcctccacgacgacatcatctccaaggcttttcaggtcggccctcggcagccggggagcttttccttctccttgaattctttttttttttttttgttcctaggagctaattacctgcctgcctaatttagggctcctgcttgatcgaagaaatgatcagtagttgttcagatgagatacatgcttgttactactccgcactacgtatgttttagtgggatatggttggatatgcagtgatcaagtagtccatatcattgcggtaacggtaattggactaacaaaaaacctggatgtggcattggtttctgattgcctgtgcggtttatgagtcattatgtgattagctgtcgatggttgcaaactcttttttttttttctagtcatgcatactgtataagaataactgtagatgatataccctttgtgtaaattggcatgatttcagtaaagatttgaggtagtatttagcacgccttttgcttaccttactaccggggttgtgtgtatgttatgctaaagaaccagcacctcaattcggtgtgctgcattttattcctcagtttaattcatgcttacaatgaaacaacttgacactaaagcctaaaagttaacaaaaaaatgcagtcttatatttgttaaaatttatacctttgctttcctaaaagaacaactcaaaataactgaacacaagcacagtagctttctgaagaaatactgcatcattgggcctttagacaaatgcttgaaggctgatgccttctacttaccgttattttggttattttaggggaggaatggccgtgcctttctgttctctcatgccatgaatgttgttgtgggcgcgaaggaggacaggcaacttatgacggggcttcacactgttgctgatatctattgcaatgattgccgggaggtgttgggctggaagtacgagagagcctatgaggaaacacagaagtacaaggaagggaagttcatatttgagaagtcaaaaatcgtcaaagagaactggtagaatccaaaagattaggcactccaaactttctttagaggatgaaacattcactgttccaaggttatcagtgtgttctggttctttatgtctttgtaaatatcagtcatccacaagttttaatcttaagtctgcctgttcttgccttgccgtgaagtgtaaattgttcttgctcccgtttctttctgtgaataacatatggcctgtgggtatttgttcttgaaccatgtgtgctaatgtgcgtaattttataggtactaaaagaatgtttgtatctttctcctgcacaagaataccgcgtggagatttacagtcaaatataatctgacatgatttaatcaaaatttgttgggaagttgtgaagtaagacaatagatacctttatacttgcctatggttcaggtggaactcgaaattctcgactctacttgggttggtaaatcaattgtgatatctgaatacctgagctcagattatgtattcaatgtgatgtgttgtattttgatttgtttatcttaaaactgctgcatattcagattatgttattgtcatggcaacatggactgctatttaataagagaactcaacttgggttagtaaatcaatttgatatgcttaggctgtgtttagttcacactgaagtttggaagtttggttgaaattggtacgatgtgatagaaaagttgtgtgtatgaaaggtttgatgtgatggaaagttggaagtttggaaaaaaactttggaactaaacagggccttagttaatgaattagttctgctatttaataagagaactcaacttgggttagtaaatcaatttgatacgcttagttaatgaattagttctgcttttgccaattaagaagggtaatctcttcatcatcattactcatctttggtcctgatttcctgagctactgggaaattgagaatgatggccttttcttttgaggcattcgtcaagctctgctatttttgtttaggcatatataactcttttgaacaagttgcacattcgaagaaaatcacatttagttgtcactttgttctaacttcaatttgtcctacacttaattggacagctttggcgctcatgtcttatcagggtactgtttttagttactattttttcttgtcgaaactttattttcgacgaaatcttgtcttcctacccttatcatgaatcatgctcaacactgaaagagaagtgacagcttcagacgacaggaactcgagttcagaccaaaggagcgtaaaccgcaaaggtttgtttgaatcctcaaatcttttgcaatttctgattactcaaaccttctgcaattcatgagtatgaagtgaagactagctgaggctataagcctgaaaacgttgcagtatgaaatgagaacagaacatcatttccgtatatactgattaactttgccatcacatgcctcatcacaccaagcagaggcaagcaccagatctcaaatgctactccagagaacctacttcaaatttgcatctgaattattattttgtgatcaatttgaatatgaattttaaccagccgcatcagtgatctgcgttgggagaggcgacaaccttgactgccaaatttgtttcagaatctgatgatctcagtcatagttcgtttgatgaactcgaacgagaattcccagactgaaaactgtcttagccatgcgaatttacctcatcacatttcacacagaattacacagattcaccagtaaataatacacagactttttcatcttccctctaattacctctaaattttgctcaaatcaactgaaaaagtatgggtcaattagtcatccatcaggggaaacttttttaatcacataggtggatgtatactcgtttattgcatgttaattaaataattacaatttttttaaaaaaatgataagatagattaatatatattatattactaccggtatgtctaaattcgacttctataagttataacaaaagtaataaattaaactatattcagtatatgaatattcacagccaaatttattatttttgttagcataatttaataggtaataaaagaatgttgttacctttctcctgcacgagaatactgcaaggagattaacagtcaaatataaccagacatgatttaatctaaatttgttgggaagttgcagagtaagaaagtaggtccctttatacatgcctaaggtttagagtaaggtcatgttcttttctctagatgaaaattaagatttttgtggcatgctttttaaactgctaaacggtgcgtttcgtgcaaaaactttctatatgaaagtttctctaaaatatcatattaatctattttccaagtttataataattaaaactcaatcaatcatatgttaataccacctcgttttgtataaaaaacttaatcttcatcttcatctttatctttaggagaaaagaacaccacctaagacagtaggtctctttatacttgggttagtaaatcaactgtgctatctgaatatctgagctcagattatgtattcagacaatgtggtgtttggtgttttaatttgtttatcttaaaactgctgcatattcagattatgctgttgtcatggcaacatgctctgctatttaataagagaactcaacttggggtagcaaatcaatttgatacgcttattcgatgaacttgttctgcagttgccaattgaatagggtaatttcttcatcatcattactcatctttggtcctgattttccgagctattgggaagttgagaatgatggccttttctggtgaggcattcataaagctctgccctttctgtttaggcatatattaacccttttgatcaggctgacattcaaagaaaatcacattttgttgtcactttgttattcttaattgcagccagtattgatgctcaattgctcatgtccttttagagtaccacttctcttgtcgaaactctatttttggatgaaatcttctgtcctactcttatcatgaaacatgatgaacaatgaaagattagaccaaagtgacagcttcagatgaaagaaactcgagttcagatcggaggtagcggaaaggtccccttgtttgaatgctcaaatctttcgtgtttcctgaataccaaatgttctgcaattcctgaatatcaagtgaagaataggtggggagaaaagcctgaaagtttgcagtatgaaatgagaacagaacatcacatttctagagtatatactgattaactttgccatccactgcctcatcacagcatgcatggcaaggtccctttattcttgggtcagtaaatcaactgttctatcttaatatctgagctcagattatatatgcacacaatgtgatgttttgtatcttgatttgtttatcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3145 - DNA, 1289 bp, Oryza sativa
  unsure (1)..(1289): unsure at all n locations
accctctccagaattcagagaaagctacaactacaaagtgagtactctgtctactatcatcatttctctctttagctagcactgttctcaaagcaatggttttttccttcctcttgctaatcatctacttcctccgtcataatatataacaacttaagattggatttgacatatcctagtactacgaatctagacatgtatctgtccagattcgtagtcctagaatatgtaaaattcggtcatcggttactatataatgggatggagggagtacttcctgatagtgtgatattaccatggcatgcaacacaagcttgggagaaatggataatgattggtttttgccaatgtgccatagcccagaggacaggagctagtggacttcactgtggcagttgctgcaagctgctactgctgctgctgctagcttgcaggcagtgaggaggagcctttgaacagctgtggccatgatgttctgcagtccacagggtaatagagaagcaaaagatatatactgcatgatgcaggagtatgaaatagtataaatgaagtattccgtccggtttttaatatataataatatcgttggcttttgaatatacgatgaaatccttcattttttttaatgattttgaacatgagattaaacctcattgtttcaatttcctttgaaactccaatgcactatctctttcggctccaccatttaggcttcagcttataagcataagaaaaaaataatttaaaacttaattttagagttgcttcttggggaattttttatcatggtttatttttcattatttgcttttaaataactatgaacacatatatataaagtttcactcataaattattttttaattgttaataagatatttcacatataataagtataagcgaaacgatggcatttttctctctctcaactatagtctaatagagtacctttacggcggtggttatgctattggtattatcactgctacaactaatcttaatcattgttaatttgatgagttctactaccagtagaaataaatcgtctctcctctcaactatatcctaatagagcgtctttacaatggtttctgatggtaatattctgcaatcggtattatcactagtagaactaaccttaatcattgattgatcagttctactaccagtataataattattttactacaaatagttaagatagtactccctccatctacttttgatagtnnnnnnnnnnnnnnnnnnnnnnnnnnnnnnnnnnnnnnnnnnnnnnnnnnnnnnnnnnn

SEQ ID NO: 3146 - DNA, 1208 bp, Oryza sativa
tttctgtccttttgacttgttgagaacttatttttgactgtttcttccatacagggtacagattcctcctaattcccttagttattcttaagcagtttgcacataattctggcatcttcttttgcaggtgtcatgattgcttggactggtattgagcatttcattgcaggcagatttgatgatcctcctgctgttgatgagcctgatgatatgcaggtaacatgacaaattaatatgctcagttgatgagttgaacaaaacaaagtgcaccatcaagcacagaaagctttttttgcttcttataacttggtagtttaaaaatgcattgatacatgatcaactctttgctgctacaataaaaaaaggtcttgttaaaaggcagttggtgttgctactgataaggaggaagagtgtaaagctaaaccgatggcatttcaacgaacattgaaatgtgagacttggatagattatatcgtgttcttgaccttaatttgggtaaatttggcatatatgtccttttaatcccaagtaactgcatttggcactatagttgaagttcgataatttcgtttacatcaagtcatccagagtcttttttttcacccacgactcccaaacctcaatactcaaatctcaaaactagcaaattacctgccaaatttggttttggtggtattttcatcttgcggcctaccatattataagcttagagccatatggtcatcgaacaggtgagcttgtgttatgtcaaaattgcatccaagccagtcaaacaatccacattttcaccatcttccccattcctatagctgcctttatattcctcatgtctccttcagtttgacactctggggggattgatcaaataagcttggcctgtgagcaaagctagtcaatatttatgatatcagtagccatgtgatggtggcagatccaccacgaagatcagtttatgagttattttttatccaaatgttttcctataattaatatcatggaagatggaattcgcacattgtcagaactcagaatcaggccgtctaattttcttacattaaaatagaacacacttcagatcgacctgttgtgtatttatgttatggaaggaatcttgtacttggtaattttactctactcctgacgttaatacagtgtaagttctatgttttataagactgactggctattatcatgcctgataattgtct

SEQ ID NO: 3147 - DNA, 808 bp, Oryza sativa
  unsure (1)..(808): unsure at all n locations
nnnnnnnnnnnnnnnnnnnnnnnnnnnnnnnnnnnnnnnnnnnnnnnnnnnnnnnnnnnnnattctgcttctatattttgataatatacacattcaacaagtcgaaaccaaacaattaccaggtcctcataaatttgaaagagataaaaaaacatcttctgcttctatgttgattatatacacataaatggatctcacatggatgtccaaacaaaggggtaaatagattgatcaagcttattagaacaaatcagaccaaaaataagctaacggcttacaaattacaaccacaatagatatacttcagttaagtttagcatcctttgaaaataataaagtagaaatgcatgcatcatggtaattgaagatcataataatgattgaaaggaacaagttaacatcaacaatgaaaaatataagttaaatcaactatgatcttacactttaagcctcatgcccaaatcttgtagaaaagtacaatatgattttcggaggtaagactctttcttcaaatcaatgccatccctcctggatggagaattctcttctatttcctttctactgaaataccatgaagcaccaagttcaccagtctcctcattcctgccctgggtagttctgtatgggctattttctacaattccatgatgtgatgaatcacttggcatcatagccatgtaaactcgctctcaactatattgagaaaggactgatgaagatattacttccttatctattgaaagtggcctgagcagcactgaacgaaaaagatcagtaagtggttataaatttactaaggaccaaggac

SEQ ID NO: 3148 - DNA, 781 bp, Oryza sativa
  unsure (1)..(781): unsure at all n locations
nnnnnnnnnnnnnnnnnnnnnnnnnnnnnnnnnnnnnnnnnnnnnnnnnnnnnnnnnaatagccttcaaagaaatgtaagagagactcagcgaggttaaaaagtaaaatcaataaagttcactctgactgtgtaaatagtagtatatgcaatgtatcatttcaacaatcgattactttacaggttgacattgcgagtgactgcacaagataaagaactactaacaagtaacaccatctaaagggcaaacaagttaatgatgagaaatgccctgcatctaaaatactcagcgaactaatagtgagaacacagggtttggggtggggagaatgattgaaagatgcaaacaagattctgtaacaaactgaaaattcagaactatgccagcatataagatataataacagtaaataccagctaatcctattgatcaggagtaaacatacaaaagctgatacctctgaggcataaactaagtcctggtcctacggtgacagccactgctgaaagatcattttctgacacatttgcatcatcaagtgctttctgaacaacctgcaaggaaaatacaaaatctataacataaatgtcaaaaacagcaagattgaacagaaactctgaaactgaaagccaaacctgatcaatcgcaagagaatgagcttcctcggccatcttcggagcgacgcctccccacctcacgagtaaatcttccttccaaatgttgtaagcacaaaacaatacaatcagcagcgcacagagcatagcatgaccaataatacaga

SEQ ID NO: 3149 - DNA, 366 bp, Oryza sativa
aatatagtcattattaattaaagcaagatacattgaccttaccgtgaacataccattctgattaaagttccatttaaaacaaccagatgagtgattcaattggatatgaacaatagaagcacacaaatcatgccaagaaacaagattctgacccactaatgctcttctaaaatacacattaagaggaacagaattcataacactagcaattgaagaacatttccttcggacaatggtatacaaggaaggatacttatctttaaaaggcaaattaactaaccatttatcttcccaaaatcttatttgttccccattattcagaatccaagaacccatattcaagaaagtctccttaactttcattag

SEQ ID NO: 3150 - DNA, 5667 bp, Oryza sativa
  unsure (1)..(5667): unsure at all n locations
ctgcattgatgggacattcttgacaggaaagtatcggggccagatactaacagcaataggggtagatgggaacaaccaggtattgcccttagcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagttttggaagagattagatgagttgacagccaaatgcagtgatcagcgtgcagcggctccatcgaccgccgttgctgaccctcctcaagctcttggacctctcccaacggatagtccaacattggttagaagaactagattagagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagacgacggcacatgtcattgctcttgtgcaaagccgaagctgctccacaggccatgcacccatgtcattgctgccgcagtggagtgtggcataccacatacagtatatgtgtcacagtacttcaataagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcagaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtaacgtcggactaaggcgcctaacgtctttatgtatgctgatgtatgtcggacttcgacacgtaatgttatgttatattattgaactctacatatatgttaaattgcacgtcatcgttatgtaccattagtaacatttgctatatttaaatagcctgtactcttgttgtacataattaatctcatgattttattactatttcataattttgcaagttatcttttgttttacagtactattttttgaattgttctaactcgaaacactatatttttcagagatggcacgtcaggatacacctcagttgttggacccagcgatagattaccgacaccggtctcaccttactgcagtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagatgatggactgtggacaggtccctcgtagcagctttggtcgatcgatggaggccagagacgcacacttttcacttgccgtgcggtgaggtagcccctaccctacaggacgtatcgtacttgttggggctaccgctcgcgggagacgcagttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcaccatgagtgtttttgtaccgaaatgacaatcgtattacatatttagtccgcagttaaggtgcctaacattttatcgactgcttgcaggttgagcagctacaggcggaggccgacgagtactcgtacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcaactgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgacgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttccgcgtgatgcggttgttcggcttccgtcagccctttccagtaccgtttccgaccaccgtcccagctgctgttcaccggtaagatcttgctctacgctttccgttgttgcattaaaatctgcctgttcacaataatttgtaacatctgtcgtttcacactaatattacacattaattcgcaggtactcgcgcaagggtcagcactcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctacgccaggcaccgcgaccaggacttcgctcgtgttgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttagacgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggcggtaactatttttattactacttctatacatgcctcgcacatataagtgagccgttttacttgcttattgcttcagggtttcgtgcaccgttcagcaccccgccttcctcggctaggccttctgttgtgccccccacaggtacttaaaaaaacaacattacttccataatcaatttacatacattttatgtcttagcttacaagggtcccgttgtcgatgtgtaggtttcgcccacttcgctatgacgcaggccacccacttctcccaggctgcagggtcagcgtcacaggcagccggcacgtcgagtcagggtccaccactggaccatgctgggacctcgtcggaccccttcctgtcttccaccgtgctcttcgacatcactgacttcgacttcgcttcaggctcgacagaggacgtcatcggcccctcacagctgggaggcgcaccgccggtgcagacgcaggaccaggcgcaggccactcctccgcgggacactcgtgctacccgtgctgtgccaccggatcgtttcaccttctcccaggaccacgtgcgagcacaggcccggaggaccaagcgtggtcgcggcgcggggcagggccagtagagcagtcttctttttgtttacttgcttcactttccagtactgtatgcttgtgtaatgactacgttgttgttatatgtgcacgataccttttggcgcatgcacaatacctttcggcgcatgcatgactactttctgccgcaccgatgcagcctcctttatttgcgtgtgatacgagtatttgcccgccatttggcgcatacgaccaatgtaactttcggcactgatcatgcatgtatctttcggcgccaatcaggcatacccaccataccccaccacgttcacatgtcaggggtatcactcgattttttgcgcctatataagtcgccttaatgagtgagccctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatgacttcgaggaatcctgatattcgaggaaggcgcttttttaggtgccctaactatgatcgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaattacggcactccctccatgggaagcccgtccaagatgcaggtgtggtgatcgttgtcaggtcttcgttccataaatcttacaacattgggtcgaaggttctttgtttgtccaaatatnnnnnnnnnnnnnnnnnnnnnnnnnnnnnnnnnnnnnnnnnnnnnnnnnnnnnnnnnnnnn

SEQ ID NO: 3151 - DNA, 3748 bp, Oryza sativa
  unsure (1)..(3748): unsure at all n locations
gaaattgcgcaccaccaacttcaatacatttttataccaatattaccaagttttaccaataaatacttctttatttattattaacataacatagaaaagtcttttggccgtacttttttcatctgggtcctttgccgccctcgggacccagatgaaaagtacggccgcaagctctgaatgggcggccaaaattgcaattagccccttgccgccctctcgcaattttggccgacggcggcagacggcgcggtcgacccaccgtctgccacgtcagcttgctgcccaccatttgggcggcaggggctatttctgcaatttttttggtcgatagattatttctgtaaatattaaaaaaaaaaatctaaaaacgaaaatggttcgacaaagaccccccgattcatggcggaggggcagtgaccgctgccgaccaccgcccgcgccgccgcgcagctgccgaccaccgtccaccggagttcgcccgccgcggcggcagccggaagaggcgtatccgctgagacagcaagggtgagtttctttctttctttcagagagatagatagagagagagagaggggaaataatcttagcgtccaagatcattgtgcgtcgaaaatcttccccgtctcgtctccgctccctgcggcctgcgccgatctcccatctcgcggagcaggtcgcgtcctcttcctgcgtcctggtgagcatccacatcatctttttctgattcatctcacacaccctcgaatttgcttgcttgcttgtgttaaccctagcttctcttctgtagatctggaagaagctcttaatttcagagccttaaccttaatacagttaacactttgtttgttccccccacaaaagtcccaagttggatcagcccatggcgatctgtatattcttttgatcctcttcgtctgattgtcgatggtagcatgcgttacatgtatactagccaagagcctgtgcgttgcaacggaaaaagaattgagtttctaacttattaaatcgattgagcacatatttagtctaataagtagtagttttattattttccttagtgaacaagtaggtgattttgaaattttgggagagccagcactgaaacggaaaaaaatcattggagagtaggggctaataaatgggacccatttgttaggtcggttgtggtggtgcaaagtatagattgtgagacccaaatattagtggtaagggtggtgtggcagaacgaccaccaccactactaaaattttaagtagtatacagatatatatcgcatttttccttgtaatattcatgcattccaaatgaggtctttaggtggatgcgtttggtaccttagtgtggtcaccaccgtgattcccttctaagctggtgtgttccttctagctggtgcctggtccaagctcgcattatctatcttgtatttatagcaattagttgcttacagtttatctccgttgtgaagtcaaatttaccttgggctaagttcaggcagcaaaatctcaaattaggatgcagcatgctatactgatattgattggttattgcacttgcacatctgagtaattgtccttaagatggcatgctcattgcttaacaaacttgagtgggctgttccctttgttggacagcgtgtccaagaatcccagtatcccatttagaatgagcaaatgtatttccacatgatcattttacacgtctttgctagtttgaaatttatagttattccaacccaccttgcgtggtagatgtgttagatgtgcattatttgaccagccatattgcatccctaacaccacattttcggaaatataaatattcctgaaacagttagcaaactgtaatagatggagctttttttagctgatggagtcattggcaatataacttcaattatgcgctatgtgggcaccttccttgtgtaggctttgatctatccgatctgccagagtaatggtacaaggacagtgtgctaccagaataggggcaagctgtcctaaaaggcagactaacttttaaatgggccttgtggggatcacaagatggttaagaggggatcaggggagttgtgatctaccgaaataattccctttctagataagggatttgggtcaacagttttatgtcagtgatgggatggatggtacagaaataatgggactatagggtttagttaatgagttgtaccctggcagatggaaatgcagaaaagccttgaatactgagggttattatgttattatgaaatgtctcagttcctttgcttcgtgcctttgcatggtacatggagtcatctatattcatctgtaactccaaatggaattccactaccaaagttccctatatattgccttacttttatgcttggtacttcctccagtaaaaaagtgacatatgcactaattttgttcttaaaagtacttcatagaattacgcttttgtaacctttcttcatatatgataactgcatattgtggtctagccatcaaagtagcttcttatatttaaggtaaaagagctctttattactagagggagtaattactatatccatcagtagccatcttttaaaatatgcccatgaatttgtttacacagaacttcatgatacctacctttgttagtaagctaactgctctttctctgcaggcctcttttgtaatctatttatgttttagtggattccaagcaaaatggctggtcaaccaagtggtgctgacaaagaagtcatcaacgagcaaatggttgcaaacatgtatgccaacatgcgctctgaaatgaatcaactctactccagggatcacagagtcgacctgcaggcatgcaagtgagcactccctcgtgatcggtgcaatcgagccacttgacccctcgaggcgctgctacagaatgattgggggagtgctggttgaacggactatcaaggaggtcttgcctgcagtgcaacgcaacaaggagggcctcgaggaagttgttgctcgcatgaacgaggcactggagaagaagaagaaggaaatcacggagtttgagctcaagtacaagatcagaatccggaaagcagatagtgacacccaggaagaaggcagcatgaaggaaggatctgcgcagggtgttcttgtaggccctgcctctgggcagtagaagtgataaaattacattgttccttataaactgaaatttctcccttttgagtccagttttatagggacacgcatgatccaatgttctgctgttatttttggcaaatctggttgaatttccatgttacgtgctatgtaccatacatctttgacactagactttatccaatggtattgttatctgaccagttccccagtcttttagcactgtagttctgcagttttgttctgtagtttatgtatgttagctagtctgtggatacaattatattgtgcgcaacatgcaattttgacctcggttgggtcttatggattggtcacattttcttatacgattgatctcacattaaatccaaacacagatggttttgaacattgaatccaagaaatgcctatcaggcgcccatttgaggatatcatgttctactgtggtggtcaaggtggatgtactaagtaatatccactttagttttgataatatcagtaacaatgggataatttgtttctcactggtaatgcgcattattttctctattgttgnnnnnnnnnnnnnnnnnnnnnnnnnnnnnnnnnnnnnnnnnnnnnnnnnnnnnnnnnnnnnnnnnnna

SEQ ID NO: 3152 - DNA, 609 bp, Oryza sativa
  unsure (1)..(609): unsure at all n locations
nnnnnnnnnnnnnnnnnnnnnnnnnnnnnnnnnnnnnnnnnnnnnnnnnnnnnnnnnnnactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgtcagattattgaccttggttcatatgtgagattatcgatgacatgcacatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgcggccggttcgacttggcaacccaaaactctctatgaagtgacactgcaaaatgttttaccgcctccttcatatcttctgctctactataaatcgctccctgaataacctcattttctttg

SEQ ID NO: 3153 - DNA, 655 bp, Oryza sativa
tgcctgcaggtcgactctagaggatccccacaattggaggttgacaaccatcatgaagatatctccaaaaaaaaaatccccatagcattttcacaaatcaatagaatcacttcacaaaattgggaagaaaaaaatagaaaagttttaatttgcttactgtaatgcttttgctgcccccacagcgacttggaggcgagcattccatgataatcccttgtttgagtcatcaacataatgaagttcatcatgtagagtcatcttgctacagtgctcatatacaagtaatctctgatcaaactcagcacaatatccaacaagcccgagtatgttaggatgcgtcagttcggagatgttcacaactagctctagaaaggcatccgctggtattcttgagttagcagcatcaatcttcaaaacttccagtagctgatgcaaagcaaatatcacagttcagaagtgacgatggtataatcaacaaattcttgctaaagtaactactagaaaatctgcccaacagttttgtacctctccatccggaagctctgccagatataccttaccaaacctgctatctcttatcaaattttcttcgttgaaactattggtatattgctgaagggacgcaatagagaatgacttgacggtagtagttaaa

SEQ ID NO: 3154 - DNA, 546 bp, Oryza sativa
ttctgaataaggttttcccaaacccaaacctgacctaattcagtttttttgacaaggcttgaatcttataagtttatcaatggacctgacatcttcgccgcgaggcgaggggggtgtgggcggtggaatccggtggaatctgggcgaggcgccacccgtgcccccttctatgacccccgccgcgcgctgcctcgttgcgttgctccattccgcccgcgcccccgtgctcgtgccagtgtggtgtgcggtgtgccacccgcccccctttcccaatccctccggtctcccctggaaaaacattttttatcttcccaaccactaacacagcaccggaggccattaacgcgctccgccgccttcaccgatcctgggatactggtcctcctgcaaacgcgtgcgccgcagcggtcacggcggtaagttcctcagttgtccccttcttcgcacgaatcctatatcgatctgctgcgtggggttcggaggtatctgctatccgatcgcgtgctcgtgagatttgccttcgcttttgattgggagtaatcccag

SEQ ID NO: 3155 - DNA, 705 bp, Oryza sativa
  unsure (1)..(705): unsure at all n locations
tnnnnnnnnnnnnnnnnnnnnnnnnnnnnnnnnnnnnnnnnnnnnnnnnnnnnnnnnnnnnnnaactattataggccgcatgcaagtttttctcaccgtattttaggaaaaagtacaccgaagatccctcaacttgtcatcgaattacaaaatcgtcctccaaccacgaaaccggatacaacgcatcctccaacttacaaaaccatacaaactaggtccctcggcagttttatccccggttttgtccgacatggcggctggctcagcgtgggacctacatgtcaagatgccatgtcagcaccctctctcttccctttcctctccctccttctcaatctcacttttctccttatgtgtaagcagcaagctggccgatgggtggggaaaggtcgccggggtgaggcaggagaggaggaggcggcgggtgatgaggtgttgatgaaaaacacgagccctgggaggtctgcttaactccagtgcagatccaaaactcgccttcgggtatgctagcgtgccaattgatttgatcctgccatccacaagaaataaagacaaaaaaactgtgggtaaatccataaatgatagtccatcggctaggtgcccatgacatatcaatttatctttgagcccatgttaaatatgtatcgatccgcaggttttaaatagatattaagaacttaatctattcaatcggctgtagatatt

SEQ ID NO: 3156 - DNA, 932 bp, Oryza sativa
  unsure (1)..(932): unsure at all n locations
nnnnnnnnnnnnnnnnnnnnnnnnnnnnnnnnnnnnnnntacatcttaaacctcatgcaagcatgttatattatctatataatttgttaaattctagagctctaaaatgcaaacatttaaatcatcatcccacataattcacataatatttcaatatatatctccatcattttttacaatatcctatatatctacacagttcatcctcaccctcacttagctaatgttatttctctcttcgctcataagccatatcaccttaattgtttctagctcttatatgattattctatggtccaaattatatccctcctttttcctctcataaagccatatcaccttacttttacatttggatcatcattaccatttaaattatcataaatcacattaacttatataagcttatgtggtctagctatcttacacattatttctacttattatcatactaaactcgtgcagtaacacacggggtttcacctagtttaactataaagaattccacatctatttaaaagcaacatcaaacctgagcacagtacccaaatttgtaatcaatgccccatccgtggataagatcattctgcaaaaaatgaaacatatatatattagtggctgcaatatagtccacaaaagtcatttaggttaaagacaaaatgtaagtttcagattgtggtaaccaggtaaattgacgggggtgttttttgccaaaaaaaaaaaccaggttgatcatatattaattccttatggcaacaagtcattttatctacaataaactatgaacttataatggattggtccctttttctcacaactgcagcattagcaatccggggactatgtaaagctaagagaactagaaccacataaataaatatgattcaaagcattttgtgagtaatgtggaaaaacggagacttaactttttt

SEQ ID NO: 3157 - DNA, 6650 bp, Oryza sativa
  unsure (1)..(6650): unsure at all n locations
atcggagcttcgggatttccagaagcgttgggagcgggccaccagggaagacagagcatgggtcgatccgtttgctcgcccacgaagaaaaaggaagagaactgatagacaataggttagcgagtgtttcgatcatgattttgatttttttttcttttgcaacaccagttttggagcgtagagttttcggtcgccacattatgtgtacaaaatttatgaattctttacaggtggtatctacagtttttttaaggtaacacatgacgaaactcccgaaaagtttgagcaggaaaagtttggtcgtatggacatgtttggttcatttccacatattaacacactatcttttgtcaaatcttgcttgaaattgtagctaacanagtttgggcaaagaaataggtctaggtctatgactggtgcggcaaaccacagttatggcagtgactcgcttaaggaattatagcgtgcctatgtaacaaagttttatcagccaaccaaaaccaaacatgcccttcgtgtggtactgtggctggttccagacatggggattttgctagcgtggtctattacgtccaggttctgacaaaaatcggttgaattccgcgaaatttcgaggttttgttgaggctcgaaagagacaagccgtctgagatttctatgagtttcatccaaattcaaatttaaattgataaaaaagaaaaaatcaaataaaatcttataaatagtgtgatattcatagaatctattgggatataaattttcgaaaaaattgttgtattccatgtatttactgaaatttatagtaggaaaggaaaaaataatgaaataaaaaaggaaaagaatttcagtttacctccttttctagatacggattgaaatttcagtgatttcgctcagaatttcgccaaagccctcggttttcatgagcttatcggtaaactcagggaatttgtattcaaattttggtttataaaatttgtttggaatctatcggatttcgcgaaaaccgttatttcgccacagagttcaaaacggaagaccatttcgaaatcgtaaaccctgttacatcctctccaaagctgaaactgaatctgataggaccttcagctgctcaactccttccctgtcccacgacgctacacggctgctattcggatccgctgtcgttgggcctaatataagcggagacaagacgaaaaacgtgcgatgctgttagcatgtcagattagtagaattagttgctcgcttgtcgatcatgcagggtcatgtagtacaattgttgtgttggtttttcttctctctacagctacgcttgtcttgctgctttgaacttcccatgattccatttcaaaggaaaacagaaaatctttctataatcattttttttcttttttattgtgcactcgtggctttttaggtactatttttttttgtgaataaatatgtttcaacatgcttgaatgtatgcattgatagaaaaagaacggcagtgaaatggacagatttttaccaagcttgaatagtggtgcttgaatgtatgttccaacatttcctttctacatatgccatagcttttgctattgtgagttagctacatgagatatcaaggtcatctaccttccaactcactttgacttggtgtctttttgttgctaacttgtggatccataggtcatcaggtccacatgtcataacaaaagtcatgtgactttaaagatatatgatctttatctatctcgatcaatatgtgtttcgaggagcaactagcagactgggagagtagaagcctcaaatggcaactactgcaaatctgcaatgtaatattaaaaaaggtcagtggagtaggagtttgagggataggggggagaggtggagggaataatagatgtagctttatggataatctcgattataacaaaaagataaaacaaccagtcgacaatgaaggagttagagggtgaggggggtgagggggatgagcatctttgaaaggcaacaaagaatcaaatttcatggataatcctgactaaaagttagaagttagttaatactaatacatgaaacttagatattacaacaaacgatatataggtatcagaggaattcaaggatgactatccttgaaaggtgacaataaataataagagcaagaagttaactaatacgcgaatgaatatgctagctttgttgaccatcacacgataaaaaaaacaatttatagaaaaacatggtgaaaacaaaaaaaaacacatgagtatacttatattgacatggttcacatgaacaaaactatgacataatatgcatgaaaacgtttcgccgaacgcaataagaaacactttatatgcacggtgccgatctaaaacattattgttttttttttctatcatgtcacgcattgcaaaagttatagaaaaatattacttcaaccgtttcacaatgtaagtcattctagcatttctccgtttcacaatgtaagtcattctagcattttccatattcatattgatgttaatgaatatagacatatacatctatctagattcattattatcaatataacgtgaaaagtgttagaatgagttacattgtgaaatgaaggaagtacgaggtggaatactatacgagagcccgcttgtcttctggcaggcccactggcccactcaccttccacacggattctgtaacaaaatttcgcaggtatccaccgcggggcagtcaactggcagcaaaacagtagcagaggagaagcgaagcgatccaccgttccaccgatcaaggcaggtatcaaatccggcgtggaaaagccaatttcgcaaaatggtcctcgcgatctgctgccgagcctgagcctgaagcgagacaaacagatccacccccctcgtcctcctcctccaacccccacaaagctcagatctcgcgccccatgagcgctccctctcctcggatctaaaaccattcccaccccctctctctcctctgccacccaccggaggagatctgcggccatggcgggcgccgcgggagggttcgtcacgcgggccttcgaggccatgctcaaggagtgcacagccaaccgcggcaagttcgccgcgctgcagcaatccatccagtcctacctcggtgcgtgcccgtgcccgtgccccatcctcctcctcctcttcctcttcgctgccgggcattgggtggggggatctccctgccgcgacgccgtggcgctcggtttggtgggggggtgagttgactgtgagctgtgcgtgtcgcagatgccatcaagggggcggcggcggcgggacaggaggagggcggcgacgcggcggcggcgcccatcacgcaggtgctggcgtcggcggggcgcgtgctggaggggactcaggccgagctggtgctgcagccgctccgcctcgccttcgagaccaagcacgtcaagctcgtcgagcccgcgctcgactgcctccatgtaactcatcttctccttgctagtacttgtttacccggcccgatgctcatgtagcagaaagtgtgttacattatcgcttagcgccgatcattgttgagatgcgtggggagatctctcaccttagcaccaaagctcctgtgaacggcattggtccatcgcgtgaggcaaccactttgtaccgtctaggattatagttcgttcataccggactggatcagtcctcatttcacatttaaagatgtgttgcacaatttctcgagttttttatatactccgtaattgtttaggttggaggtggggggctgcttaatttttctagtagtctatgggtcttgcagacgcatcatcgaagtatgcaatacagtaatgagctttctttgaagaggctgtgttaaagacttcaactgtatatagagtgcgatttagaaagtaaattaatgcatcagaattaatagttagcatctgaataacaattgagacagcactgcaagatccacatcaactaacttcactaaaatgctacatatagttcaaaatcaaaaaacgcaaacatggtggacacacatgcctacttaagtttaacactttttcatgggattttttttggttaatgtgccaattcattttgctagtagcgtttaatgaaaatcagagtttgactcatcatgctgctatacatatagatatacaggtatgccgtttattagttatcgtctttgtatgacgtgtaagattcatttccctgttcgtttggtcaggcagtgcttctcatcctggctgagttgcagaccatatgaattccctaattgccactacttttcattacatcaaattttggacctagaatcatgcccgtaatatatgtttaccacctttacgttgccaacaaggttttaccttttcttttacatgctacaattattgaaaaatgtcttttcttttttttttttgcgggaattgaaatgtattttctgattgacctgttccattttcaattaccagaaacttattgcttatgaccatctagaaggcgaccctggtttagagggtggtaaaaattcccctctatttactgacatcctgaacatggtctgcggttgtgttgataacacctcctctgacaggtacacatcactttaagatgatattatgttggatcacacttttgcacatgcactgaactgggtgacatctgtgttgcagcactgttctccaagtcttgaaagtgcttctcaatgctgttgcttcaaatagatttagaggtgacctacttaccttgctaagcttattttccatgttgctcaaactttccatttattaggaagtttaggagctaacacgatattgtatatggcatctttgaatcatgctggcatgctaggcaaatgctaatcttattatccattatgggttggtccctgtgggcagaccttctcctgaagttttacccactaaatagtgcctacgggaattagatgaacatatcaaacactttgtgtacatagcactgcaacagggattatctaattttcgatgctattttgtttcttacattttctttggtgaattcatgaagaaattgcagttgtcttttacaaaaatcctgtaagtgaacacagtggaagatattaatctagctatcgcctttacaaggcttgtgatgggactttcatgtatctcccttttccgtatccatatagaagaataacgggagacaccatacataattttgagctgtttgtttgagtgcagtacatggagaacctttgcttggagtgattagagtatgctataatattgctctcaacaggtacatgttatatagccacctcatgatctgctgtattttgacttggaaacctgtctgatactttacaatatttccatagcaagagccctgtgaaccaggctacctcaaaggccatgttaacccagatgatcagcatcgtattcaggcggatggaatctgagcaggcaaaaaattttccccataacttctattggcattatgcaaagggagatgatttactgaaggaacgaggtgtgtgccttgccttttttgtcaggtttctgtaccacctgccagctctgcaatgaaagaagaaccatcatctagcacagaggaatcagagaatggtgaagtatccactggtaaccaagctgatgaaaaaattactcttggagatgcgctatccttgaatcgagctacagaagcatctccagcatctgttgaagagcttcagagtcttgcaggaggagctgatattaaggtagtgaaattgctttgcttattgtttaatgttactatcaggacatttcacactaatttatatgtattctattagttctatctgatccaaaaaaatcattttgcaggggttggaggctgttcttgacaaggctgttgaacttgaggatggaaagaaagtatcagggttcgttaagctttaacctgtctttagtgctgtatctgtgatgctacttacctgtccttcataggttgtagttacggattacatatgacccctaaccctcctccttttccagtggaatagacctggacactgtgaacataatacagcgtgatgcactattgctcttccggactctctgcaaggtttgtattcttattgaatagcttacaatgtacataatgttactttgaccggagttgaatatcatttacatccttgtagatgagcatgaaggaagagagtgatgaggttgctacaaagacaaggctgctatcactcgaactgttacaggttcaatcacatctttgttcttcggatgttgctaatcctgtttgtttcgatggtctgtgctaactctttagccttcagggattgctagaaggagtcagtgattcatttaccaaaaatttccacttcatcgattcagttaaagcctatctttcctatgctattctgcgagcggctgtgtcttcatctgcggttgtttttcaggtaatttcttaatcgttttttcaattttttatgcatactaccttgtcattatagacttgtagttataataagggttatttgtctgttattatcatattgaccgtcttttacttctttgcagtacgcttgtgggatatttgcagttctattgcttcgttttcgagagagtctgaaggtaaaataatatttaattaagttcacattatggacatactgtttgcact

SEQ ID NO: 3158 - DNA, 504 bp, Oryza sativa
  unsure (1)..(504): unsure at all n locations
nnnnnnnnnnnnnnnnnnnnnnnnnnnnnnnnnnnnnnnatcattgcaccaaattgtttgtgtatattacaaacagagaacgtgaaacagctatgtatctgttttatgtttaattctttgagatgcatttctttctttcatgtggcctcgccttcaaatctatatcaatagcatgcggtttttgtctatttaatgaaccatttttttccctgacgcaggtaagatcggctaccctggatacatggctgccagagcaagttgcatttattcaatgtatgtattactccctgaccagaaatttttaatatttgccatcaaacaaaggggtaatgcagttctcaatgatgattgattcccgtcttcacttctttcagcaatggggaatgaaaagtcaaatagctactgggaagcggagctgccccctaactatgatagggttgggatagagaacttcatccctgcaaagtaatgaacctcttcaactttcagtacctataaatctag

SEQ ID NO: 3159 - DNA, 311 bp, Oryza sativa
  unsure (1)..(311): unsure at all n locations
cataaaagcgaaacgaaagtttgcgatttgggcgggtcactaccgattgctggacgaagggttgtagtttgagagaaacccagtcgcccccagcaaaagagcgctccgaccggtaatgatcagcctgaaatttcatcctggattgagcgcgcagcaaatgctcacaaatcagtacttgcattttctcgcgttcatgtagccactcctgaagctcagaagactgacaagctgcagtagctgacaacccaaaatagcgaggcttatgaccatatnnnnnnnnnnnnnnnnnnnnnnnnnnnnnnnnnnnnnnn

SEQ ID NO: 3160 - DNA, 711 bp, Oryza sativa
  unsure (1)..(711): unsure at all n locations
tgttaaatggtccttgcagtttacagcgagcagtcatcatatttcgcacttaataagtagtgatggaaaaatgtcaacaaccgaatatgcggtgggataaaccggaaattaaattactgatgtgagttgagagacggttaaagtgtagatagacgtgtagttcattttctctgtacgtatatatatcaataggtgactatggtgtacctgcgcacttggcctgtattcaattccgtttcttcaatgaaaacagttcagacagagtcctctacctccacgaaagtcaccgtcctcgcttgacgtgtagtagtacattgttgccttgttggcttataccgtttcgccggagatatgaggtcgatgggcctcccaagccgaaatgccaccctcctttgctaactaggagtatctctgtttgatgagtttttaaccgctatagcttttatttaaatctttagctcccttaaacaatataaatttttaagttatattttaagataatataaatttttaagttagatttaagaagttgtagttatagaatatagaaaataaataaagataaaaatttggaaacctagcctttctagtttttcaacttttccagattctcaaaagttagtccatccgtcccataatataataatnnnnnnnnnnnnnnnnnnnnnnnnnnnnnnnnnnnnnnnnnnnnnnnnnnnnnnnnnnnnnnnn

SEQ ID NO: 3161 - DNA, 10444 bp, Oryza sativa
  unsure (1)..(10444): unsure at all n locations
nnnnnnnnnnnnnnnnnnnnnnnnnnnnnnnnnnnnnnnnnnnnnnnnnnnnnnnnnnnnnnnnnnccaagtcgctgtgggggcagcaaaagcattacagtaagcaaattataacttttctatttttttcttcccaattttgtgaagtgattctattgatttgtgaaaatgctatgtgtatttttttttttgtagatatcttcatgatggttgtcaacctccaattgtacaccaaaattttgaaccgtctattgttcttctcaacagcactttagttgtgcatatttctgaatgtggtcttgcagcactgtcatcaagatcagtatcccaggtacaataatgttaatgaaaatattttggcatcagactctttggtgatgctctggatgttcagtatttcggatgccctcatgcactgctatttaagtatttatagcatagctgtgcatttgtaattataatgaaggctagtgtaaatgaaagaattgtatttaggaatgggtattgctgattgctatgcattttcatcacattgcatcaattgagatgacagagtcttttgtttgtttgtttgcgaggagagatgaaagagtttgttatagaaaagtgatcttgttatatttcgcagggatgcttagctgacagcagctaacaaatttaggcttcagataatatttctttctagatctattctcaatctcattttttaattgccatccttgtattccagtatagacgccccccgtgtcaattgacattgctaacttgtgaagctgttcttcttttaatctgcttaggaattgctagtgtttccgaaacacatactgtcatgtttagcagtagttatatactttggaatttggatcgcaacagaataaggttgctagtttatttttgactttttgagtgaatgttactatttctttattgataaatagtgtactcttttttatgtcagttgtctggccgtatgcgcaccttgttccattatgaagcccccgaagtgcatgaatctggattattaagtgatcgaagtgatgtttacagctttggagttgtcatgttggaacttcttacagggcgtaaaccttatgacaggtaacattccaaaaggacaatatcccagacccacttccacttagctaagtatccttgttttgcttgaagatggtttctaatttttctcatggaaacggaactgcagttcacgtccacgtgctgagcaacacctggtgcggtgggccacttcccagctttacgatatcgatgctatatcaaagatggtagatccctctattcgaggccaatgttctgaaaaggcgttgtcgcgttttgttgacattatcagcagttgtattcaggtaagatatttgatattaccatcaacaccaagatggatcggtgtggctgacctgattcctcttatgcagcatgagccagagtttaggccctcaatgtctgaagttgtccaagatttaactcgcatggtgagtgatgcaacaaaggcttccatgtaggcgcttccaaaaggagaaaaatcccagaatcctcaattagctcattgctgaaaattcaagagttatctagtcatattacctgcttgcaagttgatcgctcaagcattcgaccaggcgtaggcagatcaaggaaagttcaagcagcgaacttgtgaagtggcgatgtgcagattgctgcatcccccccccccccccccctctttctccaagccattttatccctgataggttccccatccttagacaataatgctcctctgtgatctctctataatcctttagactgtactctgctatcaacacctcgaagtgcctggtttcagatcacatgacgtgatctccgtagttttttagacgatatgtaaatatactcagaagtcagaagtgaagaaacttttgtacgtcagtatgtcgagtttatgatgacggttaggcgcagatacatcagctctaggaaatctgaatattttcctgagcattcacaagtttgtgtactacatatgcattctagtcatacactatatatgcaacttctagcagatcatcataaaccctatgtaagcattctggtcatacacttcgtgatctcttctagcatgagaaaggtttgctttgcattgcacatcttatctgctctgttagcaccggggaatacaccagggttcataaaactgatgaaatacaatcggattttgtgaaaaaccgacgtttcaacgtggctccgcagtggttctcctctgaaatttcaatgggtttcatccatgcgaaaaccgccgtaccgccaatgtccaacatggaagatggtatcggaattgtgaaccctggttagcacttaagtagattcttgtttgtctccaggaaaagaaacgagtttagttccaaacttcttcttcaaactttcaacttttctatcacattaaaatttttttacacacataaacttttaacttttccatttcatagttacaattttaaccaaacttccaattttgacgtaaactaaacacacccctagtaagtttctagcatagcattgttaacttgattactctgtccgtttcatattgtaccgtttcatattgtaaaatgttttagtttttgtccgaactgattttttttttagtttaatcaaatttatgttaaacaatatagcagtattttcaaccaaaaataagtataataaaaaaatattcaatatattcaatggttgatttctaatgaaattaagttggtgttgtagatgaccctatacatttaaaatatttaatgaaatgttaaaaagttagttaggtggtgtttagatccagggacttaattttagtctctgtatttagacactaatttggagtattaaatatagactacttacaaaactaattacataaatgaaagctaatttgcaagacaaattttttaagcctaattaatccataattagagaatgtttactgtagcatcacatagtctaatcatagattaattaggctcaatagattcgtctcgcgaattagtccaagactatggatgggttttattaatagtctacgtttagacactcattctaatccaatgcccatagtacatttgcagtagcacacgagtattctgcgaggagtacgttttatcctctgcaggagtaaaaacgtgcgaagcgtgcaaaagcaaaagcactgcagtgctgcgtgggcccgcaccacctcacgttccccccctctccgagattagtaattttcattgctatcgagagagccagccagtagatagaatccgtccaaatccgaaaaccacgcgacccaacccaaaagattaacaaaaaaaaaaaaagacaaaaaaacagccggcgaaagtgaaacaagaaaccgccttcggacagagagaaaccaccgcgacgacgacctcctcccacacgcctatcgtcatcctcgcgatcgccgcattcatccatccactccccccgcacgccgaaggaataacctagaccagagacgaccaaggagagcgtctccgatggtggtggtggtggtgggaggcggaggaggaggaggaggaggaggaggggtgaagaaggaggagggggaggaggaggcgaggggaagaggaggaggaggcggcgtggtgggagggtgggggacgtgggaggagctggtgctgggcagcgccgtcatccgccatgggggcgttgcgtggggcgccgtcgccgccgaggtccggtcccgctcgccgtgcgccttctcgcctgaggtccgtgcttcccccctccccgtctccaaccctaacctggtggtagtgctcatgagtcgtgcccaatggctgtattgtcggtagttgtaggatactatgcattagggcatggatttagccatttaggggtgcttaatttaagtattatcatcgttggatgatttggtacatttccatcaaatggtcttaggttgtgattttagcgatgctgagaatatgtggtcgtgttgcttggacgggaatgagctttacattccaaacaaaatgaagcaaatgttaaggaacacatgctgtaattttgactcgcaacgagggaatggaatgaaaatgtaaccttacagccattggccttacagtaaagcacccattgcataccttgttcttgcttcgataccaaagtttgacagtttgtgcaatgccaagggtgattcgtcttacacttgcgtcaaactaatttgatggaatgctgttgttagctcatgcctttcttacaatagtttgggtatgtgagagcattgagcccattgtctgaaacattttggagcttagtacaatcagttttacagatcaaattgtttctagtttccaaaaaggagcaatgcattttatccgcctgcatgtctgatgcctgctggaagttatggtagacatttgcttacttgatattagagttccatactaattatgagcttacccattcttgttcgcaggaatgtgaagctaaattttcagagatacaagcacgctactctgcatgcgagtaagtgttgcatcattctttctatgttgtactagcttgtccacatgaattcagtcttataacgtcttgcagtaagtatgtgacgataaattagtaaattgctaaccttgaactttaacctgtgttgagtctcctgtcttggcctattgtatttttcatgcgggaactggatgaactctgaaactgattacacaagatgcataatttgtgtctcatggcacataaaagctaaatagacacgatttataccttatattatttgccttctttaagttggcctatgatttctaggatctacaattagaattacagcaggtgatttttttcctactctctgatatagttttccaattaggacaagtttggtggtaaaatggtgttttgctgtctagcagtgaactggcttagattttagaaattgttgtatgagggcaagggcactggtggatctggggtagagccgtagaggtagggataatactttatgatcaattgatcattgttgagttagctttgggatcatcagcatgagattcaaagaaagaaacagcaagtctctcaagttgggcacagttcgaacagtgcgtattttacaaaaagaaaaaatcttgctatagagaagtattttttaaaaaacaaaataaatccatttttcaagattttaataattaatagtcaatcaatcatgtgctaatgactcgccacgtttcaaatgccaccgataagctcagcctaactcctgatttgaacgtagcctaaagcagtagttgaaatttgaacagtcgattcaactcttaaacatcttttaataagatgtgctgagtttaagttactctcctcatattcagcttttacctagagccaatatacccaagacatttcaactggctgtggtctagtatgcatagtgttttgttctgcagtaaaacaactcacctgttggccattgatagaacatatcatattcattcaacttgcttctttgcagtgcttggtttgaggagctccgtaagcggagagttgctgaattaagaaatgatctgaagaagtctgaaaattttattgggttagtgtttatgttgttacatttcagtatatgtctaattcttgatcttctttttagcatttcaaatttaatttcacaataatttagtttgaatataaggcctatgattattgatttcagaaaaatggtcattccatctggttttcatcttttgtacacttacataatgtgaaatctggtttcctttttcctgttccagatccctgcagtccatgatcaaaagcctcagcaatagcaagcatgatgatggcaactctgaatgtcacactagtcatactgagtcatgttcaaataatgaaaatacagctgataacaattcatcaagcaaagcattgtccaaagatagatcatctgctgctagttttacagaggaagcaagcaacagtcagaaatctgaaaaggtgcaacactgcgatactgattcaattcaagtgaacaatacttcagcagaggctttggtaaaaccccttgttgaaaaaaaggtttgtgctgaagatggtttgctttggggctctagaaagaaaagggccgtgagggataggaggacttttctgatggctgataatagttgcagagctggcgagaatacatctacatcacacatacagacagatggttcctctgaaggctatgcaaagaagggcttgaaaactccaaatctagaatctggtgtgtctgtcgttgagaaagcaaaaccaaacttggcagagattttgaaaactatatctactcaaagtgactgttatatgttgcaacgccgacttgatgtccaggtatgatggatagatcttgtaaattcagtcaagtcttgtacttatggaaaattgattagagttgcacgctgtttgttctgatagggtatcaagcaaatgaaacctttgtggatactaagagtttttagaacccattttagcgacttcaaaataaagtatacatgtttatataactgtttgtgctggaagaaactttcagtgcctttctgcagtttatgcatttcaagatgaaaaaatagcagacactggtatgtttacattctatcttatttgtcacttttgtcacacctgcagcggaagcggactagatacaagaagatgattcgccggcatatagacttccgtatccttcattcaaagatcaagagtggcgcaacatcttctaccaaggagcttctaagagacattctactgtttgtgaataatgtccttgccttctatccaaaggctacgttagagcacatggctgcaattgaacttcgaaatattgcattcagaacagtgcaagagagcgcaagcatgccctctaagagttgtggagtaacaggagcagcaactgcccctttagtgaagaagaacacccgacccgtgcagcctggaagtcatgggcctcatgatgcaaagagaagcaaagtttctttaaaggggactggaagtactgtcaagcagggtgaggccaagggatcgcgtggtggttcatcagtgacagctaatgtaaaaactatgcagagaaatccaccggccaagaagagaggcgttgggcggcctccaaagaatgggcagaagcgtgctgctgcacagcaagatagccctaacaaaggcaggaagaggacccgacgctgaacttcggctcaaaatgcccaaatatacaaaactgtgtacagacagcgtatagctagaccacatagtgtcgtctctttcagtgtttacttgttacctggcaaagactaggtcggaaatcagaatgttgtagcagggagtagtactgtatttcctgttgttgtcttaaaaggacagataggaaagaacatttttataggcagaaactatcaacttagatatatatagtatatctcttgctttgtgcaatgctgatggtttcttgatcaaatgcatgctatgatactaacgcagaaagtttacctgcaaattttgaacttattaggggtatatattcagtacaatgtacagtggcttgtcattgctcaagaatcatgatctgtatagtacctgtcagtctccagtaactgcatgatctgcatctgtatagacgacagtcaatacttactcaaggcgtgtttaggattgatgccattttaaaccatactatattttttaagttgttaaatatgtggatccatttaatttcttgtcaatttttaataaatacataagaaataatgttaaaattttgacaatattgttaaaaatttggtaaggtttattttggctacaatctaaatggctcctcattcctgtttattttaggagggagggaaccggtgctttgattgatgatgttattgggccggtatgtcgttatgatgggccgcggcgggccggcccaaaagcagcgagcccgaggaggagccagccaacaaacaaaccgtgcggaaaacccggtcgccagcggctagcccaaaaaaaaagaaagaaaaggagaaaaaaaagccgccgaggcggctcgcacccgtcgccatcacggcaaatcaccgcgcggcgcgagtcatgggtgcagcgaatgcgaaggcgtgtgtgtgggagagagatggggtccgacgtggagccagccagccgtgggaggtggcggtggaggtggaggtggaggtgatctggggtttcatcattcgtgttccttgtccttttgtaagagaaaaaaaaaatagtacttacttacattgtgaaacggagggagcagtaacttttgctacattttctagtacatactccctccgtcctaaaaaaaactcaatttggaaggggaggggatgtggcacccgtccagattcattgtcctaggaggggtcacgtcccttctaggttgagttttttttggacggagggagtagtttctttttcttctaatttcgtatttacgcgagacacaccactgcacggattgagatcctctgcagtcagatgcacgctgcctttgtcacttacatgtgggcatagagaacatcgggtccacatatcagtgacaaagtcatataatcttgatcctcactgcacatgcggaacgcgcgtacacacactaaatgactactatataccgttacacacgagcttatcaccgttacacatgcaggccatatagacatgccggtgagtgtaccatcaacccatcatggagaatgtatcgtaatatgcgactatacctttaacacgttctaaataatagatttgagacgcataaggatccggtgcagtcgtagtagagactgcaaaggcagttgggaccgttttccatcattagatcgagaggcaatcaacgatccagacatgtgctatatcagttttaagtagtactaactgctactacaatactacagggaaagaatttctgatccaatagtagctctaggacagctatagctactgcaggggatcccaatcctgtttgagatcaacaacaaattcatgacctcttttctatagtgaaataattagttgatgtcttacatcttgctagaaaaatacacggatgaatgtatacatattgtagaaatgatggataaatatgtattgaaataaagtggaaatgatatgggacatgcttatatattaagctctaggatgtattaaatagtaaatgatatgctatatttgtatgtgatttaaaatattttgatagatttgtatgttaagctttaaaagctagcgggattcaaatatataaatatattccattgtgagcgcacttctatctatcatgctctaggtgttgactagatgtagcacggtcatttgataaagtaccatactctacatcttattaaattttagcagaatatgtacacttgtttttgtttttgagaggatacctaggagggtgtaggtacacatgagttatatacaaagacaaagcctacgacaaggctggcctgtacaaacattacttgtaaacggttgcacatcacaccacaattaaacatcatcacccaaaggcagcatacaacatagtcttctttcgggtatgctcctcatggaataaattatcaaacctaagctcttcctctttttttcttaaacgttggaactgtcaaagcaaaagcagttctggtgcaagaacataaaaatgagctttcttgctgtccttgtttccacagcattaaagaataagcacagcacccttaacagccaatgacactaacacacaaacagttcctcttgttttcgaaggttggactaaccatgctacctatttctagcctaaatacctaggagatcttccctacttgcaattcacgggtagataaggttattattgttgtgaattgcagcaatcagactgatttatatccccatcatgtgatccaggcctggctgaggagcagctcccatgcctgcgcctgtcacattaagaagcaattgctggagccagcgccttgttgtaggatcatcctgtggttgtcaaaagttggtgtttcaaacctttcatttagtattaatttatcaagtacaggaataagaaattggtggcagctgatgggttaatatcactcaccctaagacagttattgaacgtgccatccttcagcatgtcagggaggcaagtttgtagtgcagcacatgccctgcatagacgccgcgtagaaaaaaatagcctgttcagaatatttaagtaaaataatttgatagcacacaaatgtcagcacagacctggaattgtctgacagcctaaggtaacatcggataatgtgcttcagcaaccttgtggaaggctgctcagcaagtgaaactaccatgtttgctaaaacactgcctacagcaaagaaacgctcagcagtggcacaaatgtagcgcaannnnnnnnnnnnnnnnnnnnnnnnnnnnnnnnnnnnnnnnnnnnnnnnnnnnnnnnnnn

SEQ ID NO: 3162 - DNA, 693 bp, Oryza sativa
taatatcactcaccctaagacagttattgaacgtgccatccttcagcatgtcagggaggcaagtttgtagtgcagcacatgccctgcatagacgccgcgtagaaaaaaatagcctgttcagaatatttaagtaaaataatttgatagcacacaatgtcagcacagacctggaattgtctgacagcctaaggtaacatcggataatgtgcttcagcaaccttgtggaaggctgctcagcaagtgaaactaccatgtttgctaaaacactgcctacagcaaagaaacgctcagcagtggcacaaatgtagcgcaatccaacatcatcgaggagaatcttctgaacaatgaaggtggccacctacaaaaatatttgactaaatcagtgaaataataatggttcattaggcctagcttggcaaatgagatttatttctggcctcatttgaactttgagctctcatcaacaaaagaagcttaagttcctcatgagctaccaacttaactatacctgtgtacctgtgtacaaacttaactatacctaccaagtttaaacagttaggtttgggtcataaaaaaatggaattaaaagtggcagcaccatatagttgccaaattgccaacctcctctcaatacatatagcacaatccaccttttaggcttataaaacgaaaggtggcatttgagcttaacaa

SEQ ID NO: 3163 - DNA, 721 bp, Oryza sativa
  unsure (1)..(721): unsure at all n locations
ttcattttcttgccgaaacacttccaattttcagcgacctattagatgaccaattttggaacacattgccaatgcaattttttaccaccaaccctccccctggtcacccagatttcagaagcaaattaactaaaaagcttgctgtgaagtaaatattgccaatgtttttccagcaaactaattatatgccaaaactgacaaaccaaattttggtagttctgtttggtaactgcagctggcattatttcagaaattctatagttcacaagcgtttgttctatggtagcatttccaaattatctttgttgcttgactcttgaaggctatgtctgcatatggccctcttccacatataattggttctgaagagtacattcatgataacagctgtgatgtcggacaaaaccggggataaaactgccgagggacctagtttgtatggttttgtaagttggaggatgcgttgtatccggtttcgtggttggaggacgattttgtaattcgatgacaagttgagggatcttcggtgtactttttcctaaaatacggtgagaaaaacttgcatgcggcctataatagttgggcctcaacgggaatgcgggctacgtgcggcccatattagttggaccgagagctagaatgcggcccatattaagtgnnnnnnnnnnnnnnnnnnnnnnnnnnnnnnnnnnnnnnnnnnnnnnnnnnnnnnnnnnnnnnn

SEQ ID NO: 3164 - DNA, 728 bp, Oryza sativa
  unsure (1)..(728): unsure at all n locations
tnnnnnnnnnnnnnnnnnnnnnnnnnnnnnnnnnnnnnnnnnnnnnnnnnnnnnnnnnnnnnnacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttaaaattcgaccccacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgt

SEQ ID NO: 3165 - DNA, 620 bp, Oryza sativa
  unsure (1)..(620): unsure at all n locations
nnnnnnnnnnnnnnnnnnnnnnnnnnnnnnnnnnnnnnnnnnnnnnnntaatcctttagactgtactctgctatcaacacctcgaagtgcctggtttcagatcacatgacgtgatctccgtagttttttagacgatatgtaaatatactcagaagtcagaagtgaagaaacttttgtacgtcagtatgtcgagtttatgatgacggttaggcgcagatacatcagctctaggaaatctgaatattttcctgagcattcacaagtttgtgtactacatatgcattctagtcatacactatatatgcaacttctagcagatcatcataaaccctatgtaagcattctggtcatacccggattgctaatgctgcagttgtgaggaaaagggaccaatccattataagttcatagtttattgtagataaaatgacttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3166 - DNA, 527 bp, Oryza sativa
  unsure (1)..(527): unsure at all n locations
nnnnnnnnnnnnnnnnnnnnnnnnnnnnnnnnntgtaaactgaaaatttctctgggttaaaactacaagtcaaacattatttggcagtttaccataatttgattttttttttcaagaatacacaagttttacccatcaatgcagcattctattctcttgcattaagatgaccatggtttgtttggtcttgtaggtcaggagatattcacgatcggagcttcgggatttccagaagcgttgggagcgggccaccagggaagacagagcatgggtcgatccgtttgctcgcccccgaagaaaaaggaagagaactgatagacaataggttagcgagtgtttcgatcatgatttgtatttttttttcttttgcaacaccagttttggagcgtagagttttcggtcgccacattatgtgtagaaaatttatgaattctttacaggtggtatctacagtttttttaagnnnnnnnnnnnnnnnnnnnnnnnnnnnnnnnnnnnnnnnnnnnnnnnnnnnnnnnnnnnnnnnn

SEQ ID NO: 3167 - DNA, 343 bp, Oryza sativa
  unsure (1)..(343): unsure at all n locations
nnnnnnnnnnnnnnnnnnnnnnnnnnnnnnnnnnnnnnncctgaagccgccggccgccaccgtactcgtatattcctctccacccgtgtgtcgcgtcgatcgccgtcggcggcgggcggcggcaacttctggtttatggagaggaacaactagggtgggccggtgattggtccagttttgactaaacggcccaattggttcatggcccaagcgcatcttaggggttcggagatttcttcttcgtaccccgtcgaaacatacgcattcccccctgtggtgccctcgtatcgtattaccggacacctacgaggnnnnnnnnnnnnnnnnnnnnnnnnnnnnnnnn

SEQ ID NO: 3168 - DNA, 2829 bp, Oryza sativa
  unsure (1)..(2829): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccaccgcggataccaccccaacaagaatgtatccaacaaatttcattgcagaaacattgttttttcttgatggggcattccctgctggtgcaatagaagaatttgaaggttcttttgtggggacatgccctgctggaggtgatactgatggtaatggtgtcggtgcagcaggaggcaatgctgatggggctatgctggtattgaatgggttcccatccttcctgtgtggtacattagtttgaatgaacttttcttctttcgctaaacacaaatatgcacatgaaaaactagttgattcttaatattaaaagagtatacgagcaatggaattgatttttaaacattaaagttagagcaacgatcgacagaaacaactcaatcaaggggaagttccttacttaaaatttggtatgttctctagtttcacaggcacaggaccggagaaaagattgttttctatgttcctgttgaattagtcaccacagaaaacaaggcgtgaaaaaagagagagaaattatctttactgaaatagcaggtttcctgaacttcttggagaaaagaattaagtaaaaaaaactgtagttttgtgtacatacaaatcttggagagggagatcttgcagcacattaagcaacccaattatttgattgttctgaatatgcctgtgatcatagtataacattaagtacttgacactagtgaaaagtcaacttgaaagacagtgcaataaacttcaatactcacaggctagtcaatgctgtcaagtttcccattgaaggtggcaaaggaccagtcaagttgttggaagaaaaatctctattcaagaaggttgatcactttggtaagaaacttcacattgtcaacaaatgctagtatagaataacacttagagcaaacttaaacttgctcttacaaatttgcaagtccagttagagttgaaaatgcatctggtatctctccagataaatgattgttattgagggacctgcaaatgcaagaattatcactgaaagcactaactttatgaagtcttgtgaatgtgtaggcaacaatatacttacaagcctgtcaaaagcgtaagtgtcgacaatgtacttggaatgctaccacttagctggttaccagaaaggaaactgtaattgacaagcaaaaccatagtaaaagattaaaataaccacatagatggtttggaagagtaacaaaatgatcaaatgggcatacaaacgctgcaatgtgattggcagattatctggtatggttccaccgatattattgttgctaagatctctacattgggtaaaccaagaagcattaagaaccaagtcaataacagtgtcaattcgagaggaaatcaccaataatcttaaacttcacgaatgatcagcttacaaggtgattagcgatgtgaaattccccagtgtgttacccagttgtccgcccaaatttgcagcattgagagttctaccagaaatatcacattgttcagataaccagataaacaggtaatcaaacaaacaacattaacaaaacgaaagtgtaatagcagatcatacatggaggtaatatttgagaccacgcattcaacaccctgccagccttcattgcaggggtcgccaccgtttgtaatccatccaggcactgaaggtgacccaagtgcagtgtacaagccatttattgcaaacactgataaacacaaacaaagcacaaaaataaggtgccacagaacacatttttggagtaaaatgtgatagtacaagacagctccgtcatcaaaccataaataatctgggtccctaatgatgtcatcaattcatgatcatgtacagctatgaattctgaatctttgcaacagtcaaaaccaccaaaaggacagtacataccatcttgctcataagtgtaagactgcgagagcggcagcgcggcggagagcagcagcaagaagacggcggcagaagcaatcatgggcagggacttgctcttcaccatgcgaacatccatgaaggatcttccaatgcgggcatcacctgacgagcacttccgaggaatgatcaagaaagtaatcgccaactttgctttgatctctgagcgcccagccgaatgatgaatatctgaggattgcaggtgcagcctggcgtcagagaggaacaggacagataaagaagaaggaaaaaaaaaacaaagttggctaatggcaagcaatgccaacgctggaagaatctcgcaacggaaagaggtgccaaaattcggcaagaaatccaccacatcaagaaaaaaaatccccttttaatcactcgcaacagcacagtctccaaaagaaatccgtcgaacacgccagatataacccaagaacatgtttattttacctccaaaaaacagattgcaacagagaaaagggaagccaggaagcgagaagatgcagaagaagaccgagaacaaaagagagaaagaaagaaagaaaagaaagaagattataatccgatacctgcagattcttgtcgccacagcacccctcctacgacgaccctatctttgccgccgccgccgctttatggagacgctcgccaccgaaagctactactaccagtccaccaccaccgagtgcgccctcctttctcgcaatctcccccccccccc

SEQ ID NO: 3169 - DNA, 9282 bp, Oryza sativa
ccccccccccccccccccccccctcgtaataatgcgtttaaaacttctcaccgagcccggaagccttggccgctaaggattttgctgctctgctcggtggagaacaacggagacgacgggagaaaggggagggaggaaagagacagatctacactagccttgcaatctcgcagagccgtcgcgcggcaggggattggattggggagataagcgagcggcgagtgaggaggagagtgtgagagagcgtctgttacgcttgtgtgcgcgtaggcggagatggggtggaaggggaaaaagacaagtgcagcaaagcagccgcttttaaacctgcttagccagcgctaagaatgagcaatgattgtgacagcaccattttttttttcaaaaaagattgtgatagtagtagctctctgattttttttttaatacggtataagagcaggtacagtagcagactattagccagctgtaaacatattttaatgagataaaagatgagagaaaaaagtagtgggctacagatctgtagccagctgcagcacggactccaagacgtaatatgtgtatgacaagtgggaccatatattaatagaatagtaagcaactattatatgaaatggctattagatcggctatagacgaattggagccaatagtgggctatactattaaacttgctctaaacgaaagaaaaataatctatgtaagcactcgtaacactacactctatgagattgacgaagtgactatgaacgtctcgttgtcgacgtttgcgaatatacactttgatttacaaagtcaccatggatatcgtgtcgatagatacatcgtctatcgatgaaaaaataattagacgtatatataatcacgcatgttaagtttagatcttgaacctaagtgagtagattctaccaaaaggaattaacaagttatggtcacttcgtagctctctgattttctttttaaaaacagagaagaaatttcacatgttttttttcattttttgagtggtttatttgatttccaaaaaaaaaaaaacaagtgaactctcatgttataaaggggggcctagatttaggatctgtgtgaagttcatggtacaaacagtctaacaacttataaaataactgtctaacaagaatgaggcaatgaaagtgtgactatacatccatggcttttgctaaagacgtggttacagatagctttgtttttctttttcttttacaccctttaaccttacaaccttgtccatgtgaaacaatgaaacatgagtgcgccttgcaaaggcatgtccactccccctcaaaaaaagacatagtcacagataaatttagaattggtgaatttggttttgttactactatgcgctttgcataattactctgtagatctgttttgtgattgggctttaaatgacaagaattgcgatttatcatgatagaatctgtgtaaaaaaagaagcatctcaatttactgagataccaccatgggtataagaatgatgaaccctttgatttttgggacgctgatgaccatggattggagactaaaatgatgttgaggagtcgtctggtacaagactgctccatccctcctattcctgtttcacggcggaatccaaggaatgccttttgctgtagaatttgtcccatccttttagcccatcgtatggataaaatcatgaaaaaaaggggtgaactttggtagtcctagagttatgattccgatcatgtcatcccaggatctagagcccaaaatttctgcgtctacaataggcatcgcatcagatacgctgcctcgtgtcgcctcagtaatctgtacttgtacactaacagaaggacaatacgcaatttattatccattttttctcctacttgcattgcaggagattggcatgccagcaagctgaaggctcacacaatcctcccgtttccatgactaagggtgtgttcgaggagaaggggatcgaggagattggggagatacgtaaaacgaggtgagccattaactcatgattaattgagtattaactattttaaatttcaaaaatggattattatgattttttaaagcaactttcctatagaaattttttgcaaaaaacgtaccgtttagtagtttaaaaagcgtgcacgcggaaaacgagaatcaatctcccctattatctcctcagaacgaacagagcctaaaggccgaagcttttctcagtttctggcggcacactggacactgagcaccaaccattattccattaagcaactgttaaacgcaacactaattgactaatcaagtaatcaacagcactaaccgataacggctactgtaacgtggtgccccttttgaaaggagtaaacaattagtaggagcactaaataggggcctaagtagccgttgtagctgccgccgtgtcagccagtgtcgccaccaatctacctcgagctgagcctcagcaacgcatgtcgaaactgataaaataaatcgacaacgacgatgtcctcacgtgcatgaatgcctaatttggtactgttactaactgaacatcttggtggtacaccagcaaaagaaatcatccaagttgatctactagtggtactaataataaattaactgtccaaaagcaaggcaaatgaaagtatgaaacgcctgatcgacaagagcgtacgtgtgcaatacgagccgagtaaatgagggcacatgaaacgcagcaaagagagagaggcccacgagaacggacaggttgggaacggaacagctgccggattcctcctgtcgccgtcgccgccggcgtccagattccgccgctgatccggcagctaatgacacacacgccgccggctcagcatgatgttgacgccgtagccaccacaaaaaggagaaaaaaaactcatcatcggatgaatcgcacaagttttctcgagtggattttgcgttgcatgcatgggggggtgtcgtggtggtggtggtggtggccatctcaccatcgtgacagcgccgctttgttgtctgcgcgcgaggacaccgggttgccaccaaggctagctgtcaccgtccaccggacggcgactgcctgacaaggcaagcttaacggcttttcatcagttgcattgcactgctgcagcctgtgcggtccacatcgcgatcttgaccggtttcagataagttactacaatcgccgtcttgccgaaagggagaaacgaggccatccaagcgaattcttcaggagaaaagcgggtgtgtttagttcgcgaaaagaagaattttgtaggtgtcacattggatgtttaactggatgttggaaatggttttccgacatgaatgaaaaaactaatttcataactcgtatggaaaccgcgagacaaatttattaagcataattaatctatcattagcacacgtgggttactgtagcactcatgggtaatcatggactaattagactcaaaagattcatctcgtgatttccatgcaaactgtgtaattagtttttctttttatctatatttaatgctctatacatatgtctaaaaattcgatgtgatgttttttggaaaaaaaattttggaaaataaatgctttgattagcctgttttttttctcagcatcaaaggtcactggcaagcaggaagaggcaggcacatgggaacaaccaggcagaacaagaatggctttaacagctagcttcacattccccgacagagtttctacaagatgtgtatagtccatccttccctccattggggatctagcaaagaaaggtgtaggatcgacagcgaaaacaaaggcatctaacactagcagagcaagtgggatcggtagccaactccatcgatccgccggctgctcgcccgccacaatacggcaggggcagcagaacttgctttagaacaaagatacaagacctgtacatatgtggagagaacctgcctgaattctgctggagaggcaggaaatacagccagagaagaacagaagaattactttgcggatcgctgtgatgcagatggcatttagcatttgaatgctactagctcggatttgatgaggaaccagcaaaaggagtgggctggtgtgagggccactggaccctttctggagggcagggtgctggggcaggatgagcgatgaatgttggtacatcgtgtcctggcattaaaactgagacacctttggcgtaaacaggtatctgcgaaacacgtgagcaaagtagtcaatgaggatgtcccactttcatgatcaatgtatgcacaaactggtaatggaacttcaaaatacagagcattggtaatggaatcgatttacatttttatatactagtaatagaaacgagtaacaaacatgtattccataccggaacttccccaggaaccagtcaagttgaaattaccaaaacccaacagcaaaactgatgcacatgaagaaaaacttttcattttcagaccatctaagaactcagggattggagtgacatagggtcatcaaagtttcagatccgtttgcaggatttaaacttgattttcagggctgtgtgccgctgttgagtctctttagtcctcagttgcttactgtttagtgctgtaaactctcttttctatctaatgggaatgacatgcaaagctttctgcatattccctataaaggtaaagaaaaacctccagggctacactggagatctttaagctggaagaagttccacagatggctcctatgaatgcaggaactcctatagttacacagatgggttttagtagtccgtaactttggaatgatcagtgcagggactcccaactcccaagatgccaggcctagcagatgacggttctatcatgcaactattttttaattgggtgaaagattcactatagttaaatctaaaaaacaaagtgcagagagttttaatctgtatagtaagtactccctccgtttcataatgtaagactttctagcattgcccacatacatatagatgttaatgaatctagtgtctagattcattaacatctaagtgaatgtgagcaatgctagaaagtcttacattgtgaaacggaggaagtagtctgcagtgtaagtaccacaagcatacaccactaaagaacataatagccttataaatcttataagccaaaacgtaataagccaacataataagccaaaacggcttattaaagaataaaaatgaatttgtaggtaaaacttttatatatgtgttctcggtgacttaaaagccaacgctgaaaaagaaactacgttgaaaatatttcaaaatcaatgtcaaaattaagtttgaaaattcaaattttggctttttctttggctgaataggccatccgatgggagcctacattttcctataaaatatttccatgtcacagttctgagtgaattttggagccacactacagaagctgctaaaaagaattctagtttgtatgaaagcttgaatcagttgtccatgtttaaagctatcgtgaaagatttggcatcaagaaaaagaatatttaatagctgcatgatgtcatttaacagggaacgttgctagtgaagccttgttgtgatccacaactatgaagctgatctaaatatttctcgaccgggttagtaagcaagttttctagtacaccccccaaagatctaaccgatcaaaaatctcgatcacatgaccacatactttccacttaaggcgaaacagatgcataattaaagtagtccagtggtaagtggctggtttttacccctcccaccccgcacccaaaaaaacccaccacatatgcatgcacacaaataaaaatcaatggtaaaagattgtcagtattcctatttcctccactagcttcacaccgtagtgagagagatgatttttagcaggtgatccttcaagtatgtggtggctcctactgcagttacactaaacagctagatcaggtaatctttttgtggaatagattgggtaacagttgctcgggtaatttttttaataatacagtgacaagaatgatttattggtaggctaacagattaaatggcaatagtgaatttttaacattggtgatgcccattcaattgtatagtaaaccttatctcttccatggcaatcctttgttataacagagcacacaggaagtactacctccattttgtaataaatgacgatattgacttttggcataatgtttggccattcgtcttattaaatataaatacacaaaaaatatgaatcatgcttaaagtttacctaatgataaaacaagtcacaacaaaataaatgacacatacaaattttttgactaaggtgaatgatcaaaagtgaacgacgttatctattaaaaatggagggagtaatacacatctatattttgaataagtatggggattcgaaaccatggacttttgcaattcagtctagtgttctatcactacaatacaagccagccctcttctaacacagtccaaatttaaacatttcaaatttgcactagcatcttaataagcaggaaacaaaaaaaattgtgaatagagtagaaaacaacatgcagcagggcaatccacttcaggggagtgattgccaactatgagtgcaccaatttcattatacctattgctctttctaccactagactaccaaaaacagaagcatatgccagaaggaagccattattatagtttcctatgataggaaaaagatcagctcaatgtagacaacacaatgaagtaacttagcatacagaatagagcatagtcctaatcactagtactagttcataagtgtggattctgcaccagcaaggaattcataagtgtggattctgcacaagcaaggaatgaacttcaaactagcaaagttgatgccagcagttgaacaacaaagtttaacgtccctaagagaaggaaagcaatcactacaagtctacaaaattatatgaagtatacaatgcacatttcacatctaattgaagttactgagtgcttttgatccctatgatgtggaccattataactcaatcaaattctgctgctgatctatcttaacaagatgttccacaaatgctaataattctcaaacagcaatgaatgagacctctggctgtggacagctaacattgcaagccagaggatgattcagaccttggggtggctgcagacagggatgggcccttgtctgcttgctgctgtctcccatattcccctctcaggtccattacgcatgatattgataatctagcctctcttgaacaataacgcttttaacccgttcttttcacaacacaacaaaccaacatagcctattgaaagcagcaaaacacttcagacccgcctggaagcaatcctaaggattaggatccaaatcccaagcttccagacaggatcttagatgacaaatcgatactaatgtactacagtaacattgggacgaatcccatatgcagctggtcgggctcatcgtacatgacatatggatatggcttgttgtgatcagacacgccgtccaaactaattaatgagttgtcttggaacaatgctgcaacacctatttcttcagaatgaccgtacacctatgaacggaattggaaagatctaacttaagctctcaaatgctgcacctcgcttttatatgtgaggaatcgtcaaatctttcaagatcatcctaatcgtcaaaagagtttagagactacgaattcacaaccgatattcaagtcaagaaatctaaaaatgtcagggtttgacttctcactccctgcttctgcttcttcctagtgagagagtggaagatgtggaaggaaggtggcgggacaagtttcgcaaccgggtcatcaaatgagcagacacaatgcgtgaaaaggcaatacgatgcgatgcgaaaagcgaaagctgcgaaaagggcgagatgacggaatcattaaagcgatggatgggaagggggggagagcgtgcgggagcagtgcgccggtgcggccatacctcgggggacgcgccgccgtcgagcttcctggccgcctcgagatccgagccgccagggaaggcggcctcgccggcgccgcggcggtggaggagtaggcggaggcgagagaggatccctcccggcggcggcgggtgcgggggcggcggccccatcccagcgtggccgcggtgggccggggagcggaggaagtgctcgaggatggccatggcgaggaacatggagacgaggatggcggtggccacgaacccgaacgacaccgcgctgacgccgctgtccagctgccgccaccgcatctcctcctgcgccgccagcgccgctgccgaccccaccaccaccgtccccggccccgaccccgtccccgccgccggagccatcgccggcccgcgctccatgcccgcacctcccacctctcctccctccccaccaccaccgatcccacctgcctcacgccaacccaccggccgccattgccgacctctcggcggcccgccctctcctccaacgcaggcaccgcactgcgccgcgccgccgccgccgccgccgacgagtggaggtgatgcaggaggagtggaggagacgaactgggaggagaggagggggtggtcagtggtggtgtcacgccgtcacacggcctacgcgcgactagtaggtccttgtctgcagcgtgacgagagacggggcccgggggggcgctagtacacacacgaggagcaggggtagaacgggcatttccaccgtgacggggcgcgcgtggcgttctcctctcgcgagaagcggctcggtgcggtttccgccttcccatactgcccccggctcgggcgtgcgtcggacgtgtggttccaaagcttttattcaacgcttcaaagaacgctttaaagccaagtgccaacgccgaaatttttccatctcttgcaactgtatggaagtaagagtattatcaattttttgtgttcgaaaatcttagttttgaatcatctcctaattatgtttagctaagctttatttttttccaggatgatgatcagagcaaggttctcctactgacacttgttgcttccgcaaggcagagagacacgccatgtgtgatgcgtccttgactggtcgatcactcgggttgctggctcgatgcacggcgtggacaagtgcaatcttgggcgggctcgaggacgacacaagtaggaagcaggtcaaaggtcccagcatttccaaggagtacccatcagaaaacatgcgagtactagtatttcgcttattttaggacgtactccattcatctactagtactaaaattcagtcacctgcccatgcatgctcagtgacttaggggg

SEQ ID NO: 3170 - DNA, 6582 bp, Oryza sativa
  unsure (1)..(6582): unsure at all n locations
cccccttacacagtactacagcattgcttatttctattattgtacagtacgagtacgttctaacagatatgggctatttcctcgatcttgtgctcatttacaccgaaaatggttacctacatctagaaatggagagagtagtaaacagaaagtatagatacggccgttcctaccgagaagtactcttcctcgttgctcctgaatactgtagtttaaaagagactagaatatatatggggttgtttggttcactaccacaatttgcctcatcatgccacaactcaagttagccatgtttgaattagtcattcatttggttggtgccatacgtttagcaagattcattcaccatgatgtgggtcccacatatcattggcatataaaagtgtggcaagtttattctcctatgactgaagtgtggctttaattttattggccacatgttagacatattagctaaatgaagtatagcaagttttagtaatgtgagtatgccaaccaatcaaccccatagtcccaacaaacacatgccttgttcggagtactcgcaagtcgtaacagctggagctcggacggaggcagggctcgaggaagctaggtagcatatcagctaagagcttttgtccgtttctgcttgttaccgtcacgacatagcacggttccggatgatcgaggtcaacaaagcaatcaatgatgggccacctattcgttgtcaagacaaatgttagtgccctttgcattggccgtcctcgttcaccgaacgcaatcacagcgtactaatcttgctactaaactattcacatacgagctaccactacattagtacttatccaaaacaattattgaaacagtaagtactactacagtcactactagtacgctagcttcgtgccatcttaaacgtatctttgcgtgcaagctaacttccctcgagtggtacggtgccaccaccattcttatagcgctgcgcggccaaaacaataatcaggtcgcgttgatctaacttaacctatcaacgagaagaaactgaagtcgtcgtcatcatccgaatgaaaaaaaccgctcgtgccgatcgagcagtagtagtactagtagtttaagggaggcggcatgcaggacggggagcacccctcgtgccccgatcagcgccaccgctccatgaatcccgcgctgtcgagagcacctaacacacgcagcataccccaacgacgacgctgtcaatgcgcgcgaggtcatagctagcgtgcgccgaatactactgtggtccgtgggtggtagtgtgactgatgaaaccgtcctggattttacgcaagttatggtcgatactagtactagcaaagcgcgcgctacgtgagcaacctcggcgagacggcgcggtggacagaggggcgggtgggggcaagccggcaaggcgaggtggcagctgcaaccgcaaggcggtttgatggaaacggtttctttggggccgtgcggtgcgggagcggagcggtgtgaggtgttggcacttggtctggggctcggggatgtggcggcgggccggcggcggcgtccagcgtggcgcgaacgtgaccgtgtcgcgtacgtgagcgtgcggtgccgggtgggctgctcggatgctggttggaataggattgcgggatgatggcatgtctgcgggttgcggctgtacgctcgtgcggtgatcatgacatgcgtgcatgtcaatagatctctccagctacttccgtggtctgagttatttcagtctttaatttagctacagcacctagcagtaatattatttaagagagggatgattgtgactacatcacctgccgatcattaagcatttacaccgtgagtcttttttaagagaaaaaatacacttcgattttttagtggaaagtacactgaatctgggtatggcagtatatgtgtgtgtgctttcttttgggatagagtctgaaaacctgtgattaatgcagtcctattaccatctcaggcctcgttgacgtaacagggccgcaaaaggcatttcagccttgtctctttacgggacagtattgggctttgggctcttgtatcgtccctgggccgttcaccgctggcccaaaactaggcggttcggaaccggatcacagctcactggctggggatagacgagacggcgaccacgacgatgacgatgacgacgacgacggcgacggcagcaacggcatccccaccaccacccccatctccggttcctcccctccccgcgtctcaacccaccggaaatccattcaaaagcacccgcgctcccgcaccaatccaccgcacgccatggcgtcgcgagcggcggccgcgatggtgctcgccggtgcccttcctgtgtttcccggccgtcccctggtcgcagccggcgccaggtgctgcgacggcggcattcgcgggagggtctcctgctcctcccaccgtcgctcggaccatccctcctgcgcggctgaggtgagcacgcgctggttgctggtctctcctcatccaaatggcttccaaagctgtagcgttcgcttcagtttaatcgtgtggttgtctggtttggtgcaggagggaggagtggtggagctgctcaagggcgcggtcgcggcgctcgccgtcatcgcccagatttccgtgtcgctcccggcggacgcgatcctctactcgccggacacgaacgtgccgaggacgggggagctggcgctgaggagggccatccccgcgaacccaaacatgaagaccatacaggtaaactgcatcagaatcggcggcgatgcatatcgcttagtacggttggctgggcgttgttcttagattgtgcgagcccatttgccaggaatcgctggaggacatttcgtatttgctgaggataccgcagaggaagccgtatggctccatggaaggagacgtaaaaaaggccatgaaggtaataagttgactctgtgtcttcttcataagcatttttctagcaacaatgttttgcttcttctatgcattgtgaacttcttattgaacttgctgagctgttgtcctgaatgctgatatatagaacaaatgcgctctggatgcagatagcaatggacaacaaggatgcgatcttggcaagtatacctgtagaactcaaggaaaagggctcgaagttatatacctccttgcttgaagagaaggtcagtaggttctaggatgtgctcatggtgaattgcagtttatgaaacagatcaaattctggttttcacttgtacttatttataaattatacctgagctactttggaatcaactgcagggtggtttgcaaactctcttgaaatatataaaggaaaatgatcctgacagactttcggttgcacttgcttcttctcttgatactgttgctgaattggagctgttacaggtaactgtactaaactgaatagaagtttcattatgtttaaaggaggatgattatactccggcgatgatcggattacttaaagggggaaatttctttcaacaggctccaggtttatccttcctcttaccacaacaatatttggaatatccaaggtaacttttgttgatctctccaaagcttaaaatctaaatgtttctttgtctctagaattattgtgagggaagggcagagataggtccgaagattgaaggtgacatttgattatactgagttactgacatgcatggttctatgtcctgcaaacaagtataagctctatgtcagtataagttttaagataaccaggtctctgcccccaagttcttgatggtaataatcaaagctgccgctattagtaggttttcaaaatgaattcaatagaaaacttaccagtttttccattgttgcaaattaattggttttgacaaacttgccattttatcatatttgcaaactcactatttattgctggtgtcacccttcatatatttcatggagtagaaactgtcgaataaaaagtactttctagttaattccaagtgggaacttatttttatttataacatatatcatcacatagtattataaaatcattaaggccagattggtacagggtggcaagaaaacctcacaagcatttttcttttcgaactcttgaggaatggtgaatttttcttgggttctgattggctgatcgcttcagcagcaatgtcggtaaatttgagcgcatgtttttagtttacttagtcgtcctttaggtcccctgtttttcttctgttttgggtctttggggtcggtgaagtatgggcccaggttgttgtccaagttgtccattttaggtgcgcacttttgcgccagagcgagtcgtgtccttgtcgcgcccggcacattctgatcatgtgggatggcacacgacacggtggaacgtgtcatgtgcatgaaggcctcaatggaaactactttgggcctcctgtaatccgtataaacaacagtggagaaaactgagaaaagctacagtgagattgcgcagcgccaaattcattcgcgtctctgttctttgttcttgtgagtgttccttcaatcccagggggatcgctgacaagcaatacactcagtatgtgtagctgattagcagattatgtaaggtggtgtttggatgggagggggactaaaataagtccctcccatcccaaacaggccctaagtgtaatggtgctttgaacattccatccctgtggcacttatattaagcatgcaatcattcctccagtctgtaacgaaatgttcatttgtacatttaatttaaacagctcgcttttaataggctagcaggaagaggagttgttgaattctcagtggagaaaggtgatggttcaacattctttccaactgctggtggtgaaccaaaaagtgttgctacaattcaggtggctttgaatggctgtgtaattgtctggtatcataaactgcagtcttttgacattgagaaataagaaccttatccttggttgttatcttttgtcataccatggtgtgcaagagtatggttctgtatacagttgcagttataaaattccacgtgtcagctattgatttctttactaatttccaggtagtgattgatggatattctgccccactgactgctggaaactttgcgaaattggtaaggtagcttaactccaacctcatctcactattgattatttcctgccaatagctctgccttctgacatatatgataaagatcatcgaaatgattgtgttcatcgacataacatcttcgagaacatcaatttaagatttcatgtttctgcgatgtgctaaaaaaatttcctttactagctcttgattttcttttcagtagttaggttacatcatctgatccaatgaaatgaacttttcttcaggtgttggatggggcatatgatgggataaaactgaaatgtgcaagtcaggcaattattgcagacaacgagaatggaaagaaaggttacactgttccattagaggtcatgcctgctgggcagtttgaaccgttatacagaactccgctaagtattcaggtcagtattccacactgttaggtctgttctgaaggggtatttggatctaaatcatcaatcaaaatccttacgatttagttcaaactggaagtgtatgtaaaaaggatattaaagaaagcccactcatctggactaccctgtaaatgccagtgaaatctgagagttaccgtctttcgtaagtcataacccagttcctttgttacttgatccaatacaggatggagaattgccagtccttccgatgtctgtatatggtgccgttgctatggcccatagtgtggattctgatgaatactcgtcaccaagccaattcttcttctatctgtatgacaagagaaatgtgagtaaatggatatatctttagaactagacatattcgctagcacagtattttaaattcagattgcataagtgcatgtacctcaacagtgcacccgtctacctcttgtgttgtgaaccatatttctgaatgcttctgcttttctagacccatagcgtgccctatgtataagaactaattgcgtaaatattttaatttgtgattattttcctttatcttgtgcagtctggtttaggaggaatatcttttgatgaagggcaattctcagtattcgggtaagtagtgattgccattacagaactgtgaccactagacagcaaacttggtttattttgtggattaacaacagagaactgtgtcgatcaaacatctgcaggtataccacagatggaagagaagttctgtcgcagattaaaactggagatataattcgttctgccaagcttgtacaaggtagagagcgccttgtactgcctccagaagcgccggcagagagctgatacaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3171 - DNA, 1258 bp, Oryza sativa
tagctgatgggttaatatcactcaccctaagacagttattgaacgtgccatccttcagcatgtcagggaggcaagtttgtagtgcagcacatgccctgcatagacgccaccaggcacagtcacagcctctcgatcttaggatggttttggcgtgccaaattcttcatcctcgagacctcgacgtcggtcttaggtattctacagtgcagatttcagcatgaggtaacgaattattgatcctcatcagggagaaaaaagagctaataagcgcggcgtcaataataagttgcgctagtgatggaattaaatcgtaatggtatgttttcaatgcgttgttttgatacactggagcaacggtactccctccgtttcaaagtcaaactatttcaaagtttatagacaaatatagtaatatttataatactaaattagtttcatcaaatcaataattaaatatattttcataataaatttgtcctggcttgaaaatgttactatttttttctacaaatttgtcctgactttgaccaaaaatcaaaacgtcttataacctgaaacaaagggagtatataatttcttagtctacagcactcagcacatggcagcaaaagtgtgttcctcgtctaaatcattgccattcagttgcttcaccagcgtctacagtagattttgacagaatgaactgcactcgagaagaaatcaaccaatatcagcatggtaggatggtctagaaacaccatcttctggctctggcgaagacacaccatgtgcatcagtttggtcatcttgttcgtctttgtttgatggtgatggatcatccccttcaatcaagtatccctcctcatttgtagtctcgtttattgagtagcccctttcagctggatcagcagtgccaagatttgctaaacctgacgctaggcctgaaataggagtatcagcagactcccctctatccatagacagaatctcatcaccagtatcaaacaggccttctctaaccaaagcagaatagatgtcatgaggattggcatctgcgctttgcaagcttgcaaaaagtcctgtctgttcagagttatcttcttgtgctgatcttccactcggtgcttcacttgtccctgtcagcataacttggtcctagaatcatcacaaggcaactttgttagggtcataaattatttaaaactggaaatttggaatgagggaaatatctccttttattggtatcatattccccaaatagcaatatcagcatatactt

SEQ ID NO: 3172 - DNA, 5055 bp, Oryza sativa
catcacatacttaaagaagaaaaagatgatggtatttagataaacatgagatggttagcgacatacagtttttgacagctcacttcccatttccatggtacgcaaacacagaggaatatttcagtttgcagcagaaaactgataacttcagtatcatcaacctgcgtgtattacatgtgaaagaagctttaattccatttgaaggaaaaaaaatctaaaaccagttcaacacgaaaaaaaaaggtagaaaacatcaaagagtacacatgtttgtttcaaagtaattcaacatattacaaggttacaaattctgttttgtgcatttttcctcagaaccctgccagagggctagtttccaataaccaagctctgtgtctacttatatataaaattggtttgcatccaaacttaattcaaatttctacaaccccacataattcccccccaaaaaaaacatggatacttggtagttacagtgctacaggaaccaggcaaaccactaaacagaagtaaatggctggttaccacgaggatcttggaaatcttttgcttacaatttatgcctgctgttctgcctaatacaagaaggatgcattcttataaggcctcatgcctaactactgaataataataacatggctcttcgccaagatggcagaatagaattactgaaatgtgtcaattgtaatatatatcatgttcgtatcactggttaaacgattaactcatgtaactacatagatgaattaccttaacaagtgcaccgatgacacccaggctggtgagtcgcaggtattcaaaaggtcttgtcttgctggtagtattcaagaatgggtacaggtacaggggaatatgagctgaaaagaacaaaagaaaatgagagagggaaatggaatttttcacagaaacaaaaacaagagctaaaaggttctttagtgtgttattttcttatgaagattaagactttacctcgatttttgttagcacgcttttcaaactaataaaccgtgtgtttcgtgcgaaaactttctatatatatgttgctttaaaatatcaaatatatctatctgtcaagtttgtaataattaaaaattaattaatcatgtgctaatagctatcttgttttacgtgctccaactttatcttcatcttcatgagtttcaaacactagtactacacatttaggaattaggatacgtcaaatatagattacaaaagcatgatcatacacgcatatgagagacagacatgcaaaggaccatgaccattaccagttaagaaaaggatcctggtctcagggtgagatgcaacacactgaaattatttttgaaaagcaaaaaagaaagagttaatcagcaaatctatgtcataaatccaacttgggtaactcaaaaggcaatttctactgtaaaatacatcatgaaatgcaagcaaccagaagacaacttttccagcattaccgccctatttcataagattatgtacctgaagaagtgcaagtgcattgcagactcggttcgatgcacctggtgacaatgttgggggtgaaagtgcagagtagattgacacaatttcctgtatgtgttggcaagtatggatacaccaagtgagtaagattgctgaaatttgagtaagtttggattctaagcaacaagtgctaatttgaacagcatacaatatttgacctcaacagcaaactgatgacttgagagtaggattaaaactataaattatttgtgagtttaatcttcaagcatgcaaattgtaaacatatacgaacaggggaatcatgcagacctgaagaagtgcagcaactgttccaaaagaatgccaaagaagtggggccagatcttgaaatatctctcttttctgaaaagaaaggattgaattttttttgaccaaataaactggcttatcatgttaatgactggaacatgaagtctacaattattttgatcaggaaaattacagaactaattaggtacaaaacaaaaatttctaaattagttactacaaagaacatagggttctaaaattttctttagcaaaacattgctgttgacaatgaagccatctgctctggaatatggtaaatctacaatccaggtctgtgtgtatgagcggtaatctgtataaacactttacagcgtaaaacgccttaaagagttaatggaactctcgaaggctacccataataaactgagtctaattcgctattgtgctacccaataataatggtaatctagcgggaagccgggaagtttcaccgaccacaataattagagatgttaatgttatcttgatcaaaacgtagtgtaatagcccatttcatgatagatgcgcatcaaccatacggtaaccctaacaccaaatcaccattcaccaaccctaaaaaaaccattgacattcacaatgctaaggcgaaaccttcccccacaggcagtgtgaattccacaaattaccaccagtgccccagatagggtaggctatagaaccctagaagaacgcgcgctggacctttgagagctcgaggagggcgttctcgcgaagctcggggtcgcagaggtcgagcaccagctgctccgccgacgccatcttcatatccttggctggctgccccaccccgccgcccacgccaccgccgccgatcggagaaggcgatggcggcgaggccccggcgaaggagggcggaatggaaagcgagggctgcagattcgccattatccccacagcaactgcacaacaccaacgaaaccaccatcaccatttcttcccaaaccacaaaattatccaatcaaaaaacacacaaactcgatcaattccacacatgtagcaaaataagggattcgactgctcacaggctatacagcacggagcgaactaggacgaaatggaagggatcacccgaattccgcgacggatcaccactctccgttcctctccggcggcgccgcggccgccgtgggctcccccccggaagaaacccgcgcaaactcgaaataagcgaactcagccgagcgaaaccgagggagagagatccctcttcgccctatgcgcccacgacgccagatcaccgatcccgagtcgacggtcccattgcccgtccgcgacgaccgggcgtatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcacgttgccatgtgatgcgcgtgttgcgatgtgagactcgatttctcagttctcgtgatttgggctggaacgctagcgatggaaagttagtgtgatagtgtcatgaatttgttgaggtcttcttgttagatgtggatttgttgaacggtgggtttgttatatccgcactcgtaattctctcgtgttaaattagcaatagaagttttgggttactggatcgaagttttgctgagatatagttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacctcttttatggttgatgtggagcttatctgctactgaattagatacagatttgtattcttgtttcccatttgttcaatccaaataagtgatgcaagtggttctagctatgttgtgtagagtgttgatgtttttcatccatttctgttgtgcagactgagaaggctttcctgaagcagccaaaggttttcctcaggtagggttcttctgctctttcaatgctttatgtattctgtgagcagttcacatgtcttaacgatgtttttctgcttcattttagctcaaagaagtctggcaagggtaagaagccaggcaagggtggcaaccgcttctggaagagcattggccttggcttcaagacccccagggaagcaattgaaggtacaataggttatttgcctctttgtttagctgattctgtctaaaagttgtatgctgtacagaagaactttggtgttttcactgtagccactgaatgatttgtagtgcgttaactttaaaattgtcactgaaagaacagttgtttgtcatgcattgacagtatttgttaagttgtttttatacactactattgccggtatgtttgactagcaatttaaattcatctgaatattacagacctgagataaatgctactatttgttttaagtattgaacagttgattaactgcaattctttctagggacatacattgacaagaagtgcccattcactggaactgtttctatcagaggcagaatcattgctggaacatgccacagtgccaagatgaacagaactatcattgttcgcaggaactacctccattttgtcaagaaatatcagaggcaagtaaactaccatggattatatacttatgtttcctttccttttctccgttctaacatagggtgcaaacctcccaccttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactgtgagatttggttgctgaagtacaatttctgcattttcaacaggccgctgtcgaaaactgtgaggttcaacgtcctgaagg

SEQ ID NO: 3173 - DNA, 7224 bp, Oryza sativa
  unsure (1)..(7224): unsure at all n locations
cgatttggatattgttcccaacaaaacgaagtcttatcatcagaacgtgttttatggaatctactctatgcaaagttttgttaagatgcctgttaatgctcgatatgctgtgatccttgattttcctgctggctatgtgttgacgcttgtttgttgtgtttcttcgaaagagtattggtggatatgctgtgcctgtgcatgactgagattctgaataaggttttcccaaacccaaacctgacctaattcagtttttttgacaaggcttgaatcttataagtttatcaatggacctgacatcttcctatcgcacctaagctttgggaggatgctaatatctggtacaacgtttacatttcacaatcaaacacaactctgaaatgttcgaatatctgaaatgttagcctggtacaccatttacgtttcacaatcaaacacaactctgaaatgttcacctttgtccttcagagaattagagttcagatcaacgaaaaatgttcagtctcgtataactgctacagtcttgcactccaagacgatgcgatcgaccacaaattaacgagaaatcactgccatttttttttagcatagacgatccatcaaatgagtaatgcttgaagtttaattcgcacgaagtgcaggttggggtgatgattgttagtggtaaagctgcaagaacaccgctctgagcttcttcccggccggagtttgggccttcttgggccgatgtttacggcccatatagagaggggtgtatctgcatcgctagggtttgcctccgcgccgccacctccttcttagcaaagcctcgtctccactcccctgccctcccgcctctccggatcccccgcgcgccgccgccgccgcccgcccgccggtcgatacccctccgcggcagccatggctgagcaggtaaggctcctcccagtcttaccctcgagcttctccgtcgcttgcttagggtcagttctatggtgtccttgttatgtgactcggatcttcttgtcggtgttgctcagtggtattgcgtgatttggcctggaattgtagggagggaaaactggtttggtagccttgcacatcagtatgttggtcattattgtcgattatagatttgatttggggttctagcctagtctcatgagtttgttgaggttttcttgttagatgtgggagtagttgggcggtgggtttgcatagtaccattctcaactctcacttgatatgttgtgacttgtgagccatgttcatggtagcaaatgccaggtgcagttttgtggttagtgtggagcttatctgttagagagttagatataggtttgttatcttgtttcccatttgttcatgcaaacgagtgatgcaggtggttctagcagattttgtgtagtattgatgttttacatccattcctgttgtgcagactgagaaggcattcctgaagcagccaaaggttttcctcaggtagggttctgctgctccttcaatcaattatgtactattctgtgagcaattcacacgtcttgacaatgtttttctgcttgattttagctcaaagaagtctggcaagggtaagaagccaggtaagggtggcaaccgtttctggaagagcattggccttggcttcaagactcccagggaagcaattgaaggtacaatagagtcttgcttctttgtttagttgttaccagaattccaattcattacattttagattcttgcttactatcttttgtgtgctgtagagaagaattatggtttgttttactgttaccactgaagtgatttgtagtgcattatgaacattaaaaattgtttctgaaagaatcgttgcctgtcatcagttaacagtatttcttaaattcttttgatacactgttgctggtatgtttgactagtaatttaaatgcagctgaataatgctatttcttttatgctaattctttcaagtactgagcagttgattaattacaattccttgcagggacatacattgataagaagtgcccattcactggaactgtttctatcagaggcagaatcattgccggaacatgccatagtgctaagatgaacaggactatcattgttcgcaggaactacctccactttgtgaagaaatatcagaggcaagtaaacaattatggattctacttatgtttcttttcctttttctgacttgggttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattatcagttcacccagctagtactatgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcctgttaatgctcgatatgctgtgatccttgattttcctggctggctatgtgttgacgcttgtttgttgtgtttcttcgaaagagtattggtggatatgctgtgcctgtgcatgactgagattctgaataaggttttcccaaacccaaacctgacctaattcagtttttttgacaaggcttgaatcttataagtttatcaatggacctgacatcttcgccgcgaggcgaggggggtgtgggcggtggaatccggtggaatctgggcgaggcgccacccgtgccccctcctctgacccccgccgcgcgctgcctcgttgcgttgctccattccgcccgcgcccccgtgctcgtgccagtgtggtgtgcggtgtgccacccgcccccctttcccaatccctccggtctcccctggaaaaacattttttctcttcccaaccactaacacagcaccggcggccattaacgcgctccgccgcctccgccgatcctcggctccggctcctcctgcagacgcgtccgccgcagcggccacggcggtaagttcctcagttgtccccttctccgcacgaatcctagatcgttctgctgcgtggggttcggaggtatctgctatccgatcgcgtgctcgtgagatttgcctccgcttttgattgggagtaatcccagcgagcccccggcgacggcggcgagcgctcgcgaagctgcgagtggaggatcgaactgtcgaacgtcatttcgtcatcaagcatagcacgcttttttttcccctagtctagtcgccgatgcattatcattcccacccatgcttcatcgcgcatcttgtgcttgtgccatcctcaggctccagtaaagagcaactgcaaatcgtatcgcatcgcgaatcacgcatgacgcgtacattagatttttcagttttcccgtttatgtccgcttcctcgaatttccacccccccccccccccttttttttaccagcaatccacgggaaagcagatgctaaagctggagtatactacttttcttgttttcttccctccttttggttcgtgaggtatgcatccaaatttatgtacgcctcatgcctatgcatttctctgtgagggaccactagggatcatgcgggtcatgtttttaccccaaaagagaaaatctgacttttttttctctgcatacaggatgctatgaatttatcagacctttcttcttgatgtcatgagacagtccgcctttattccacatatttagaattttagatagtagtgccttgtggataaggtgagttcgcttgtgctgttttatttgttcatttctggtgaagtatatgcttgccgaactctctaagctggctcaatgcaaagtaatgaatgatgatactacccacttgattccacagaatggtagcgggagagatagctgttctaagatgagactgcggttgcatctgctgattctttgcttgatcattttatttctggtttataacatggcgagttaccaacataaacagacaaaggtaacactcatctacgaaatgtctccctgtagtttgcttgacagatatgactgaccttattatgggttgttgcagttggaagcaaaatcccgtccatttgatacaattacggtatgtaaaccaatcagctccactagaaggaaaagaactttgtgctatgttaatctggaagcatattttcatttgttgctgggacgctgattttgtcttctatgtaaatatttaggtgtctgacaaagtgtcttctaaggtgtctaaaagatctgccaatagggttggttttttaccccatggtatagtggaaccttactctgacatggagttgaagccattatggctcacaagaagtgcgcaatcaaaggtaatttgaaaaccaagcctattcttgtatacagtgtgttgctcagtacaatatatttgttggttctatttcagttttcatacataaagcaggctttagttgctccacctttctgagtacgaggcctgaatatctagttatctgacgctctgcgaattttggctccacaggattctagccagaaggatcggtgcttgcttgccatccctgctggtatagatcagaaaagaagtgtggatgctattatgaagaaggtacttaatttgctacctcaggaagtgatagtttcctcatgatggtaactcttgaatgttcagtttcttccagagaattttacagttatgttgttccactacgatggtaatgttgatgggtggaacgatctaccttggagcaaaagtgtgatacatatagctgcttctaaccagacaaaatggtatggcatctttctgcccttcctctgtgagaagagcctgactttgagtgctcttgctgttgaatatactttgcttcaccttgcgatttctactgatctggtgtcgtcttaattcaagataagataatgaggcatctattttttaggtggtttgcaaaaagattcctccatccttctgttgtctccatgtacgagtatatatttctttgggatgaagatctggaagtagataactttcacccaaggaggtatggtatttcataaatacttgatgttgattttgagcctcacattgcctagctgttgtataaatgatgttgaggttagacatactgaagtgctgaatcattcctagtacaatgtactgaatcccgtaatcctggttcaagaaactttgtataaaattatcagtgcatcttttaaatgtaagaatcaactactgactgactggtatgtgttaggctgcaaaagttaatcttggcaataatgtgatcttatgctaattttcttctcgagtattttagtttatgctatgcaacaattgtgctaacgcatgaatttcatgcaggtacttgaatatagttaaatcagaagggctagagatatctcaaccaggtcttgatcctaaattgtctgaaattcatcatcggataactgttcgtaaaaaggggtggagtttccacaggtaactttttcatgtgctgcaactttttttattattgatttgttgactaaatcaaacaacatatgcactttgatagaaaagttaatcggggaaacaaagattgtgcaaaagagggaccgccttgttctgggtatgtcttctttcttgagttatttctcattatatgacagctacttcgctgggtaactgtttgcattggttactgtttggtctagtgcagttcaatagtattgtcttactgcacagtaaacacagtaactacatttctgttacctagcatttagcaacaaacctagatcatatttctgcttggtgtaacgattatatcatctatagatgggttgagggcatggcaccagttttctcgagatctgcttggcgatgtgcttggcatcttatccaggtaatggttgtatctttcaatagcaatgagattctgaccatgtctcatatttgaatgtataattgaacctggctataaaactgtccttctgagtgcttaattcggccaggggtattacaagatggaatagacctcagagacccattcaatgttaaaattttgagccagtgacccatcctatgaacatcaagccatattgggcaaagtgatcaggactgttttttagtatacaaaaaggaccgttcagggcctgaatggcatccttttatccccttttggcagaatagttctgctcaaacatgtaaatatcaaatcttggatgataggggaaggagggagggagggaggaaaaagttgccaaaaaaaaaactgcggaaagagctgttataggcttatagcaacttgttttattggatccgtttattctaaaaaaagttaagtctccgtttttccacattactcacaaaatgctttgaatcatatttatttatgtggttctagttctcttagctttacatagtccccggattgctaatgctgcagttgtgaggaaaagggaccaatccattataagttcatagtttattgtagataaaatgacttgttgccataaggaattaatatatgatcaacctggtttttttttttggcaaaaaacacccccgtcaatttacctggttaccacaatctgaaacttacattttgtctttaacctaaatgacttttgtggactatattgcagccactaatatatatatgtttcattttttgcagaatgatcttatccacggatggggcattgattacaaatttgggtactgtgctcaggtttgatgttgcttttaaatagatgtggaattctttatagttaaactaggtgaaaccccgtgtgttactgcacgagtttagtatgataataagtagaaataatgtgtaagatagctagaccacataagcttatataagttaatgtgatttatgataatttaaatggtaatgatgatccaaatgtaaaagtaaggtgatatggctttatgagaggaaaaaggagggatataatttggaccatagaannnnnnnnnnnnnnnnnnnnnnnnnnnnnnnnnnnnnnnnnnnnnnnnnnnnnnnnnnnnnnn

SEQ ID NO: 3174 - DNA, 1020 bp, Oryza sativa
tataatttggaccatagaataatcatataagagctagaaacaattaaggtgatatggcttatgagcgaagagagaaataacattagctaagtgagggtgaggatgaactgtgtagatatataggatattgtaaaaaatgatggagatatatattgaaatattatgtgaattatgtgggatgatgatttaaatgtttgcattttagagctctagaatttaacaaattatatagataatataacatgcttgcatgaggtttaagatgtaataattgttagtggatgataatgtggcatctttgcatgttgagctttaggatgtaactttataaaaaggtaggatttctttggctacacgtgggcattggcaatgcagggttgtagttcatgtctcgaaatttcttttgtgaagttttattagaggaatagtcatatattttccttaattcttcatttccttaagtgatgtttcactgtaataatacttttaccttaaccttaccaccaaccatacttcctttttcatcatttttagggtgacagaacaaagaacattggagtagttgatagtgaatacatagttcatcgaggggtacagacattgggaggtccttcagtaaaggtttgtacagatctattatttttgtactgcacgacaatctctatcagaccatatattaatgcctttgggcacatataagaagataacacatcaactttttcgatgcactcattcactttcttgagttttaattgactgatattcctatccatatagctatagcttttatttttaaaaaaagaatttggggagttgaagtccttgttattgatattttactagctaagtcatagtgacatgaatacacagccacacaggactaataactgaaatgctgcatgtgatgattgactaatagttaccattgggtggaaagtgtactaagtgtgacaatagaaacatacttgtatataatttagggatgatgccattcttaattcttatatacactacattgca

SEQ ID NO: 3175 - DNA, 1467 bp, Oryza sativa
  unsure (1)..(1467): unsure at all n locations
nnnnnnnnnnnnnnnnnnnnnnnnnnnnnntgtttctgcagaagaactgaaacagacacctgctcgtgtctttagcttacaaaagcttgtcgagataagctactataatatggctcggatacgtttggtatgtcctgtctcttattgtttgtttggtattcctgttacattggagttcgattcaccacatctttgcagaagtgcaaaactagttggtcaaatgtgtttccatgttcttaaagaaaacctagagtagtatacctgtacttctggagccattttgatttgtgtaactgaacaccagcctgtcatctgtttgaagtgcaagtgcaatgcacatcaacatcaggatctttttataactgggaggcatcccaatattaaattttagctgtgatatacaatgtcttgaactcatgactaaatattttgttttttcatctgagctagtaacttacatttatgcatgtgcatgtaggtgtgggcgagaatatggtctgtcttgtcacagcattttattgccgctgggagccaccacgaggagaaagttgccatgtatgcaattgactcattgaggcagcttggtatgaagtacttggaacgtgcagaattgaacaaattcacatttcagaatgacatattgaagccttttgttattttaatgagaaatagtcacagtgaaaaaatccgtggtctaattgttgattgcattgttcaagtaggccttcataagtcttatcaaacaattgaaatctgatgatctggtgcttttatataaaatgatgttgtaatgaaaaatcttgccatatgaacatgcagttgatcaaatcaaaagttggcagcataaagtcaggttggcgttgtgtgttcatgatattcaccgcggcagctgatgatgagaatgaacatattgttgaaagtgcttttgaaaatgtagaacaaggtaagtttaaaggaatataattgctagcattagaagtgtttcttactttctccaaaaatgttagattccattatcatcattgttttttgattaaatggatgtgtttggcagttatcttggagcattttgatcaagttgttggtgattgcttcatggactgcgtcaactgtcttattggtttcgcaaataataaatgcacacctcgaattagtttaaaggctatcgctctcctacgcatatgtgaagaccgtttggcagaggttaggatggtgaccacccttatattcacatctggacacttgatctttttggcctgatctttttggcctcattcttttcatttgcagggttgcattcctggtggtgctgttaaacctgttgatgatgttccagaggcccattttgatgttactgagcattattggtttcctatgctagctggcctatcagatttaactttagaccccagaccagaagttagacactgtgcacttgaagtgttgtttgatcttctgaatgagaga

SEQ ID NO: 3176 - DNA, 8901 bp, Oryza sativa
aactgctatctatttggagattcttcagaaatcaactgtggaacatgatgggaatgacccaagtgaggatacaaatgggcacgtcatagaatctgatgaacatgaaaagctcaagagcctcgcagaagggaagcttgtttcgttttgtgggcagatcttgaagatgcttctgatctccagccaagcactggggaagctgcaagtgcagacatacaccgtgtactggacctaagagcaccagttattgtcaaggtatagtgcatatggttctaaacttctaatagtagtgtatagggccttttgcgaaatctcatccttgcgtataatgttatattcccacattctcaactgttttaatttcaggttttgaatggaatgtgtatcatggacgctcagatattcaagaagcacatcagagagttctatccattaattacaaaacttatctgctgtgatcaggtatatgtttttccatcatagatgtatgttttcacattaaaggcgttagtagtagtggagtactaatattgtggttatgccgcagatggatgttcgtggtgcccttggtgaccttttcagcaaacaacttaccccactcatgccctgagttgtgattgtacctccttccgttgcatatatcttctcttgttggagtatattcagtattagcatttttgtgcaaacatggagcgtcagaaagaagcttaacgcccttaaaggcacacatctgagctcggtaggctgtaaattgacaagcttaaggtttttgcaggtgttctaagtacgcaagaaaattagctttgcatgttgcgcatgaaatttttccttgccactttcgttctatgtattattatttatctatgcggggactggaactatgcttctatacacaagtagaggattgaggcgagggaatagcattggctagtgctatgtatacattgttcaggatattgtactcgaggcgtgttgttatacggcaatactagattactcttggtagagcatctaggttggtgcattcaataaaagttgtgtcatcattgttgtcatatctgtttctgcgattgttgcagaattcctttgctcgtttgttcacagctccctccgtcccaaaataagtgtggccatggttttccacgtctaactttgatcattcgtcttatttaattttttttaaaaaaaattaaaaacataagtcatgagtaaagtattattcatgttttatcatcttataaaaacaaaaatgctaattataaaaaaatttcaaataagacggatgatcaaagttagacgtggaaactcatggctgcatttattttgggacggaggtagtagattacatgtaatattttctgaactactacctctatcctaaaatataataatttttagctatgaatctagacatacaattgtcaatattcatagctatacaattgtcaatattcatagctaaaaatatttatattttgggacggaaggagtagttgatatcattgtgccctgctggtgctgggtgtgaagttactagaattctgagtattgctaagtggtagctgaaaaaagtgatgtgcccctttgtgtgatactgggcgttgtaccttgtcaagtcactagttagttgccactgattaaagctgcattattgcttattcgtacaggtctcagttggcttgtgaacaggaatcatccacaactagtgcattggtgcttgtttagtcatcatgcgttagtgcattgcataactagaaaatagacaaacagaacaccagagaccgacagaggtcgattatagatgtgcccccgttcatctgaagttaactccgactgatctcatacttgccagcttaattctaactggtactagtagtaacaccatgacaaataaacagaagctaacccaactaatctcatgcttgctagcttaattctaactggtactggtagtaacaccatgacaaataaacaaagatagtaataatgagtaatctgggaaagctcaagcgtatgacggccaatagaagcgtttgaaagcgaaattggtggagtgcggtggagatggcgaccttcaccagtaagcgaactctgttttgctaagcacatttcaagcatgtgaagagaaagcagaatccatttcccacgagtcatgaactcacatgactcacgaaacggtggtctaggacgatagttttctgcctcatgccaagcacttggtgtcttggttgctggatgaacgaacttgggtagttgggttagctggaaattgtgaaaagagtatttcttgatgtaacttatgtactccctccatactcgtttaggacaatgtttaagtcaaatattgataatataaatcatgaataactctcaagttgttgagtttgaaaatgtaaaaattatatgaatagatttgtcttgaaaaatactttcataaaagtatacatatatcacttttcaataaatatttttatagaaaaaagaagtcaaagttgtgttttggagaccgtgtcgctgtccaaaacgacttcctttatgagtacggaaggagtatggattagccctctttttactgagatcgtaaataaaaaaacgtttagtccttacaagatctgagaccgtttggggagagctgtagatttttagaccgaaatttagtagaactatgttttaccctaatttgagataagaacgtttgagacgagagcaaacatgagccaaaaagtgtgaagtgatcgtagcccaattggttaggatccctatggtggaaccagactattcgagtttaaatccagacttgtgtacttgtatgtatggttaattattcttttactagtagacgtgtttacaaataattattctttcagtagtagacatagacccatggtgacttcgttaatcttaagatatgttaacctaatatttcggagatgttcttaaggatatggtaaggccccgtttagttcgcgaaatgaaaatttttgggtgttacatcggacgtttgatcggatgtcggaaggggttttcggacacgaatgaaaaaaaactaattttataactcacatggaaaccgcgagacgaatcttttgagcctaattaatccgtcattagcacatgtgggttactgtagcacttatagctaatcatggactaattaggcacaaaagattcgtctcgcaatttcccccctaactgtgcaattaggttttatatttatctatatttaatgcttcatgtatgtgttcaaagattcgatgtgatgtttttagaaaaaactttctggaaattaaacagggcctaagtacgtatgtgttgtaagcgtctacatttgtaacgtgtttttttttttaaaaaaaagagacaaaagtgtagggcactgcgagcctgtgataattcacacggtttgggctcttttggctgttccatggcgacgaggcgccagtttcaaaactgcccacataatgtgagtggacccaatatttccataaaccgtgggaccaataagattgggagcaagaaaataataaaaaacacagagagggttggccccgcgagcggttacaagctgcagaagtgcagaggccattccgttccgcgtgtgtgcgcgtccacccgcctccccctccccttcttcaccgagagtcgtcgcggtcactcgtccgtatctgcctcggtgggggcggcggtgcgtgcgtgcgtgcgcggccgctgtatttggcaggactcctcgtctcgtcgtctccctctcccccgagaaaaccccaccccactactcctctccaccgccatcattgtcggcgcgagcgagagcccaagcccaagccgacccccgagggaaggggaagacggggccgagatggcggggcgctacgacagcaaccccttcgaggaggacgacgtgaaccctttctcggtgaggaacccatcctctccctccctccctttctccacgttcccgccgggcgcagcggatctggtttcgtgtttccttgcccttctcctccgtgcgcgttctgaggagtggcgtgtgtgttcttcgttcgtggttggatctggttggcggccgcagatctaaccgtgtgccgtgggtgaatcggtggccgtttttattgttttttttttctcgcattgtagtatcaccgacgctaaatttagggggatttttttttatttggggggtgttgcgatgattgcattggtgcctaaaccctcgtttgtgcgggcacggatgaatttgttttcgtttgtttctctgtaggaacaagcgcgtggtaaggctggagggcagcccagctatggcggcggcgcgttctacatgccggtaagctgttcggtgttctgttcttctcagttggaccattttgtcggtgcctcggtgggggttgaatacttgaattcgcaattattggtttgttacctaccaactgtttaatctgtactgcaatgcagaatccacggaatgtgccttctgtgtcgtcgaattcgcggctttcgcctcttccccctgagcccgcagcttttggggctacggtggatatccctcttgactcttccaaggtttgtatgaatgtgtagtttatccgtctcagttgaactgcagctagactgcagtacagtagaggatctttcatggaatagtacctaatgtcgctttttactaatgtgtgatgtatggatactcaggacctgaagaatagggaaaaggagctgcaagctagggaagcggaattgaacaagagggagaaggtacaccatgaacatatgcagttgtatcacccattagttgtgtccattacgataggtcaacaaaagagtttgttgtaatctgatgcttcttggtcttaattttttgtgcgaaacacagcagacatcagtccttagcctgaagtattcagaatcataaattcgtaatgcagtgttcttttcctctctaaaaatcagcttactacctgcacaaggaattctatgctttacttagacataattagtttgatccatgatggtttgttagtttgtgattgttacatttatacattattatcttcatttgttgaccaggagctaaaaaggagggaggaggctgcagcgcgaggtaaaagctcattttctttactcactaattcatagaaacaatgttgctttgtaatattctctgttgactcatgtgatcataaggattccttatattagaactatgccatttaagatattacatagtacaaactatgaggtaatgtggcaatgatatgtgactcttaatctgttacatgtgaattgcgattgtgtgaaatgcaactgcaatgttgtattggtaacgtcattagcgagagtttctcaaaccaagtatttttttagacgaaaggtccaaaggacccagcttttactgaaagccaaagtggcagcgctgggggaaaccagcttacagtgtagcacaggttagaaaggccacaccccggcctggataagtgacagataaaagggaatctcaaaacaagtgtatcttactatttttttcaaaaatgttatccgtataccgtgtagctttcatgatagagctgtagatccttgtagttcattttagaataacaaggtgttcagactaatataacttatgcattaaacatttctcacgggctattaaacttatgccactttattggtataacacttttgcagctggtattgtcattgaggagaaaaactggcctccatttctgccactcatccatcatgatatcaccaatgagataccgagtcaccttcaaagaatgcaatatgttgcatttgcatcatttcttggtatgcttctgattgtcagattcccaaaatcttgatgctcttgcacttcggtaacgttttaactgcataatggacaagcattttagtcttctacaaagtttgcattttcacccttctttcagaaattctgcaccttcaactgtaaaactggaaaggcaaattttccagtctcctacgatcttagtcacatgttttatcattagaatttcgttagtgagattttgtgactgtctgcattgcaagtcaagttaataagaattctaaaacaatagggatgagcttttgagattttcttaattatattcaagttctgccatttatttttctagttagaaataaaaggctgtcttatgaattatttcaacattccattctgttatatgcaaaattaagacaactttttttggtgtcgagtaggattggcttgctgtctcttctggaacgtcatagcagttacttcagcttgggtcaagggggaaggtatactcatgacacttctggcgttgcttgtacatattgaccagttctttaaggctgtaatcctttaataatgctatgtccattttcaggcgtgaagatatggttgctggcaatcatctacttcatctctggggttcctggtgcatatgttttatggtatcgacctctgtataatgctatgaggtattgtttctgcgaacttctccgtgcttttcttgtgtatatgagtaagtaacatttattggacacttgttttgtaggactgatagtgccttgaagtttggattgttcttcttggtttacctggtaagtgaggagtccttgttatatgttagtaagatattcggtgattttgaatgtgtgggaacataattcttgaatttcctgtctttgcagttccatattcttttctgtgtatttctgctgggctcctcctgttgtcttcgaggggaaatcattggcgtaagttccctgcttgttcatattctgtcaatgggaatatggaaactgaaactaaaagggtgacctacttgcatgttgtacaaatggctttttttatcagtgaagtggtctgcttgtctatgcaagttttgatgcacctgctttccagcaatataatattgacgcataagaacattgtactatttgatttaacttccctggatgttggagtttccttagttgagcttaagttatgattcatgaagtggtagtatattcatcttttcaatagaaacaacaaaaaataggcacttcaatatgtgggatctgaagctcctctgtttaacacatacataaatactaaaaaaaatatgattggatggatttcttcttagctagtgtagcgaggagggtgggcctaaggattctctagtgtctgtgagagttgaacttgcatgaactaatgcttattttatactcccgcagggggattttaccagcaattgatctcatcagcaagaatgctttggtgggggtaagtgtgcatcgcattattgttagatgctaagtaactatggttagatatgcagtttttgattcatgaagataatcaacttacctttcagatgcctaccgaaaaaactctttctgatcttgtcggtcaagtaattggtgtaatttttctttgcagatcttctactttgttggatttggattgttctgcgtcgaatcattgctcagcatctgggttatccaggtcagtcctgcgaataacaaatactcctccgtttcatattataagactttctagcattgcccatattcatatagatgttaataaatctagacatatgtgtctagaaagtcttataatataaaacggagaaagtatgtttttatgaaataaattctcaagtagtctatctgagccgttttgacatttgtgaatgcagcaagtgtacatgtacttccgaggaagtggaaaagctgctgagatgaagcgtgatgcaactaggggtgctatgcgggcagctttttaattatcagaaaagattattggtccgactcatatctctgatggaatggatagattgtggtataaacgaacatatatgttttccctgtttgctgactacaatttcaaattgttagtaggttacagtgacgttgtatgacctgtcctcttgattcatcaatatagagaatgtgcagttgttacttgttacaggctttacagctggtgttactagcgtagaacattttcgttttcgtctgggctaaaaaagtataaatcgacaccaatgaatgattcagcccatgaaagaattctctttgttatatgtacaggaaacaaatcagataggcaatcaaatgctatttgttggtgactcgtccatggggaataagtttacttgttgtctcttaactctacatcaaagtttaattgataatacatccgtccaaaaataagtagctgtgggtttacgtatttgaaaaaaaaatatggaaaaaaaatagtcacacataaagtactattcatgttttatcatctaataataacaaaaatactaaccataaaaaaatttcaaataagacggatggatgaacgttcgacataaacagtgtaaaactacacttatttattttgggacggagatagtacctcttatcctaataccaaaaatcttcacacctaaattgtaaaaaaccgtgcaacaagagtcccatcatcccatggtagtattagcacttggtttagctaacatagtaaaaaaaagaaaataaaaaaaatatggtggggcccatcgcccactctctttttctcttttcattttcccacgccgaaccacgccctatgcacgtgttgccagccgcactgcaccatgtcactggggtgaccctcgtacacacgtctcccgccgcggttgaagacgcagccaaccccacctacgtcttcgcggcagaggtagcggtcgtcatcgacgtcatgcttgccatcatcagatcaagaaacttgcctctgattcttattctcctcacaataccagatcgacggcgccgccgccccaagaaccgtggaccaatccaagaaacaaaagcagagaggagaggagaaaatctcagaagagttttctctctcccatcccgcgcaagctgcgagcttgtgtaagttgtgtggattgg

SEQ ID NO: 3177 - DNA, 27740 bp, Oryza sativa
cccgttccggcccaaatggtgggtgagttcatccgtatcaagtcccagcccaagttggcctcccctatctcttgttcgatatggtggttgcaaggctgcacgatcgccgcgggatcactcgtcggtagctgaaactgagattgcgcacaatgttgttgccgataggttggccggcataattcctaattctctaccgcatgcctgcgaccacattggaacacgactaagcctgccagtgggctgagatccaatttgaatccaccccagcccacctcctcatggaatggcatgccaaaccaacccaccccatttcctctcctccaaaatccaaaccaacccaccccgcatcagatttcaatccaacccaccccaaaccattacactaaaatgggttcagcccacttcactggaatggattcaatccatgatcccagctacactacagagagcttggagccaggaggcctcgttacttctttagccatggatctcagctacagtatagagagcagcagtgtagacacacgtgcaaacaattaattcaaaacagaaatattaaaagaacatcattgcttgctgaaacactgaaaattgggcaaaaaaaatactcagaatgatacgcatcgcattgtttgttagctgatccagcactgaaatgaataccagaagactaatgatgtcatataattacaattaagtcaattgctcactactacagcaataataagggccataataaggtttatatcttcaacaaaaactaccaaaacatcatctatgccttgatccatatgcagttgtagataatctggaagagaaagaagccatcagaaatttatatttcagaaataacattgaaagattacaagttgaatattattatttctataagatatgactagcatgagttagtggacacactagtaagaatgaagaatgaatccatccatccccactattcaactaaatatctatactactatatacaaccacaaggactttcaagaaatggaaaaaaaaaagagaggaagaaaacaaggttgagagccccaaaattctgcagccagaatcaacatagtaggatacaacatatcatatcaaacaattttgcaagagaaagaaaagatttttctctatttctaccaagtactctactaactcttcctgaaaaaaaagtactctactaactgctgacctaattagctcatggaagctcaaatcatggactagagaacaccctgaagccctgaactaatctgaacccttttgagtacaaaacaaaacatttggcctgagcagcctcatcaagaggagaaattgagcggattgatctgagctgagcacatcaaacagaaagaaaagattcagagacagagagttagagctgaagatgttacctggcagaggatgacagagtcctggttggggccttttttgcccctctgggagaagagagaggccaccttccttgcttatccttcacatacacaatgctctcatctatctcctgaacatgctctagctgctcaaataagaatatatacaagtaaggatacaactaatagatataaaaggcattgcaaggtgttacaaattccgcctaacatttcaccaactgatgaacaaaaaacaacattaagttactgagcacagggaccccaccattgtaaaaaaaaaacagccatcataccaaaccttcttcacaaaacatcatatggtcagtactcagtacgaacctagatcaaagaaaatttggcacaaatattagtaatactggtgggcactcagacaaattaatctagattttgtgactaatcaaacaatataaaatgaaaacacatctacaattactatttatatggcacagaccacaaagtctgagacgaaatacaaggcgtgagatattatacctttaatccccttgttttttggctctatgtagccaatcttttgcacaaacaagtgcctcgagcatctctggtgtcaatgagcttcttgtgtctccaagaatccttcctccactgctgaaagcggactctgagggcacggtgctaagtggaattgcaagaaagtctcgagccataattgccaacacaggaaactttttggaatttttcttccaccatgccaaaacatcaaaatcctcactatcatcctcacatacttcttctaaatatgtatcaatctctgacttctgagtacgtgcaaccttccggtttgacttgaagagggtgaattcatgctctagctttctttttcccaaaacaggtgagcctacaacactaactctctcactagactgtgacatgtaggatacaccccttcttcttgcaattccttcatatacatgaaagtatgatttcatctcctctataatagagtccactttactttcaacattagaaccatggggagacaccttctcataaaagaaatccaaatagtctcttttccttcttggatctaacacagtggtaatgacaagtgccaaattgaagttgtttgccaatttttcatcccaatattttgcaaacttggtgtgcataggagcagccaatcgttttaaaagatcgctggtttgccaatcaggatcactcaaagcaactcatccttgagagttttcactaattcttgacaagcagcggtgttgttactagcattgtctaaagttaaggtgaacagtttgctactcaagccccactcagtcaaacacctcatcatggcttcttcaattgcaaagctagtgtgtggatacttcacaggcttcaaacttataattttctttttcattttgaattcagcatcaacatagtgggctgtgacaaccatgtatcctaggttttgatttgaggtccacatgtccgatgttaggcatacacgcgaatcaagattctctaattcagcatgcaattcttgtttcagcctattgtaatagttgtaaatcttgtcgcggattgattgacgacccacaagtttaaaagttggctgcatggatgccatccaatcatccaagtagggatcctcaattttatggaatggtatctcagcatggatgaaatattttatcatcaactcttcagtctttttaggatcaaacacaaaattttccacgggttgtttcctaactgttgatataaacctatttctaacttcaccatcaactagtggacaagattcgcaaatatggtttatgagatggctagttcctgattttctagtcgctgacaacattaagccacaatatttgcattgtgcttttggaagaccatctatcatgacaagctcctgctcaaaatgttcccacacttttgctctcttacgtgtttgtgaaggcagctcatgactagaactattggcagatgaactttcagaattttgcatagacatgtttaataaacctgtgtttgacaagaatagaaaattaatatctacatttgctacttgtgcagaattaatatttacatttactacttgtgctaaaaactagtgaaatgataagcatacccaacagcaacctgttatacagtgaaagacagccacctaaatcaacagattagtagttatatgggactgaatgaactgacattcaaaatgttttatcctttgaccaacagcttaaaagtttaagtgctggattttctagatgcgctcaacagtcaccattaagcagcaaaaaagctgcatgcttaataaacatgacttagaggttgggacttgggaaagggtgcaattgcactgatatattataaacaaccatctgacagaattaattgcgaataacagaacattgctagcaatcaatttgtgtaattccaatttgttcaaatctccaacatcttttttttttctttttcagtagcattgcagtataccagagatctagatgacttctcaaggttagatgagacattggtactgctaatttggcaatagcttcataagtctttacctttcaagagttaagacctaattattgtgactaatcctgatgtctgatggcacacatactacaatccagcagagtatgtatcacatgagacaactaagatgggacaccagctgcggcattaaacccaacagaaacccaccactcttcagcatctccaatcgaaccaacccacattatctaaaaatcgaaacaaagaaaaagcacaaaaatagccaaggtaccataccaggatgctcccaggaaccacttccaagaacagtccccccagctcaccgagatccaagatggaggtcacgcaaccgcagatctgccacctccctgcccacagcaagaacatatatcagcggagctcgaccaagcagagagagaacgccacttcaagaaacatgaaagatgagtcaccttcttgagtgagtccggcgactgtggcggcgaacggcggtgacggcgctcggcggtggcagcgaacggcggtgacggcacgcggcggtgacggcgcgcggttgtggcggcggcggcggcagtgcgcggcggcgcactgcgcacaggcgcgtgcggggagtgtagggtttggagtggagtggggatagttcggtttgttttggaggctaacccatgggctgaatccatggatagtcttcacaggccaacccgcatccactccagcccaaaccgcaattcttcacaggccaacccgctccaatccaaaattaatatcagcccatttgaatccaaccaccaccatccaaatcaacatccaatccatttcgcccaataaaatctagcccactggcaggcttaaacacgacattgcacatacggattaatattccgggttgggggttggacagtgggaaaaaagtcaagatgtcagactgtattggttgtgggctaacacctccctagtctagagctcttggctcgatccaaacttttttaaaaaaagttgaatgctcgaaactctgtttggatcaaccggcttgagtcgaagtgtgtcctagaactgttcagagatgaagtgtgcccctagattgttcggagatggccacacgtcctgtatgttatcacatacatgggaccaaagccaccacccaagaaccaggtcatggcaggttggggacaaagactatggacgcccgaggactgcaaagtgtgccttgatccaaacagatcgacccaaatagatcaaggggaatctcttcctgtgacgcaccacatagttatgctcgagaagttcttattatcttaccctgtagaaagggttatatcacggccattaacatttcgagtcgtgtagacgatgattatatgttgatacttggtggaggagtgagtgcagtggactggtgaagcatccaatattttccatggacgcttactattcaaccgtataaaacaattaataaatcatcacttacatagatgaaatttaattaagaaaacaagtagtaaaaaaaaaagaatcttccaatccctctcttccagaacgtgtggattattcagagaactgaacacacgttccagccaaatcccgacaaaaaaattcagccgatcctggtgttgtccctgccgaacacgagcgtggtggcccagttgaccgccacgtagaacctgttcctccagctcaccaccctcgtcaggtacgccgaccgccacatgagccagctgacgaacccggccatggacacccccctggcgtccttgttctccctcaggtccaccagcgccttgtacctccccaccgacgccatgctcccgatgtgcttgtacacgaacggctccccgagctccgcgctccccaccgcgcgccccgccctgccgccatcctgcgccgcgatcctcgacatcacccgcgccaggtacctcccctcccgctccgccacctgcgccagcgccggcagcacggcccgccccgtcccttccaggaacccggcgcagtcgcccagcgcgaacacgtcctccaccgacggcacgcggagccactcgtcgacgccgatcctcccgccgggggacttggggagcggcagcgatctcacgaactccgacggccccacgcccgtcgaccacaccaggacgccgtacggcacgcggctcccgtcgctcagctcgatctccctcggcttcacctccttcaccacgccgcgcaccaggttcacgccgtactgcaacgatttagtgttaaaaccaaaaaaaaaaaaagttagtcgatatagcggaacgaagaacgactaatctttcctatcgtctcggtcatgtagtaccttggagaggtggtccgtggcgtactggcgcagcccgacgtcgaaggaggagaggatctcgttggcctcgatgagggtgaccttgacgtagtccttgacgtgagcgtacctctcccgcacgtcgcgggtgatgaagtcgctgagctcgccgctgaactccaccccggtcggacccccgccgacgacgacgcagtgcaggaggcgcttcttctcttcctccgacaagcctacacaccatcattcaccaaaacgatcaagaactgatcgagcaaccatcgccatggacgccatggacgaggtgcaaatgcaaggtgtggttgaaagcgtacctggattctcggagagcatgaggttggtgagcagcttgcggcggatctcctgcgcgtggctgacctcgcggaggaagatggcgttctcggcgacgcccttgatgccgaaggtgagcggctcggagccgctggcgatcaccagcttgtcgtacgacaccttgaagttgtacgggttggcggggagcccgtcgccgtccgccgccgtgcagtgcacctcgtgccgccccgtgtcgatgccggtgcaggaggcgaggaaaaagtaggagcccgggcgggtggcgagcgccgactggatgcggctgacgggctccacgacggaccggaactccagcgtgccgacgcacgtcgacgccagcagcggcgtgaacaccatgtggttccgcggcgagatgcacaccacgtcgtaggcgcgcgtgtccacgtccttgaggaacctgcacgccgcccaccccgtcccgagcaccaccacgcgcggcttctcccccggccgcgtgggcccgaggtccggcaccgccgccgccgccgccgcctcgtcggcggcgtccgagcactccaccaccctcgccgccgcctccgccgcggggcgcagcgcaggtgacgtcgtgctgatccccctgctcggctggagccgcccggcagcgccggccgcgtacttgtcagcaagccccgccaacgcgaggctgtggaacgacgacgacgccgacgccgacgaggcgcgctggcccagcgccgccgcattgcgcagcgcgtacgccgccggggtggcggccgcgttgccctcggcgagaatcctcgagagcggctgcgtgagctgcgagcccctcgcaatcctcgaccacgccatctgcttcgcttcgccccacacaagaactcgaaaaaaaaacaactacagaattaccacgagaacctgcagatcaattcaaagagttgtcaatttgaatctcacaaaactgatctgatggcaacaacagcacgaggaatatatatacacacacaaagaaagcgacccaaaaaaaaacatgatacacgaacgaaacgagacttggcttcgcatttttcttccttggaaaatggagcccagtgagaaaagagaagtactagaagcacatcggtgttgaccaatctccctcccccaagaattttggagcaaacgaactctccaaatttatcacgccatacataataaagtgtacaacaacgtttcttctccaagaaaactggctgagagatgggaatcggaaccttctctcgggccggcgtgtgctgcacaagatcgcgacccagcgaaacggccagacttcaacagtacggcacacacacactactccacggtttggtagttttgatgattcgttgaatccaccatggattcctccggggatattccgagtggactcgtcatcgtcgtacgtaggaaacaagattgcgggaagcgaacggcgtggaaagaaaataaaacctgaggatattcgatcgctcgtcgtctcgcccgcccgccgcaggggcttcgtgcgtcatccccattcgccctcgaatcgcattgaagagaaaccccagctttctttttttgtgtgcgtgcgtaatccacccagactcgaggaaaagaaggggaaaaaatgacaagaaattaccggcagtgtccaagatttcaccacgagcgcgacggcagctgcaccatcacggcccgtcgctttcaccggaggagaccaaaagcagcagcagcaatacgaggaagaagaagagaagcctttctctctctttttcttgattaaaatttatttaaccgaaaagatctgtttctttctttttataagcgcgagccttccccgtgcttgccggaagatctcacggccgcggcttgtgctgcaagaagaagaaaacgcacgtcccacggcacgggctggatgggccccgctttaatttctttcttcctgggtaggattcatttcgtctacctgtaggactttcaaacaccaccttaagtatgagacgctgtttgatcggacggtggagattcgtttgcttcgctccctccgtctcaagaaaaaaaaatcaaccctgactaccatatatccaggaaggggatgacctctgctaggttaagtttttttaggttgagttttttttttttgattgaatggctcttgaacttgcttggatctggagggggtaattatttcattcaagtctggacactcgtggctccatcgtggtacgtggaataagaaaaacgggcaaacgaaaaataatttatgaataaaacttatatatacgtgttcataacgatctaaaagggaagactaaaaaaacttcgatgaaaaatcttaaaatcaacttcaaatttaaagttgaaaatttaaattttagcggataagataaggcttttgaaaaggcggcattacacggagaaaatttatcttagactaagggtgtgtttagttttttgggtgtaaaaactttgaagtatatgaacacacatttgaagtattaaatgtagactaataacaaaacaaattacagattctgtctgtaaactacgatgcgaaattattaagcctaatcaatccgtcattagcaaatatttactatagcatcacattattaaatcatggcgtaattaggctcgaaagattcgtcttgcaatttacatgcaaactgttcaattgattttttcccacatttaatgctcaatgcatgtgatttttttcccacgttttttgccaaatttttttgggatctcaacaaggcctaaaactatgtaagattgtactcttaggttgcgttcaagaggccaggttcccaacgttgcctcccgaaaacaaagcatgtgattatggtgagattaagtattaacctgcaaacttgaaaaatgaattaatatgatttttcaaaaaaactttcatatagaaaacttttataaaaaatacaccgtttagcagtttgaaaagcgtgtatgtgaaaaggaagggaagtgagttgggtggaggggaaaagaacacaaccttaataggtaatggagaaaattagggactgtttagattgtagccaaaataaaccttaccaagttttggcaatgccaaaatattggcaagattgctaaaattttagcatgatttcttatgtattaactaaatttggcaacaaactaaacgcagatatttttttagcaactcgacaaaaaaaatggtatgattgaaaatagcatcaaagtgaacaaacccttggactaaactacggacaccatggggattcatggggattctgttctgttgattatctatatctaactgacatgtaaaaaaacatttcttcaatggatgaaaacaatttcacatattggttattgagtaaaatacaccaacggtccttaaacttgtcagaaggtttcacttaggtctacaaattgcaaagtgcacattgaggttcctaaatttggttattgtataatcccgatccaaagccgcgtttgactatggtcttgcctacgtggcacgcacatgacaatacatggattttattattttttgtttttcgcacttttcgtcccgtcactttttctccttcttccttcttttttctcgtcggtggtgaaaggcggcacgaagggaagggttgttgcagtggtgaaaaaagaaggaagaagggagaaaagaataaaaaaaatccatgttatcgttcacgtggcgtgccacgtaggcaagaccagggtcaaacgcggctttggacgagaataatacaataaaccaagtttagagaactcgatgtgcgctttacaagttcatggaactaagtaaaacctcccgacaagtttaaggaccgctggtgtattttactcttggttattcattcaacgcttctagaagtacgatattttccgtattggttatttgttccacctcctagaaagtacaatatatctctaaaaactccttgcatcagtatccgtatgagttttttttctctctcaatcatccagttcaattagcccttaatcaaagcagggtcttgtgagctaatcacaccttaatcgacattgagcaattgttcaacggtgccacaaaaaaattcagtgacagaagaaccaaaccttaggttggttggtcagtcagtcagtcagtcactgcagcggcttgaagacctgagagtgcggcgagacgacggcctcctgcaccatcctcctggggtcgccggggtcgcgcacccacttcacctcgctcatgttgggcgtctcgacgaacagcatcgtgaactcgcccaccttctcggcgcggccgcgccgcccggcccgcagcacgaggctgttgctcctgtggtaggagaagatgccgccggtcagccgcacgatgtcgcccggctcgaacgcgtcgcgctcggcgccccacaggaggaagtgcgccgccgccgtctcgtcggccacgagcgccaggcacgtctcctccctcgcgtcggcgcggccgtgcggcggcggcggcggcgccctggccgccttgtcgagcacgatgaacgtcgtgttcacgttgttggtggccgccggggcgaggtctttgagcttcaccgtgctgccgctgctgatgccactgacaccgggcgcgtcgggctgcagtcaatccattctaattgttagtcaaagttacactgtaaaacatcaagaattggccgcttgcacagtcgatatctatatcggtagagtgatgtgttgttgctgaagcttgtgtaggcgtacgccgaagcagcagatcattggctctactgagcattccatcgaacatcttgaggtcgtcccaagatcgacacaacttctcaacgcctcgacacaacaacaacaacaaaatcaaatcccacatgtgaggtacttgggaggaaactgcggggttacccctttgtgtgccatgggtgatgctcggtagccgggagagcgccgccgaagtgatgtactccgcccggcggcggcgccgcacctaactgcacacacccacacctctccctcttcctgtacgcgttgttgccaacggcttgtttgatgggccggttgacgggcccccggccccgctccaccgacgctttctgaggccgggtcgccgagaggtgagccggcggcgggcgagtggagatgagcagaggcggagatggggaatcggttgcgacttgcgagctggctaggccgaggcgatacggcgtcgtggtcacgagctgagctcgcgccttcgcgcatgggtgcgtcacggaacaggcaagaagggaacgtacaccttaagatagtttcatactctgtgctgatagaaaataacgaacaccttaaaggcaaggtaacccgcacacaactatactctatgctcatccaaaggtggctttcgtaaaaaaaaaaagagatcatatgtgtacccttatgtgcataccctctaaaatatgctcccctaccataccacactgcatagtaagccaaagcacctgctaatatgtttgaactcacaacaatctatttatcattaataatctacctatttaatatcgaagaaacaagaatacttaaatattgtgtgcaaagataaatcaatagattattagtacttgtttggtgattaaatattgcaacacacagcacagcagtggaaggcagccaacctctagttgctctggtaataaggagctatcgtctcgagagattataacccactcccctctactgggcattctatcgaacactttaaggtcgtcccaatcctgacacaagttctctaagagtttttacattcatgcgaaaagacagtagtaggcttacctctttatgcgccatgggtgatgctcgacagacagggaaacaccgcccaggtgatgctccgaccaacaacggcgacgacgcagacctccgagagaccaccagacgttggattgggaagaagctaaagccaatgggcgtgtctgggccgagggtggtgagctggaggaacaggttctacgtggcggtcaactgggccaccacgctcgtgtgcggcagggacaacatcaggatcggctgattgatgatggtttttggtcgggatttggctggacgtgtgttcagttctctgaataatccacacattctggaagagagggattggaagattctctctcttactacttgtttttctgaactaaatttcatctatgtaagtgatgatttattaatggattaattagatctatatcattaaaattttattggttttgaaatatactgttactttttgcgtatttcaaacgatgccactgctatttgtttgtaatttcattggtgctactaagatacgtattttgtatgtattggacgaaaataccatcatctccttctctctttcccgttgcttctttacatggacatggtcatacgagaagtaggtgtcaaagtacaggcccatctttttctcccccaattcgtaacttcaattttacgatgatgaacagataagagattatctctgcgggctcatcaatcaattcatgtcgggtgaggcgatctctacggctcccgttattacatgcgtgtcccctagcagcggtgcgggcagacacgcgcccgtgcgcccgttattacactaaaaactactatgtaaggttgtactctatgagtagtaggtaatggagaaaattatcttaaactagactacggacaccatggggatacttttctgatgattatctgactgacatgtaaataacatttcttcaatgatgaaaacaattttccatactggttattcattccacgcttctagaagtacgatatttttcgtattggttaatggttattcgttccacacttctagaaagtacaataactctaaaaactccctgcatcagtatccgtatcagtctgtttgattggagggagttgttgatggaaaatgggagtattattttcgagagtataagtttgtagtttggttggaatacttgaaaattcgagagtgtttgggagaattaagggtccaattcccaccaatctcttacctagggaggtctgttaattcgtgagatttgaagggaattcaatgtgaaaccaaacaaaggatggagactatgccaaacatgccctacgagttttttttttctctctctcaatcatccagtttaatttgcccttaatcaaagcagggttttatgagctaatcacaccttaatcgacattgagcaattgtacaacggtgccacaaaaaaattcagtgacagaagaaccaaaccttaggttggttggtcagtcagtcagtcagtcactgcagcggcttgaagacctgagagtgcggcgagacgacggcctcctgcaccatcctcctggggtcgccggggtcgcgcacccacttcacctcgctcatgttgggcgtctcgacgaacagcatcgtgaactcgcccaccttctcggcgcggccgcgccgcccggcccgcagcacgaggctgttgctcctgtggtaggagaagatgccgccggtcagccgcacgatgtcgcccggctcgaacgcgtcgcgctcggcgccccacaggaggaagtgcgccgccgccgtctcgtcggccacgagcgccaggcacgtctcctccctcgcgtcggcgcggccgtgcggcggcggcggcggcgccctggccgccttgtcgagcacgatgaacgtcgtgttcacgttgttggtggccgccggggcgaggtctttgagcttcaccgtgctgccgctgttgatgccactgacaacaggcacgtcgggctgcaatcaatcggttctggtcgttagtcaccgtagaataagcgcatcatggagtggccgcgtgcaatgctaaaacctatattggtagagtggtggaattcgtgtgtttggtgttcgtggtgaagcttgtgttggcgcataggacgaagcagcggcatgttgagtcttctgggcattctatcgaacaccttgaggtcgtcccaatactgacacaacttctcaattaatttttagatacatggaaacagtaggcttacccctttatgcgccatgggtgacgcgattcgtcgaccagcaacggcgacgacgcagacctcccaagtcccgaacccctacgaagagagaccaccaggcgttggattgaaccgtcgaagaagacgagaagatctgcaggattggggagaagctaactagctaagccagtgggcttgcctgggccgtgggtcaatggaattgatgggagcaggtcggtgtctactcgtgccatgcgcgcgcagatcccttgatcggctttcctagcctgataagcatgggctagcccattgcagctaaagcccaataaacattttagctaaaatgaggtaatcttgcccacggtagcaacattttagctgcagtgccaaacagctcaccttactaagcgaggctagtatgtttattgccgaggatccaaacgcagcctagtgtgtaatctcaacttctacgaggtgaagtgcccatgatcacgaattcatgactcgagaattgtacacacctcttactcaaaatccttggcctaatcttaattttggcataattttgcttttcttttttcacatagtgccctaatctattgtggagctatgatcgacgtcgatatgaacggtagacaacatcgtagtcgcgccgaccctcgagggaaagaacaccggcgagttgccaagcatcacacagcgaagatggttcctcgtaggtgtccggtaatacgatacgagggcaccacaacggcgaatgcgtatgtttcgacggggtacggagaagaaatctccgaacccctaagatgcgcctgggccatgaaccaattgggccgtttagtcgaaactggaccaatcaccggcccaccctagttgttcctctccataaaccagaagttgccgccgcccgccgccgacggcgatcgacgcgacacacgggtggagaggaatatacgagtacggtggcggccggcggcttcaggaatcgaccggtcgccggcgttgggggatcagcgccgtgattccttgccgtcgctgctgccgcttaaactgctttattctcagaaatgttttaaatgtactctgatctgctctgttgatggtataaatttgaacttttaaacctcgatgtcatggaacttacttttcctgtagtattcgagactttgtacaatgccccgatcgatggcaggattggcaacttgtcgttgtcagcaaatactacatgggccaaaaaacttaatgtacccgtgtttacgtgtcagaccgacccatcttctactaattccctgtagtcgaaggaaggaaaggatatgaggatgagtaggcagagcaggtacaatagtaggctataagtcagctgtaaatatattttaagaagataaataagagagcagtgggctacagatttatacctagctgtagcacggactccaagacacagtgtgtatgacaggtggaaccaggtattaatagtgcagtatgtaactattgtatggacgagctattagactgactatagttgaattgtaactagtagttggttatactattaaacttgctctaattgcgctgcctgcgtgtggtcctaattaactgactgatctacaacgacaagacaatcagtgcgagcgtgacaaacggagcaatgcagccaaacggagtaatgcagccgagttaaggaagcaccgattttggaggcagtcatggctcaaggcgattccaacttttttttctttagacttttaatttttttatcacatcgaactttcctacacacaaacttctaattttttcgttacatcgttccaatttctttaaacttctatttttagtagcgtgtaactaaacacagcccaagttatactgccagcagcatgggcaacaacatccagcatagctcccctctttaatttcttgggaaatatgctaggtatagtaaaagaatcaagatgataattaaagactatttgagcatgtatattgcagtagcaactagcaaagcaataaatatcgatctgttcatgacttgtatcacttgccctacatggctacattaatcactttattgattgacatacattgggtagcatttgcactccatgtagtggagcaaggattggcttggcatacatgaggttggaaactttgaagataagattgaatggtacgtatgagtagtccttaataatgtaaacaatgaagaatttctatactgtatgtatatgtagtggtggtttttctaccacaccatccctactagtattatataatattccctccagtttcattttaattgacgctttggacattgacacgctctacaagatatatctttgaccttatttttctattataatatatacaataaataaatgcatgtttacttttattatagtgttttgaaagacaaatctatatatgtttttctagtttctttaaactaaatatttttaatgttattgatggtcaaagttataaaagtttaaccttaatcttatccaaaacgtcaattaatatagaaccagagggagtattatattacaccactgactacttcctccatcccaaaatataaaaacattcttatattttgggacggagggagtaggcaaatagattccattaatcaacccacacccttcaacggtcatctcctggctgattcactgttgattcttcttaaattataaaatcacctatttattcaataaggaaaatcataaaaaaactatttaacttaaatatatgtttaatcgaattaatactaaaactcattgtttttttttctcttggttcttggctagtaggatgaaaaaaggacgatggtgggtgtgctaatcattcatttgcttcatcctatttgcggtattgcggtagctgacctgtacgtaacataacatcacaaatgtgacagccatgatttactaccgaaaattaacacactcttataagaaagctaatgacatcacacgtttcacatcttaaatcgccgcaacaactcttacagctacttttggtgccataacatttcagacaagtttaataatcaataccctatgtagttatgtctcgtcatgccttctaagcagctaaaataaataaatgaaatgaagaccaaaattacagagagcagttgtgacttgtgagcaaatatatagaacccaataaaagttatatccatttatttatatattttatttaatgtataaaattcattattgcttgttaaatattatggatccttttctagttattgaaaattaattaattattctctagtttttttggccgggttggccgaagaaacggacaaccgattgtattaagatttgaagaagatatacttatagttatgtactgtatacataagcaccagtatatttttcacgcaacagaaggcagtcaaaacctggaagaacatctagagatgccagaaccacctttactaaagacaacgactagtcacctggttctttgaactctctagcttctctccataccataattcttctctagctaatatccaaaggtttggataagcttaattaagaacgctgttttaaatttgggattatacaatagttgaatgttgtagtaaaaacaaaagtgtatgaaaatgaaattaaagaagcggtgaggaggaaaatgccatctcataccgaagaagctcctctaacatacagttctccgacatgtgtcgttaacctatgagcctacgagctgtgaggctcacatgtcaatcatttaaagttagagtatatgtttccgtcccatgctattgggatgcaaaatgtgatggaaatgatattttcttagcatttttttggttcaaaaagatgtttttttatataagatcattagcattggtgtttttattttttaatgttcgattccaccagcagtacactaaacagtaagaacagagacagactacgtacattcctccattactaaaaaagtaagtagtaagaaaacgtataattttgactttcattatgattccataggtaattttatcgttttcgggaggtaccatatttgtatgtcatgtaaaacttgatatttataaatactctattagagaccgtataagaattatcttattccatcatctatgtgaattacatttttcaaagggtacttcatttacggcaacccaactaatcgaccgcttgaggggcaagaccgtaagagtagtgtgttcatatggacctatcattgcgtagaagtggtcaccaagtttaatgtgagccctggcccctgggatcaaatcaaacttgatgaacatgctgagtattggagtgatgatcccatccaacatcaaaggaggtggtcctcctccccaagctccagggtgatccctggctgaaacaagagaaacctgtaagaattggtaaaagaaccgttgcctggcgccttctctttttcaaaaagaataaaaaaaaggagaccgttggcgccttttctgatggagattgcctttgtcatactctgaaacgatctgcaattacaaatggtactatacagttagacagttagttagtgacccatcatttacttcgaaagagaagttagtgatcggtcaaatgaatatattgctcgatcgactgctcgcttgcttagcagggaaggctctctctacccatattttgcttgcttcacgaggcgctttcgtgtgaaatccaaatggaattggcgaaggcacaactaataaattggttgacggatacttgcgatccatctgctagctcctgctgtctatccattaaccaactggctatcatccttcctccttcgcagcctagctcgcacccagactcttacctcccagtgggcagtcagcgtcgtgcgatctactcctatctcacaccgacgtgttaactgtccctgtttttaatttctggacgatgtttatagctgccactcagtcgctctagtgctgtttctggaaaataaaaagacactgacggctcatttaaaatgtactactagggattttattacgacagtttagcaggaatcggttcaaaactcgtaaaattctcaccagattcctccattctaaaggaagcctaaatgtgctagtataaaactgatgagaaacatcgtaacctacttctccacatcacatatatacaaacatgctgatcaaagattcagacagaaattttctaaaaaaaaaaagaagattcagacagtttatttctggctgatcgaagatccagaattgccagtcagtttttttaggtggcggagtggcggtgttcaattctgatctatctcgtactaaacattaagtcaaaagaaaaaaaattaacaaacaacaactgtaattgtattactccggacaagtggagtccgggagtcaagagtggcatacaacgcgccatgcccatgcatcatggtccagccgtccagccatcaagccgacatgccattaatacctccacccccttctctcctctcctacccgctacctcactaccaccgccatcaatgcgatccatatgctctcctccttaaaacccccctgcgccatcctccaccaccacctccgccgccgtcagagaccaccactccacacatcgtgttatttgagattccggcgagccggccggccggagacgaggaggatggtgttcttctgcttcttggtggaccagaggaggaaggtccggagcagcaagccggcggcggggatctgctcgcggtgcggcgggtgcgcgagcgtggcggacatggagacggcgacgcgcttctgctacctgctcaccgtgcacagggccacgtggcgcgccatcatctgcaccttctgcggcgccatgctcaagtcctaccgccactacaggctctacgccagctagctctacgctacctacgatcgccggccgccggcggtgatggccggagagagagagaggaggaggcgacctacttgctgcgtacgtctctgtgctctctgcgaggtgtgcttgttgcgttgggccttggctactagtactactattggaggagtattaattaattggctttgttgatttcttgcaaaatgctaagctttgcatgcagcttgtaatccctgtgcatgtagtatgttgtacatatgctggagatgaagagaggaagttgattaaatttttgttaccggtttcattagcagagcctatgtgtgatcgatcttttaattatttcttctaatagaattatagaaaagatcagggaggttatgatatttgaaggggcatcactcatcagtactactacttttgctcgcatgactgctcatacatttttcttgtctcgccttgatccatcatatcatggcttgaacgtgattagtcacaccattgagagcggctggccatgagatatttcgaaataaataaagacccatttttctctacatttggcttaaagcacacagcatttaaattctgtacccgaccacccgttggtagcattaactgtgccatgcgagaggatagtttgatgtggaccttcattaccagaaaaccttggtttaatttcgttggcccactgcacacaaacatgcagcgaccactcctcgactccagctggtttttctgtttttttatttaatttttgaaggactcactaaaatttcagtgaaaaatgagaaaaattacaggtaataaaattaaatagaaggaaatgagaaatgagcaaaacgagcaactgagttcatcctgctccagctaagcctgttaaatggtccttgcagtttacagcgagcagtcatcatatttcgcacttaataagtagtgatggaaaaatgtcaacaaacggatatgcggtgggataaaccggaaattaaattactgatgtgagttgagagacggttgaagtgtagatagacgtgtagttcattttctctgtacgtatatatatcaataggtgactatggtgtacctgcgcacttggcctgtattcaattccgtttcttcaatgaaaacagttcagacagagtcctctacctccacgaaagtcaccgtcctcgcttgacgtgtagtagtacattgttgccttgttggcttataccgtttcgccggagatatgaggtcgatgggcctcccaagccgaaatgccaccctcctttgctaactaggagtatctctgtttgatgagtttttaaccgctatagcttttatttaaatctttagctcccttaaacaatataaatttttaagttatattttaagataatataaatttttaagttagatttaagaagttgtagttatagaatatagaaaataaataaagataaaaatttggaaacctagcctttctagtttttcaacttttccagattctcaaaagttagtccatccgtcccataatataataatctataatcggatggaacatttcatagtataacgaatctaaataccatcctatccagatttgttctaatatgaaatgtcttattcagttttggattactatgttataagacggagggaatagctatcaaccagctacttctcagcttctaatgcgatgggggttaagggtgggaggaaggtaacggtgtgtttggttagagtgatatcactaaatgggatatgacgatccagtttttaaatatgtttggttgatgggtaagaatggattgggtggtctaaagagaaaatgtttcacgaagatactagatgagtgggttaaattgaccggatgaggatatccacatttggtaatcttaatcattagtaaatgattaatatctcatccagttatagatttcttatattttgaagcgtatggagtaattgacttgtcaaaattagtgttgattatataattagtccattttattgttaattagtatagatatgactatattgatgataattaacatatttatcattgattaatatgttattgattttactctatccgttcctatccggatggtcatatatccataaaacaaacagaaccaccatattcctacaaatataaatggctatacccgtgaaagggcttgtagcctagtggttacaagagcctcagtagtacatgaggtcctgggttcaactccctgtgggagcgaattttccaggatttaacggcgttgtgctttcagtggtaggtgacgtacccgtcgacagcgaagcgcgacgttgtgctttcagtcagtggtaggtgacgtacttgtcgacagcgaaacgtctgtggtgacttcaatctctccaggatttaacggcgttgtgctttcagtggtaggtgacgtacccgtcgacagcgaagcgcgacgttgtgctttcagtcagtggtaggtgacgtacttgtcgacagcgaaacgtctgtggtgacttcaatctctccaggatttaacggcgttgtgctttcagtggtaggtgacgtacccgtcgacagcgaagcgcgacgttgtgctttcagtcagtggtaggtgacgtacttgtcgacagcgaaacgtccaggatttaacggcgttgtgctttcagtggtaggtgacgtacccgtcgacagcgaagcgcgacgttgtgctttcagtcagtggtaggtgacgtacttgtcgacagcgaaacgtctgtggtgacttcaatctctccaggatttgctcataggggtagggatggctataccctaccacgaatcaaacacacccttaagccgcatcacgtggttgacgtcttggtttctagtataattttctcgtctagactgggccgagtaccgtgtgagatgggccaaccaaccgcaaccagccagctattccggcctagtgtggcctgccacgacacgaacgatctcacgcacgagccgttgcagcgccgcgtgcgacgacccgccctcctccacggccttcctgcacgccgcgctcacctccgcggccttctccctcgcctccgacgacccgccgccctgcggcgccatcagcctcctcaccgcgcgctccacctccgccgcctccacgagcgatctcgccgcgtcgccgtccttcgccgtcgtcctcctcagctcgaccgcgacgcccatggaggccacggcctcgaacgcgttgaggtgctgctcgccgtagagcggccatgtcgccatcggcacgccgaaccacaggctctccagcaccgagttccagccgcagtgcgtcacgaacccgcccacggcggcgtgtcccaggatgtccttctgcggcgcccacctcggccacaccatccctctcccggcggtcgcctccaggaacccctccgggagcagctcgcccgggtccgcgtccgtcgggtaccgcacgccgccggcgggcgcgccgcgcaggacccacaggaagcggtggccgctgcgctccaggcccgcggcgagctccctcacctgcgccgcgtcgaggaagccgatgctcccgaagcagaggaacaccaccgacgccgccggctgcgcgtcgagccaccgcacgcactcgtgcggctgctcgggcggcagcgtggcgtcgaaccagatcaccggcccgatcgcgtggatcgccggagcggggcggcggccgtccgcgatcgcggcgaggaccgcgccctcgagctcaacggaggagttcacgatgatgcccttcgcctccgtgaagcggcggccgtggtactcgaaccagtcgtagttcttcaccgtcttgctcacgaggcacaccggcatgtacgacggcggcaccggcggcagcccgggcacgtccacggttccctccatgccgtcgaacccgacggtcaggtcgtcccggagctccggcagccgcagcatgagcgcgaggaacgcggcggtggaggcgaagtacacgtacgccgggagcgagagctcgtgcgccgcgtcgagcaggggcgtgaagaagaggtccacgacgaccgcggccacgggggacgccaagccggcgatggccgccttgacgtggtgcgcgtggcgctcgacgtaccgggacatgaactcctcggtcgcctcgcagccggtggggtgctcgacggcggggagccgccggaaggtgacgtcgagcccggaagccgcctcccggcgcacgtgggcctcgaccaccgacgcctctatctccgtcggcgcctgcatgacgagcacggtgagggagacggcgcccccgccggcgacgagcagccgcttgccggcttccagcgcggacatgaagtggccggatccccaggccgggaggaggacgatggttgggccagccattgatgcagacagagtaggatttgctactgaattttgtcaattgacagtgacgagctcctgcttgcttgcactgactctcggagtctctgcgtataaaagaacgggcaattgcaaatttgccactattttgaatcgttattataagactgccactaaaaaattgtaaaaatactactaaaactatcattcgagtggcatccttacaatattgaaaaaatcgataacaaatttacaaatgcctcttataataacggtgacgatgtcttagatcgatactgttggattttttttttagaaaatcctggtgcgtgtcaaaccagtattttcggtatttctctttctttatttcgttttttctcttttagataaggtttgttaggtttgttagaatcgcatgaagagccagagcctccctgcgtggtgtgtgaaccgagcgcgtgggatggcacacgctgcgaaccgatcgtggcgcacaaagggttttgtttggggagtctatggtagctccagtttctcccaaaatttccaaacaatttagcttttcatccaaatcctgataaattgtagttataaaattcaaaaactaactagaagccataatctaagaaacgaaacttctccatattcttataaaatatctgcctgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttactctaaaaaccctcttctcccttttttcctctcgtgggatctactctccagatcatccccccttccagccccgcctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacagctgctgcccgagtgacccttctgatgggacggcccatacctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccctatatacgcggcgcaaaacccacaaggggtcggggcgccttggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacactgccaatcagtagtttcttaaaatcttaagctctccaaacaaatccaaagttggagtcgtggttaaagcccccgctaacgtatcctttacatttgcaatcaacactatcagaaatgctgccacttgacagcaccaaacaccttgtgttcgttccactggtcatattctggcatagtgttcgacagagagggggagagagagagacaactaggcacgcccgagggctacttctggtcatctttgtgatgttttttttttcttaagatgaaaataaagaataagtttttttacgcaaaacgagatggtattattaacgtataattgattgagttttaattattacaaacttgaaaaatatattaatatgatattttagagtaactttcatataaaaaattttcacacgaaacacaccgtttaacagtttaaaaagcgtgccataaaaatcttaatctttatccagctcttgttggagaaaagaatgggctagtgtcattagtttaatctcttcgtccgatcatcttttctgttttggtcgttcatgcaaaacacgtcaatggtagtgtcttcatcaatctgatcctctcgctcataggatggttttggcattcatccggggcgaggctgtagataaggccggttataagacacccggtctccaccaatacttttcctataaaagaacctttggtagtaacggtgccgatgtcttgatcgataagagttgcattcgtttcatctcttcgtccgatcatcgtctctgttttggtcattcgtgcaaaacacgccaatgatcgtgctcattgattcaatcgaagacatttctgtgcaatgctgtcttcatcaacctgatcacatcttgaatatgccaccaggcacagtcacagcctctcgatcttaggatggttttggcgtgccaaattcttcatcctcgagacctcgacgtcggtcttaggtattctacagtgcagatttcagcatgaggtaacgaattattgatcctcatcagggagaaaaaagagctaataagcgcggcgtcaataataagttgcgctagtgatggaattaaatcgtaatggtatgttttcaatgcgttgttttgatacactggagcaacggtactccctccgtttcaaagtcaaac

SEQ ID NO: 3178 - DNA, 19154 bp, Oryza sativa
  unsure (1)..(19154): unsure at all n locations
nnnnnnnnnnnnnnnnnnnnnnnnnnnnnnnnnnnnnnnnnnnnnnnnnnnnnnnnnnnataaaaacaacttaacaaatactcctcatttgtagtctcgtttattgagtagcccctttcagctggatcagcagtgccaagatttgctaaacctgacgctaggcctgaaataggagtatcagcagactcccctctatccatagacagaatctcatcaccagtatcaaacaggccttctctaaccaaagcagaatagatgtcatgaggattggcatctgcgctttgcaagcttgcaaaaagtcctgtctgttcagagttatcttcttgtgctgatcttccactcggtgcttcacttgtccctgtcagcataacttggtcctagaatcatcacaaggcaactttgttagggtcataaattatttaaaactggaaatttggaatgagggaaatatctccttttattggtatcatattccccaaatagcaatatcagcatatacttttggacaaaaaaaaacacatccactggaccagagtgaacaatcaaaagcaagagctcacaattagaaacatgttgagcttcgtatgaaatcttacaactaaagggaaatttaaaagatgagagaagaattaacacatgcaagttttttttttttttttgatgttttgggagtaggactccagatgtgagtcatgtgaacaagtcatcagggactcagggttatgacacaacttttagccagacagaaatatcggttgaagatacccatagtccaaactacaatgccacagaaaggttatgctgtacctcacttgtgcttatcttcttctctacagaagcatcttgcgctgtaatagttgcatcatcatctgtgaaaagcacggtctactaaaatcaatgaaaaggaaaatcataacggatttttttttataaaaaaactacatctaaattggactaagaaagaaagataacttttcaaagagaggacaaagcataataaatgaagaagattatagttaacacactatacaggtattataagatgtcaaaattaggacggaagtagggaaagaatcacatacagaacttatagggattaacaagtgcagcctccagcattgccttgaattctcgtgcagcagaaaccacagagtcagtttccccctggattgaaacacgcacacatgattaatggtctggaagactattagtgtcaacgtcaactaggagtactatatattgattagagtttaaacaaactccatatgaaacagcaaacaaatcagtaccagaacacatcattcttgccgcaaactataaatacactgtaccttctcataacctcgctgagccccgaaaatttgagactcagagatatcagcagtccgtgagtctgaagactcactttgaaactcccgcaaccaactgaagtcatcacttagaggctgcatatcatctatttgaaacaaaattgaaaagctcacatgagtatattcacaaagtataaaattgtttccaaagaaaaacaattgaataatacttatacctgccagaccacagctgttatcatgaatgtactcttcagaaccaattatatgtggaagagggccatatgcagacatagccttcaagagtcaagcaacaaagataatttggaaatgctaccatagaacaaacgcttgtgaactatagaatttctgaaataatgccagctgcagttaccaaacagaactaccaaaatttggtttgtcagttttggcatataattagtttgctggaaaaacattggcaatatttacttcacagcaagctttttagttaatttgcttctgaaatctgggtgaccagggggagggttggtggtaaaaattgcattggcaatgtgttccaaaatttggtcatctaataggtcgctgaaaattggaagtgtttcggcaagaaaatgaatttaccataatgtgccaaaaggatgggaatcttgacagaattttggaagaaaaataataaagattcagataatatttggcagctaaaaactggaactagttggcatcaacctaaacaagcctccgcaacaaaattttagtaatgacaaattatggcattaatttgcagggaaaagtttgaggggggggggggggtaaatatttcatcaagaactgcaagtaaggccattaccctgaacacagaggtggtagagcgtcccttgcttcggaagtggtccttacaggaagaaagtcctatgtgtaatgcttctttgtatcttggtaaaatatcacgttcataatcctgagctggcacttgggattgcagagaaccatgcatactctccgttgttttcagatgcatactatcttcatctgaaattttctgcagttgaagacgcacttgcagcagtgagcggtgatatgttattcatctccttgaggcaaagtacagaaatgtgtcccaagcaatttccactgagggaatgaggagatatcataaatttgaatttatgtaaatttgaaatttatgtcttttacaaaagtaatcaaaacaagtatacgacacttgaccatagaagggtgtactacagccaaaagttaagtatattgtcatctgatataaacaaatcaatcacaaagcaagcataactttctagactagaggcatccaaagacaagtgcaatatacagatttggaaccactacttgcatgttcaatgaacctttggcgggtcaggttgttgaaggagatcatcgcggtcttcatatccagctccagcgccccagcctcatctaacaacacattgacttctgcagcggctcctttagctctctcctccaccttatcagagaaatcttgcagccacttcaagacctgagcaggaaacgcgacaacacatgacgagagcagccaagatactgagatgtacagttgcaatcagagccttccagaaatcagagccagacaacgaaatcgagcatgccagcacgcattctcaggtttctgcagaacactgtgagccggcatggttcaggtggatctagcagcgcaaaagagcagccgcagccgcaatcgaggaggcaatcgctgaactgtaaccgcgatggtgcgattggctacgcgcgcttgattcttgcgatgagtatgggcgaaaatccgagaggagaagccacgaattcgtggagaatttgagccaaacgtgtgcaggaatcggcagcatcacagaacctccggggcagcaagcagcaaacgatctgatggagagggaaaggcgggcgcgtgctcacgaggtacctggctctggtttgcgaggtgcttggcgatggaggcggaggagctcccgccgtcgccaccgccgccgcggtctccggctcgccggtgggtcgcctgcgcctccatcttcctccgccggatggtgcgaactgtgaaagcagcaatgcgcaacaccacttaatatgggccgcattctagctctcggcccaactaatatgggccgcacgtagcccgcattcccgttgaggcccaactattataggccgcatgcaagtttttctcaccgtattttaggaaaaagtacaccgaagatccctcaacttgtcatcgaattacaaaatcgtcctccaaccacgaaaccggatacaacgcatcctccaacttacaaaaccatacaaactaggtccctcggcagttttatccccggttttgtccgacatggcggctggctcagcgtgggacctacatgtcaagatgccatgtcagcaccctctctcttccctttcctctccctccttctcaatctcacttttctccttatgtgtaagcagcaagctggccgatgggtggggaaaggtcgccggggtgaggcaggagaggaggaggcggcgggtgatgaggtgttgatgaaaaacacgagccctgggaggtctgcttaactccagtgcagatccaaaactcgccttcgggtatgctagcgtgccagttgatttgatcctgcaatcaacaagaaataaagacaaaaaaactgtggttaaatccataaatgatagtcgatcggctaggtgccgatgacatatcatttatctttgagccgatgttaaatatgtatcgatcggcagttataaatagataataaagaactaaatctattcgatcggctgtagatattaacaatatataatccttatattgatatatacttaaatcaagtgattgggatagatcggttgccatgccgagacagtataaatcacttagatcaaaatatatactaacaacaagactatatatattcatagcatagccgatcagagagatctagcatgtaccggctaatacttcgataccgctctatattaagatatcaacgcaaataggatataccaaacaaagagcctaatatacttaaatgcggcaagatcttaacataaagggcagatttaatatgtcagtaaagcatataaaacaaatatagttaaaccaggtaagaccggctgaaaccccgatactaccctaatcggcaaccaagaagcaggctagagattgagattctaatcacgactcataagatcaaactcaattgatgcagctataagtataaaaagaaggacaatatctagacaatcaagccattggaagtttcatagagtggtggatatcatatataatctaagccaacatcgatatttaacctaatcggctgccctctattgatagatgttagccgattgtaggttagatagcgatattgtcagagattatataagatatatgataactcgacgaattacataaacaagattagagtatcataaagatggaagcactaatcccgagaacgtaagccgtcataacaagttttacctcttgttgaagatcgaaaccgatgcagctcaacctgaaagcaagaactcgtcgaaataaaactaaagcaaaaaggatggcgatgcgtcgagattgtattgaacgtgtgtgttaaattgattacatagggctcggggtctatttatacccgagaattacacaacatgtccatatcggacatgactcttatccctaacaaactctaagataccataagtctttgcggcagactttttcccaaacatatctctaaggaatttacataaaacatcctaactaatagatacaattgcattctcaggactctatccatgcgtggcaatcatcttgaagcatatcaactcgacccaatgtcgtacaccaagtcgtattgtcggaatcggctgtatcacctaacccagtctgactcggacttagccgatctcgatcgtagccaattcggactccagccgattcttactctgtttccgcgacaatcctcatctttgattccgcttcgatctaatcttcttctccgatactgatattaccaaatttggtcgttaacacgaggcggcgacgtggaggctgtgacgctggaggggaggccgccgcgccgaggtcggattctcccttctgccacgccgagaggaggagctagcggccggtgacgcagggatggcagtagcggcgaggcgggagaaggagagggcgtcggcggcaggaacactgcgaggggagagcgaggacgatagggcacctcggcgtcgagaccctcccctccatcctcgggcgcgcgtgctcggtggcgagcggagtggggcgaccccgaggtggagcggcagcgggtggagtggggtgatgacgaggcggagtggcagcgcgcgaagtcggtggcacggagcgcgacagtggtgggcggagccgacgggcagagtggggcgactatcggcgggtagagtggggcgacaatgcgccgtcgccgccgatctccacagcttcggcgccccaactccctccgccgtcatcatcgtgcctcctccaccgagctccactcccgccgcggtcgccgctccagcttccccatctgcttcccaccgccatggcggtcgccgccgccgaagacgacgacggtggatttgagggggaggacgcgcaccacctcttccctcatatgctccctagccgcccgtgcgctgcttctccgccgccatgctgccatcaccgccaccggccaccgtcgcggcgctgcccttctcgtggcgtcgggtgaggagaagagaagagagagaggaggaagggagagagattgacgtggcatcctgacatgtggggcccacctgggtcccacgctgactcagctgccacgtaggacaaaaccggggccaaaaccaccgaaggactgtcacgaactcgattttctcaactgcgattcaatcgttttggagagatttggagatagcggaagagatagaacggaatcgagaggaagaacggagaggaagaacagagagtttcagagtaactggaggagagattggaattgattttgggggaaagttgtttgtacattgctccaaagttaatctctctctctctctctctctcccgccgacctaaatagcacatcactacaaggtctcactcactctctgacagtggccccgtgacagttaccaggtccactcgcttgcagggaaccttctcgagggctgcctctctctgttagacttcctgagctggtcttgtccttgagccggcgtgacattcccccttccttgaaacgaagcttgtccccaagcttcatggtgaggaaaacgatggcgcagttcttgcagattttcccaagtaacagctgttggttcttccccagaccactgaatcaacacttgttcaaccatcttagagccattgcgaataatgcgacgatccaaaatgtgagcaggttcagcttcagcatcagttgtcggatgaagtacaggcaaaacaagttgaaccgtttcagtaggtgccagcgctttcttcagttgagaaacgtgaatgacaggatgaatcagacttgacgctggtaaatccaagcgataagccacctctcccacacgagctagaacctgaaaaggaccataaaagcgaaacgaaagtttgcgatttgtgcgggtcactaccgattgctggacgaagggttgtagtttgagagaaacccagtcgcccacagcaaaagagcgctccgaccggtgatgatcagcctgaaatttcatcctggattgagcgcgcaacaaatgctcacaaatcagtacttgcattttctcgcgttcatgtagccactcctgaagctcagaagactgacaagctgcagtagctgacaacccaaaatagcgaggcttatgaccatataatacctcaaacggagttgtgcccaaagcagaatggaatgaagtattgtaccagtactctgcgagagccaaccatctactccactgagagggacaggcgtgaacaaagcagcgaagaaaggtttccaaacactggttgacacgttccgtctgtccatccgtttgagggtgataagatgaactcatgcgcaactgtgtaccagccaaacgaaacagagttgtccacaatgtgctagtgaaaatgcgatcacgatcggagataagggactgaggcaatccgtgcagacgatgaatgaattgcatataggcttcagtgacgtccaaggccgtgaaaggatgagacaaaggcacaaagtggctgtatttggaaaatttgtcaacgaccaccaaaatgcagttaaacgaagatgagcgtggtaaaccttcaataaagtccaacgagaccacttgccaagcatgttcaggcactagtaaaggttgcaacataccaggatatttgacatgttcagatttcgccttttgacagatcgaacaggcttgcacaaattggaccacactcgagcgcaaccctggccaagcaaacagttgcttaatatgctgataattaacgtgaataccagagtgaccacccactgcagcagtatgaagattggctaagatcttctgctgaagggaaatattatgaccaatccacatacgctgcttgaaatacagtatgccatccttcagagtgtaatcaggcacatcatgagcgctgatactaagagtctgaactttactgcgagaatcgggatcctgaacataaccatcccttacctcctgcatccatgctggaatggccacggacagagcagataaaacaatggtgtcagaagattggcacctagacagagcatcggccgcccgattatcaacacccttcctgtaaatgatcttgtaacgtaaacccaaaagcttggtaagagccttatgttgccacggtgtagtaagtctctgatcatctaagaaggatagactccgatgatctgtcttaatgaaaaattcagcatgttgtaagtaagagctccagtgctcaatggcaagaattatagccaaactctccttttcataggtggacaagccttgatgacgagatcccaaagctcgactgagaaaagccaccgggtgattctgttgcattaggactgcaccaattcctttgtcagatgcatccgtttccaccacaaaaggtagattgaaattaggcatggccaagacaggagctgagataagagctgctttaatgactgaaatgcagtttcagagtcaactgttcatacaaagagctgcccctttctcaacaaattagttaaaggcttactgatgattccataatgtcttacaaatttgcgatagtagccagctaatcctaagaagtgcaattctttgactgaggtaggaactggccaatccctgacagcctgaattttatcctcatcagtggacacaccattaggagaaataatatggcccaagtaagcaaggcgttgctggccaaaagaacacttgctacgtttcaccttgagctgatgcttaagcaaaacctggaacacagttctcaagtgttgaatatgctcctcaagagtagaactataaatcaaaatgtcatccacaaagactaacacaaagcggcgaagccaagggtgcagaatgctgttcatgacgccctgaaaagtggctggtgcactggttaaaccaaaaggaatcacacaaaattcatagtgttcattatgtgtcttgaaagctgtcttatgttcatcttgcacttgcatacgaatttggtggtaaccagagcgtaaatcaagcttagtgaaccactgcgctccattgagttcatccaacaattcatcaataacgggcaagggatagttatttttgactgttatagcatttagatggcgataatcaacacaaaagtgccaggatccatccttcttttttaccaaaagaacaggggaaaagaatggactatagctgggctgaatgatacctttagaaagcatctctttcacttgtaattcaatttcatccttctgtgtgggagtataacgatatggcctcacatttactggttgagccctaggaatcaatggaatggagtggtcatacggtcgatcaggtggtaaaccttcaggttcagcaaagacagaatcaaattcctgcaacactacttgcactgcctcaggaatgatttctgaagttgatgatactgacagagaacataattgcaccagatttgaaattgcacaacgagaaataagcccattcaattgttgaacagagacactggaacaagtggctaactgagatgtaatcccttgtaatgaaatagtctgtcccttccacgcgagagtcaaagactttctggtccaatcgaccgtcatgggattgtgatgcattaaccagtccatgccgaggatcatatcatagttgctcagaggtatcaccttcagattggtacaaaataagtacccttgagagctccattcacaaccaggaatctcttggtcacaagacaacaattcaccattagccaccttgacctgaacagatttagctaatcattgagccccagccaaagaagcagcaatctgagaactgacaaaactggttgaactgcctgaatccactaagatgagtacttcaaaaccttgaacccaccccaacaagcgcatggttccaccagattcagaccccacaattgcttgaacagacacagccataactgacggaccagattgctcctctaaatttttagaatccatcaaagaagattgttcaccatcttgcaacaaggaaaacaactcctgtactgcgtgcaattgcacagtggtggcacatttgtgagcaggtgaccatttttcggcacaaatgtaacataacccttgagcccgacgatgagccttaatagatgacatcttgtcaatagtcctgtagcacgttggccatcctgatgtttcttatcatcagcacgcacacctcctgatcctggaggtaaaggaagtggaaatgctcccttgaaagcagaactgtttttcggttgcactccaccatccgagcgccgaaagggtttactgtgattagactccgggaccacctccagcacctcttcctgtaaagacgcaatagccagagcagtctcgagatcgcgaggacgatgaagcaaaacagcatttctgatttctctatgtaatccctcagtaaaacgatgaatcaagtatcgcatattaacctcaggatcataagccaacagctgattcatcaactcatcaaaatgctcataaaactcccaaactgttcctgtctgcctaatttgatccatttgtctaatgagtaaatcatgttggtccttatcaaatttactggacatagtggcactaaactcttcccaaacaggatacctcacatgagctctagaagatctcaaccatgatgctgctcgtcctatgaagtaaatggtggcgactcgaacccatagacctggatatgtgttgttcacatcaaagtagtgctcacaacgcatacgccaatcctgtggatccgaaccatcaaattttggaaaatctaacttaggcacacggtgattatactgtctctcatcaggatccccatcaaatttcccacctcccgaatcaaaatttcccagagaattcattgaaacaggagtaacttcgaacttacccttgcccggagttgggatcagggtggtgaccatccctgatgccctaccccggtgatgttgtgcaaagcggtggccataggcccacttctctgcttcttccgccgcggtcatcaacttcgtcggcgacggaggtgtgggaaagcagcggcgccttcctttcctcgtccgtcaacggaactcgaggggaagatgccaatggagaagccatcttcgtcttgccgaggaagtccactttctggcggagctcgccaacctcctcgcgcagttcctgcatcacttcctccacttgtggcctccaattattcacaccttgatctatcttgatgacggtggcctgcgtcttgccttgtgctcgattcagcgccaacatcgactcctggatctcgacaagcaccttgctgaaatccacgttttgcttctccatcgcctccacttgaagttgcagccgggatgtgtagcgtggtttctccaggattggttgctctgataccaaattgtcacgaactcgattttctcaactgcgattcaattgttttggagagatttggagatagcggaagagatagaacggagtcgagaggaagaacagagagaaagaacagagagtttcagagtaagaggaggagagattggaattgattttggagaaagttgtttgtacattgctccaaagttaatctctctctctcctgccgacctaaatagtgtaggatcgaatcacaagaactaagccaaccagaggggggatgaatggttggtatacccaaaaaccgaaaacttttagcggaaataaaagttaccctcgaaatcgatggatcgcggtcagaccgagattgatctgtcggtctgaccgcttgatgaacgtcggtctgaccgatgtagattgatcggtcgaaccgccgagaacgcctgctgtcgactcctgtcaccgccagtctgaccgtcgtgtgcccgccggtcagaccgccgcgatgccgccggtctgaccgccggtgcgttgccggttagaccgccgaaacccagtgaaacacaaatcgaagaactcttaaagtggatgacgactttattacttctctctatgtttacaaagtgcaccaacagcactccttacaaaaatttcgactaaactcgaaactctaactcaaaactcaactcaattgctctcaaaagcgataccgggaagcctcacgctccccctctatttatacatgaggtaggcagcctaaagccacgaaccaaactcatactaagagtcctaaacaccttaggaaaccctctagtagaagaaagaaacattacataaccaatcgtaccaaatttggactccttccaaatttgactccacatcccatacgcacacaataacttcatcgtatgccatatggaatctccatcaaccacgtgcatcaactctagcctaagtatcccgcatgatctctgatcaccacagacgtcgtcttatccccaagccgactcccggtccatcaccgcaaatactctcccgagacatcgagtcacctacacatggaacaaacaaagaaaccatattccgagaccaagctatctccaacttgactcattagtagcaaacaacagtattacatatgtatagtatccatctagaagtcataatcatgaaataatcacggatatccaaacaaacaacccgaaaccgaaaccgacacagtgtcggccggtcagaccgtgggctggctggtctgaccgcgcgcataccgctggtccgaccggctaccagagcccggtctgaccggtcacatgaaataatgaatcctgcgatcacctgtgaaatccaatcatctccaaaaccacttcgtgaataaattccaaataacaaaaccaataatctccgatgcccaattgttcatcacagaataatcatcaaaaacacctttgattttacaaatagcacagcactacaaggtctcactcactctctaacagtggccccgtgacagttaccgggtccactcgtttgcagggaaccttctcgagggctgcctctctctgttagacttcttgagctggtcttgtccttgagccggcgtgacaaggacctattgtgaccggttttgattagttaagggacgcccaatatctggttttacggttgggggatgattttataactcgatgacaagttgagggaccttcggtgtactttttccccgtattttattttcaagcggaaaaagtgcaccaaaggtccctcaacttgtcatcgagttacaaaatcatccttgaaccgcaaaaccagatacaacgtatctcccaacttacaaaaccagtgcaaattaggtctctcgacggttttgactccagttttgtctgacgtagcagctgactcaacgtgggacccacgtgggccctagtgtcccacaagttagcctcttcttcccctcccctctccacctttctttttctctcctctcctctctcatcccctctcttctctgtatctatccgcgtcacgaagccggtgggatggagtggggcaacggtaggcggagaaggcaggtggaatggggagacagtggacggggtagagcgaggtggcaacgagcggagaagccaggcggagtaaaatgacggggcacgaagccagcggggtggtggcgggtagagcaggtaggcgaagtggggcgacagtgggcaaagcggcagcgcgcgaagccggcggcgcggagcggggcggtcgcgggcggagcaggcaggcctacgaggcgatggcgcgcgaagccaacggcgcgaagcagagcggtggcgaacgacaacgacgatggcgatgggttcgaggaggaggaggaggaggaggtcgcgcaccacctcttcctcttccccgtctcctccatcttcgtgctgtcgtccctcgctacatccgctgccaccgcgccatccctccaacctgctcgccgtcctttgcaccccgtctccgctgtcctccgtgccaccctccgacctcaacggcgtcctcaccataggcaacagctcgccgcgctatccccttgcccaattgctcccctgccgcccgcatgccgctcctcccctgccgcccgccgcccgccgcccgcgcaattccttcctctgccgcctgcccgatgccgtacctcgtgacgtcagacacctagctgcccagcgacaacacgctgcacaccagccactccttgggcgtcgacaccttggggctctcggcgatggcgctgcctcggcgcgggcgtcgcgccaccacctggccatgtaccccttgacagcggcaacgccgccggccaccacctccttgggcggcatgacgagcgggttgtggtcaatatagagaagagaaaggagaggagagagaaagaaaggtggagatgggaggggaagaagaggttgacgtgtggggcccacgtgagtcccacactgagtcagttgctatgtcggataaaaccggagtcaaaactgccgagggacctagtttgtattggttttgtaagttgaggaatgcgttgtatctagttttgcggtccaagaacgattttataactcgatgacaagttgaaggaccttcggtgtactttttccttttctagcattggctttttaagtcacgaaaacacttctatacaagttttactcataaattattttaatttttttttgtttattttctctgggcttatcagctataaagtaaacgatgtagtcgacggcattggcaagaaaacttttgacaccgtagcagcttcaagagaacaaagaatatgtgaaacttgaggccatagcacataaacggaaaaaaaaggaaagcaaatgtgtgaaaacggaattgctcttgcgaggatgcatcggtttcatttcagatttttcaatatgtacggagatgggcctgtccgaaaatcatgtgtgcttttcttcacctgaaaactgaaccgaatccaatgttcagttttcagtcggcacaaagcgaaaggaataagaaaccaaacatagcagtgacactgtttgagcccgtgacatcacagactttggattaatgtcaatttatcatcgttagtttctgacaatcactctgatgagataagcctctaaacttaaaaagaaaaattctaaccccaagtatccgacagctgtccaccaaaccaaaactaatgggaagccaaacaaaagaaaaaaggcaaatggaggaccaactactgcacctgaccaatcatgcataagcaacatactgacatgggttccaactaatcaaatgcatttatgcattacatggaagaccaaataaaccaaaagggaaaaataaagggaaatcattaccactatcttgtcggttagaaataaaatggaaaggggaatacatagtggatggttgactaacaaagccatgggtgattacatgcggctgatcaaagagtggcaatagtacaccactccaggtcacacttcatcaattgctttcagctttggacaattcaagatggagtccccactttggactactgtatgttcctgtcatcttcaatcattttcactctcttctctcaagttactcctttcatcttgagtggttgccaacgaatgataacaaaaacataagataaaatttactatatttacaatagttgattttgggacgtacagcggtttgaagcgcaattaaacattaacaaagcatgacaaaaacctttacagatcatgccttctttttataataaaaataaaatgaatctcataaaaatcttgtaaaattcttatattagaaacgatcaatatatgtaagatcttcataatatttatctcaacctttattttcttttatattgttccagaacatataatgagggataacgtacataacttatattgttatctgacctccaaaaataaccacgtgcaattaattattgaatacgatgagtataagaacaaaaaaaacttgaaagagccaagcatctattttgtactgaataaaacatacacgggactataagataaaaaatcacgtcattgtattgtgttttgaagcttgtttgatcagttgaaaacttttcgggcgatcacaatattcatttgcaattttcatagtgatgttatgtttgttgttgtattgtaaaaactacagcaccatgatttattatttattatattggtgcaatagtcacgaacagaaaacaaacattaggtatttcgacagcatagcaactatacacaatatcctaataattcctttcaccatcaaatagaaattgagaacaagctggatggctaccgagaatattagttacagctaatcactactccggtcgaaagaatatcacgggttaaaacaccagtaaaacgtggtctgcattggttaggccagcaaacccaacgcgccgtcattatcacaccacacatttatttttttaaaaaaacccaaactgttttaaataattaattaaaaaaatatagaaggaaaaggaaaggaaatcggagggaggaggggaggagaagcgaagcgaggaaggtcaagccggggagggcacgcacgcacagatccctcccctctcctcgctgcccatctctctctctctcttcccctcgacgcggcgagatcaggaggaggaggaggagaggggggaagggaggaagggaggctgagatcccgaggccccccaccggagacggcgaatcctggtccggcgcctggtttgcccccggattcgggaggagtttccgttcggggtcgagggatttcgggggcgcgcgcagccatgaacgagaaggcctccgtctccaaggagctcaacgccaagcacaagaaggttcgtatatcctcccgttccgttatatgtcgatttgttcggatcggaggctggccctttcgatttgggttggaaagctacggcagagtcgattcggcgtgcgatttcgtttgttgttaggtgagggagatttgggatccgcgatttcgtgggttcctgatctccccgctcctgaattgcgcgcggttgctttgcaactctttttgtggcgttaggaagagcgtggcgcagatcggaattcgcttcctttgttttgccgttattatgaatcggggagcgggcgcttttgctaatttaagcttgattatatggattttgtgaattgttcgactggtggaaatcgttatttgaaaaattgtttgtaattttatagtaggtatccttctcaatcgtggcaataaaaagttaaacaattcgcagtcaactgtacaagcaacctagctatcttcgttgctacaacatattgttaccattttgattttttcatgacccgctcaagcctcaacaatattaggtattgttcatgaagtaccctgtcttatttaccatgtttatggctcgtccttgatttccagatattggaaggcctcctgcggctgcctgagaatagagaatgtgcagactgcaagtcaaagtgagtgatcctgtgcaattggttctccaaaagatggctattgatgcattatacaagtttatgttttatcattagctttgctgctaagagtactttcacttgatgacgttgttttttatagaagttaacattctgattcattgtccgcttgctgatttgtgttgagcaagttctatggcatttggagggcctctagtaatctagaagcaattatttaagatatttattcttattgcttcatcactggtttgttgcatccaacatgttaaccatctattcctggaaatgaaaattttctgttctatttattgacttatatagtcagtatagttggttaaacctcctctccatcatgtctaatgttacctgtaaattcatctctgagcatgtaatgttagaactgataggtagacacttgcatgtgccatagttcttgtcaactgactgtttccccatttttcaggggtcctcgatgggcaagtgtaaatcttgggatctttatatgcatgcagtgttctggaattcatagaagcctcggggtacatatatctaaggtcagtgaattatgtgcatgagttcaactgtttattttcgaactcagtatgcccacttttttttttctccttcatacaagttctgacaaatttggcttgaaacacaacttgagtactttgaatgaccaacttttcatgaaaatttggtagctgctctatcagtgtcattttttttatagtatcaaagtatattatgcttgtttctttcagttcattgcatcctggctaatgtaagtttatataagattataaacataacataaattcaacatggtagaatggccatcaatccatcatatgcgaaaccggctgtttggtttggtgaccagagtttgccataccaaaccttaggcgtgctacactttaatagcctagagcctggtttgttacaactgtgacatgccacactttattagctcttttcacatgtcgtacactcaatttggtgcctaactttgccacacttgtggccaacgatttgttggccacactttgtgtggcaaaccacacctttggtagttgtggcaaagatagtcatcaaccaataagcttagctatctggattctgcaacaaccttgacttcgaagcttctgagctggctggcttatctttttcatgtactttgagaactcgtgctcacaattttttactggtcatcattgcaccaaattgtttgtgtatattacaaacagagaacgtgaaacagctatgtatctgttttatgtttaattctttgagatgcatttctttctttcatgtggcctcgccttcaaatctatatcaatagcatgcggtttttgtctatttaatgaaccatttttttccctgacgcaggtaagatcggctaccctggatacatggctgccagagcaagttgcatttattcaatgtatgtattactccctgaccagaaatttttaatatttgccatcaaacaaaggggtaatgcagttctcaatgatgattgtattcccgtcttcacttctttcagcaatggggaatgaaaagtcaaatagctactgggaagcggagctgccccctaactatgatagggttgggatagagaacttcatccgtgcaaagtaatgaacctctccaactttcagtacctataaatctagtacaatccatttgtcttgctataaatctagtacaccaatgtaaatcacctgcctatccaaggcctcccatccccccggcaagcaaacaaatacaaaaccaaaata

SEQ ID NO: 3179 - DNA, 2191 bp, Oryza sativa
  unsure (1)..(2191): unsure at all n locations
tgtgtgttatatgccttgcgcacaaactgtagatttccaaactgaaaaatgagaatgatcatgtgatagcgtgtatcatgctaatggatgatcatgtttatagttttgtttcttgtgcctgaccttgataacttgatgataattaatggtttcactttgcttacatgattgaaaacacattcttacaaccagtgatattttccacattaggttaataagtgttaagttaaagttggcacaatatccattgagtacttcaagtaatttggagacttaagttattattaagttttattttatacttgctgcattttgttgtgtaataatttattactagcttctaatagttttaatctggtacaactggtcaactgcattgaaatcaggcaccacatcagccaaaagcacaaccatcagttcccaaggtttcacctcctcaacccgagaaatcacctcctaatgcaacaccaccaaaggttgagaggccatcagttgcaccacctcctaaggttgactatgcaactgatctcttcaacatgttatcaatggatggaacaaccgagaaagaagcagagtcatcttctaatgatgatagtgcatgggagggcttccagtgtaagatattatgacttaacatttctattgaggaattattcttgttatatgagcatctttttatgaaatgttctgcgagtgcttcaccatattccttacttgcatactgtggagtatcttttaatttgggctcctgtgttctctttctcaattgttcagctgcagagccagtacctagctcagacaaaaaggattctgctaagccagtagaaagtaagccccagtctacatcaggcatagaggacttgtttaaagattcaccagctgtgacagtatcctcagctccagctgccccacaagtaaatgtgaagaatgatatcatgagtctgtttgagaaggtcagcgccagcattacttttactaatgcttttgtgaaatggctctgtcatttaaaagaaagagcacatctatnnnnnnnnnnnnnnnnnnnnnnnnnnnnnnnnnnnncagtatggtttcgccatatgctgtccagcagcagcaacttgcttttatgaccccccagcagcttgcccttccgtctcagcagnnnnnnnnnnnnnnnnnnnnnnnnnnnnnnnnnnnnnnnntgcccatgatcacgaattcatgactcgagaattgtacacacctcttactcaaaatccttggcctaatcttaattttggcataattttgcttttcttttttcacatagtgccctaatctattgtggagctatgatcgacgtcgatatgaacggtagacaacatcgtagtcgcgccgaccctcgagggaaagaacaccggcgagttgccaagcatcacacagcgaagatggttcctcgtaggtgtccggtaatacgatacgagggcaccacaacggcgaatgcgtatgtttcgacggggtacggagaagaaatctccgaacccctaagatgcgcctgggccatgaaccaattgggccgtttagtcaaaactggaccaatcaccggcccaccctagttgttcctctccataaaccagaagttgccgccgcccgccgccgacggcgatcgacgcgacacacgggtggagaggaatatacgagtacggtggcggccggcggcttcaggagttgttgatggaaaatgggagtattattttcgagagtataagtctgtagtttggttggaatacttgaaaattcgagagtgtttgggagaattaagggtccaattcccaccaatctcttacctagggaggtctgttaattcgtgagatttgaagggaattcaatgtgaaaccaaacaaaggatggagactatgccaaacatgccctacgagttttttttttctctctctcaatcatccagtttaatttgcccttaatcaaagcagggttttatgagctaatcacaccttaatcgacattgagcaattgtacaacggtgccacaaaaaaattcagtgacagaagaaccaaaccttaggttggttggtcggtcagtcagtcagtcactgcagcggcttgaagacctgagagtgcggcgagacgacggcctcctgcaccatcctcctggggtcgccggggtcgcgcacccacttcacctcgctcatgttgggcgtctcgacgaacag

SEQ ID NO: 3180 - DNA, 707 bp, Oryza sativa
  unsure (1)..(707): unsure at all n locations
nnnnnnnnnnnnnnnnnnnnnnnnnnnnnnnnnnnnnnnnnnnnnnnnnnnnnnnnnnnnnncgccgttaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggaaaattcgctcccacagggagttgaacccaggacctcatgtactactgaggctcttgtaaccactaggctacaagccctttcacgggtatagccatttatatttgtaggaatatggcggttctgtttgttttatggatatatgaccatccggataggaacggatagagtaaaatcaataacatattaatcaatgataaatatgttaattatcatcaatatagtcatatctatactaattaacaataaaatggactaattatataatcaacactaattttgacaagtcaattactccatacgcttcaaaatataagaaatctataactggatgagatattaatcatttactaatgattaagattaccaaatgtggatatcctcatccggtcaatttaacccactcatctagtatcttcgtgaaacattttctctttagaccacccaatccattcttacccatcaaccaaacatatttaaaaactggatcgtcatat

SEQ ID NO: 3181 - DNA, 816 bp, Oryza sativa
  unsure (1)..(816): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttatttatcttcttaaaatatatttacagctgacttatagcctactattgtacctgctctgcctactcatcctcatatcctttccttccttcgactacagggaattagtagaagatgggtcggtctgacacgtaaacacgggtacattaagttttttggcccatgtagtatttgctgacaacgacaagttgccaatcctgccatcgatcggggcattgtacaaagtctcgaatactacaggaaaagtaagttccatgacatcgaggtttaaaagttcaaatttataccatcaacagagcagatcagagtacatttaaaacatttctgagaataaagcagtttaagcggcagcagcgacggcaaggaatcacggcgctgatcccccaacgccggcgaccggtcgattcctgaagccgccggccgccaccgtactcgtatattcctctccacccgtgtgtcgcgtcgatcgccgtcggcggcgggcggcggcaacttctggtttatggagaggaacaactagggtgggccggtgattggtccagtttcgactaaacggcccaattggttcatggcccaggcgcatcttaggggttcggagatttcttctccgtaccccgtcgaaacatacgcattcgccgttgtggtgccctcgtatcgtattaccggacacctacgaggaatcatcttcgctgtgtgatgcttggcaactcgcc

SEQ ID NO: 3182 - DNA, 725 bp, Oryza sativa
  unsure (1)..(725): unsure at all n locations
nnnnnnnnnnnnnnnnnnnnnnnnnnnnnnnnnnnnnnattcgtgtgtttggtgttcgtggtgaagcttgtgttggcgcataggacgaagcagcggcatgttgagtcttctgggcattctatcgaacaccttgaggtcgtcccaatactgacacaacttctcaattaatttttagatacatggaaacagtaggcttacccctttatgcgccatgggtgacgcgattcgtcgaccagcaacggcgacgacgcagacctcccaagtcccgaacccctacgaagagagaccaccaggcgttggattgaaccgtcgaagaagacgagaagatctgcaggattggggagaagctaactagctaagccagtgggcttgcctgggccgtggcctccatgggcgtcgcggtcgagctgaggaggacgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3183 - DNA, 2265 bp, Oryza sativa
  unsure (1)..(2265): unsure at all n locations
ccatcttcgatgctgggtgttcccaacccttctccctcatattctgcgggcacacttttaaactgctaaacggtgtgttttttttgcaaaaagtttatatacgaaagttgcttaaaaaaatcatattgatccattttcgaaaaaaaatacttcctccgtttcacaatataagtcattctagcatttcccacattcatattggtgttaatgaatctgaatagatatatatgtctagattcattaacatcaatataaatatggaaaatgctagaatgacttacattatgaaacggagggagtacctaatacttaattaatcacacgctaatagaccgctctgtttttcgtgcgcaggagatttgttctcaactgcccacaacgaacacagcctttgacatgaagttggagtttaatttgatgcattctcctaattgtttcccctctttagatatgtgatagatttgtcatttgcacatggaaagctaggtagcagatagatttttggtgggccatgcattcttgccaatcccacattgataattgatggtggggaagcacaacttaaaagatagtctcatccattagacaagtcttttgggttgtatagtcttaagacctaaaattgtggcctcagtcgagcctgtggaggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatctttttccaccaaaacttttaccatttaccatttgctattccaaatgaatcaaaacggacccttagcaaaaattatgtaccgcctaatcatacttgtcaggcggcagctgcaaatcgaacaataaatatcccgccttgctgaccaggcaaaaaagtagggggctggttggttgctgccctcgcctggagaccattggtcaagcaggtcgatccgaccgcaggcgaccgaaacggacgcctgagatcgacgcctgagccaggcgcgaatctgagggcagcaagcaaacgcgccctagaactcatctgtaggcataaaaaaaatctcaggtatgctgttcaggataccatggtcaggcggcagctgcaaatcgaacaaataaatatcccggctgcgcaaaaaataagggggtatctgggagagaggggctaaactctcaaaaacataagtccttcccataggaacttatatttttgtgagagagactaaattgtttagccgcactttagtccctccaaccaaacaccaaataaaagctatctgtcaggcatgaagaaaagtgtcaggcatgggtgtcactgttcaagtgttcagggtaccatgatcacacaaaaaatagaactcatcggagaactgtcaagcatgaaaataaataccaggcatggtattcaggataccaaccaaacagacccttgatgccagcatgatcgaagcatggaactggcctgttgggcttgcttttaagtgnttgagatcaatgcccattaaaacgccttgtggtcacgtggagcgctgctctccctccttggcgggcacgccaagcttagcacgcaccgtaaagtccaaatttgaccagtcaacaagtcaaagaaaggcacaactccaccttatcatctccactatataaaattcattttcgatcgatcgatcgctcactcacccacttgtctcacactctcactgagctcctctgcttctcgcatccatggccgccgccgccacgggccctgtccccttcaaggacgccgacgacgacggcacgctcgccgccgccgaggcgcgctcgcctctcccgaaggaggagttcggcgacctcgtcgcggcgctgccgcggaaggagcagtacctcgacgggcggctctacgaggggttctggctgccggagcactacgcgccggggatcatcgcgttccgccgccgattaacgccgcgcgccgacgacgtggtccttgccagctaccccaagtgcggcaccacgtgggttaaggcgctggcctttgccgc

SEQ ID NO: 3184 - DNA, 1039 bp, Oryza sativa
  unsure (1)..(1039): unsure at all n locations
nnnnnnnnnnnnnnnnnnnnnnnnnnnnnnnnnnnnnnnnnnnccatagcaaagtggaacccacatgtcaatgacccaactgcatgtcttaggatctgcttccgtgtgcttcatttcattgcgattttgctgctgtttcggacatttttgtttggcatcgttgtttttatttgtgattacccacttttctcggttccaatcatggaacggagatgtgacgaaaggcgcatcgaataaagaaatgagagtgattcgggcttgatcatcatccacttgattttgtgagcatcatgatacaaattattaaatgaaatgatgtattttgtacgaaaaactttaaaatataagataaatctatttctgagtttaaaacaattcaaacttcgagttatgaaattagtttttttattcgtgtccgaaaaccccttccgatatccggtcaaacgtctgatgtgacacccaaaaattttcttttccccaactaaactaaataaggtcttattttgtttgggctatttattgatttgggccgagtttgtttgttcgttttggacttttttgtgtgggccatgtgttctgcatttgcccaagtcaaagccatgaaaagatccaaaagagatggtggttttgatgaaacaagcagagtaagaaaacgagattgatcaaaaaaacaatcacacacaaaaaaagataaatcagaaacacagcatgagcgaaatacactactagaaaaataattttttatggtgttggtcaataattttcgctggcggaaaaataccaaaaccgccagcatggtcgtaacgagggggtgaggggtaccatgttatatcggccgccaacgaagatatgttcattttcactggcggtcacttagatgagccgctaacaaaaatggataatttttgctggcagttgggtaaatagtccggtagcaagttacaattatttttgctggcggcccacttaatcaaccgccagccaaaattgatttacactggcgctcttaaaaaaattcgcacataaaaaaatcaccggg

SEQ ID NO: 3185 - DNA, 1441 bp, Oryza sativa
caaagtgacccttaccaccacttatgcgacgacagacggcgagggagatggcaggcgacaagctccaaaggcggtgaccttgggttgacgatggcgacggctttccggcgacgagaggcaacaaccgagggcggacggtcttcacctcgctcctgcgatcccgagggtggtgacggtgaatgaaggcggcgatggacggcgacgaacggcgcggctgaagatggaacggatcggcttcacggtgacgacgggcttcccggggtcttcgacgacggggaagtggaggccggtcttcttctcctcctcgcgaacccaacggcgggagcggcgaccgaaggcgacgaccacagcgacggcgcggggctgctggagcggcgccggcgaaccacgatacgacctcgccggagatagagcggccggctgcggatttggagggcatgcacacgtagaggacgacgaggcgaacccaacggtactcaccacaacgacaatcgacgtccgacgacggccggcgacgagaggaggcggcggcggcttggaccttaccgacgacggcgagctacggcggccggcggcgaagaaggacgggcggccgggcttctccaccccttggcgcacctcttggcgacggcggcaagcggcggcgacggcagaagcggcgcggcggcgcggctgcactcggccggcggcggcgacgaactaaacgcgcgcgccgacgaggctacgaggcactagagagctcgggagagggggcaaacgaaagaggaggactagggggtcctatttatagccttggaagctcgggtccgggcccaaaacgacgggaaaaactcgggaaagtttatcttcgccggaaaaaggaaaggatttgatccgcgaaattggaaaggatttccatataaaattttggggatttcttggggaaaaggaagaggagaataagaggaatatttcccctcaactaatttggaaagaggagcaacgaggaggccggatttggtggaagaaggcggcactgtgcacaggctcggctggctcgggctctgtccagagctggaagatgaacagtgccagggaggcaaactagacttttttcggttggctgagaacagaacagagcacttgacttgggccggcttgggctgcacagcacgcgcgcaagggagagagaagaggaaggaatgggccgaaaatggcccaagcggaggaggaggatttttattactttcccaattaaaataatcacttaaatgatctttgaattgttaaaaatacttccaatgctcaaataatttcaagaaaaatcatgaaaatacttggacactcaaagtatttaacaatattaaaaccagaccatttaatgattaatttaatatgtggattattactgaaatgttctttgtatgattaaaaattaggaattgagctccgaaaaatttga

SEQ ID NO: 3186 - DNA, 1087 bp, Oryza sativa
  unsure (1)..(1087): unsure at all n locations
aactcctacattcagatctttgtgaaatgaatggggtgttgacgaagggtggaaaacgatatttcatgacattgattgatgatgctactagattttgctatgtgtacttgttaaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaatcgcacactgactgacttggtgaatgccatgttggacgccgcgggactgcttaaggcatggtggggggaggcattngttgacctcaaatcatgtgttaaatagagttcctaacagaaataaggacaaaacaccatatgagatatggattggtagaaaaccatcactttcttatttgcgcacatgggggtgcttggcgacagtcaatgtaccaataacgaagaagcgcaaacttggacctaagactgtggactgtgtttttctgggatatgctcatcacaagcattgcctatagatttttaatagttaaatccgaggtaccgnacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtaacagagcgaccctatgggtgtaaacctgtggggtgcaagtgggtgttcaagaagaagcttaggcctgacggtactattgaa

SEQ ID NO: 3187 - DNA, 599 bp, Oryza sativa
  unsure (1)..(599): unsure at all n locations
nnnnnnnnnnnnnnnnnnnnnnnnnnnnnnnnnnnnnnnnnnnnnnnnnnnnnnncggatcctcggccccagggcctcctgcatctccttcaaggactccgcctgccgctgcttcggctacatggtctccaagaagaagtacatctacaccatcgacgacgactgcttcgtgagcttctttcccccttccacccctcgattaacttcgcctcagtgagatctgtctctgttaaggtttgatctgctggttgatggccgctggatcttgggcgatctttctccactgccatggcgtgatctgtgtgcggggattttagatcttggtttggtggggatcggatctggatgtgtagttttagtgggggaaaggcgagatctctgggctgtttcttcgtcagcaatcggcattgccccgtagttagatttttgagtttagcttcagttttgcgagattagtagttctttttgttaggacagtttagtttagtagtgataaaaaaaccctttaatttttgcattacatcatactactactattactactgcatagtgctgtgatgtgggtaggttgaatgtgaatttcacatgggtaccgagct

SEQ ID NO: 3188 - DNA, 455 bp, Oryza sativa
aaaaaaggacctgcactactgattgttactgtatctgatctggcaagcgcaacagagccatgttaatattgtgctgagaaatggacgaaggtgatataggttcgcgctgatgaatattcttacaatctgctatcttcctgtctgcaggaaaagtcacttaaaaaccataataatgttctgcaaaaggtaaatttcattcttgtttacaacaatgttttatatcagatcactacaaaagctgtattggaggtcaaacccttttgtctacattcttctgagcagctcatggagacagaaaaggagaaaaacaatgctataataaacactaaccgggaggagcaaaatggagcaacaccaagcacatcattcaccaacaccagtgacggctccagatcccatcccgacaacaaataacaggtaccgcttttacttccatatattttgcccctgcactc

SEQ ID NO: 3189 - DNA, 573 bp, Oryza sativa
agcttcttcccccaaagcaaatgccatgtgtattcacatggggcacatgagccacaagggtcccacctgcttgttaaattatttgatttatatgttttattaggctggcttatggatgcatggatgtactgtagaatcaaccttaactatatgaatggtcctcagttgtttacagcataagaatatatcatgttctctttcatgtcctttagttgcattctagtatgatcttcacaatagttttcttgattagcttacagttgactgagtacttccacatgccttgcactataaaagttgagcattggagtgtgatgccattattttagtcctctgttttgttacttttgggtaatgctaatacttctctgattccgccctatcatttgtttttggttcattgctgacctattcctcttgcaaaatctcaggttgctaaagacccatcaggaaaagatatcaatgcacttgagcagcacatcaagaaccttctgaacccttccactccatttttcttcaacactttgtatgacccgtaccgtgatggcgctgattttgtccgggggtacccct

SEQ ID NO: 3190 - DNA, 386 bp, Oryza sativa
ccagctagttaaataaacagccggagatagttctccaacagtcagggatgtttttttacctggtcctcagtatttggctccagtacggctctttcatcaaacgagtaacgctggtagcgttcaaggatcccttccatactacagaagaagtatcacatgattatgctttggtttgaccaatgcatcaaaagatgatgccaagcatagtcttagagcaatatcaaacaaatgcacagttataatttttgtaccctcaataattcttaaggcttgtcaggtgacaactacaaaagtaggatccattattcaaattacccatgtataaatttaaatcataactgcggacaaaaattatgcatcagaaatagcactttgaaaaacatttg

SEQ ID NO: 3191 - DNA, 680 bp, Oryza sativa
ttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaagtttttaattcggattcagctctcctaacaccatcaatttcaaacggatctagccgctcatatagaaggaatctcgggggtccatgtcacgccccgaactagtcccgaccggaactagcccgtgacgttccaaattaacctgttaatcgataccagtcccaggaaacagtgctggtatcacagggagacagaatatcatagcatcagaggtctctttattatagagtagaggtacagtcatgttgggctgcggacagatcccgagctcacaactgcattacaaaagggaaacggaagccaggacttggccaatcaacacaggcgcgacttgggaactaggccgaaaccctaaaactcatcgtagccggcttgctcctggaagaactcctcatcagcagcttccgcttcatcttcttcagcaacttggggggggtcatttatatagagcaagggtgagtacgggagtactcagcaagccatgggaaataagtgtttaatgcaggcttcaaggaaagg

SEQ ID NO: 3192 - DNA, 262 bp, Oryza sativa
ggcgtggagcatagtggtggatagtacagtcacggggctgagggtggcgaggacgcggccattctcgtggcccgttttcttcctttcgacgggcaaccttccacggcagtctcgatctccggcgccgccgctccggccctcgcccgcacgccgatgtcgccgctccagtgccactcccaggtcttcgcccccgctggccaccgtcccacactcgcggagagaaagagagaggggaggatatgatttatgtgggccccacatg

SEQ ID NO: 3193 - DNA, 1267 bp, Oryza sativa
ttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaagaggtgcgggtgggtgccttcaactcatcttctctttcccaagtggcctcttcctctgagtggtggctccactgaaccttgcagaatcttattactttgtttctggtccttctctcgctggtttcgaggatacgagtcggcttctccatatacgtcaagtcttcctggattttgatttgatccggacttgcctgttcctcaagaactctcaaacatttcttcaactgagagacgtggaacacgttgtggatgccaagcatgttggagggaagctcgagctggtaagcaacttcacctttacgttccaagatcctgtatggtcccacaaagcgtggtgccaactttcctttggtttggaaacggtgtactcctctgagcggagtgacacgaagatacacataatcccctgtttcgaaagcgagctcccttcggcgggtggctgcatagcttttctgccgagactgcgcgattctcaatctttccctgacagctctgacttctcttctgcctcattgaaaacttctgtaccaaacaactggcgttcccctgtctgatcccagaagagcggagtacgacaccttcgtccatacagtgcttcaaatggtgccatctgcagactagcttggtaactgttgttgtactagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcctaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttct

SEQ ID NO: 3194 - DNA, 5885 bp, Oryza sativa
  unsure (1)..(5885): unsure at all n locations
nnnnnnnnnnnnnnnnnnnnnnnnnnnnnnnnnnnnnnnnnnnnnatgcagtgccgccaaatctttaaagcatgtatttttgtggtcaattccagaacgtgcgtggggtggttgccttcatggggacgcaactgccgtgaagcataagaaaccactttgccatcctgcatcaacacacattctagcccctggggagatgcatcacaatagacctggaaatctttcgtctgatcaggcaggattaagactggtgcagacaccaaccgccgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaactttcttaagccagaagtcgcacttgctgaacttggcatatagctggtgctcttttaacttttcaagtaccagccgaagatgctgctcatgttcttcctcggacttggagtagataagtatgtcatcgatgaaaaccacaacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacacagtagctcctttcagctgatcgaacagatcatcaatccttggcaaagggtacttgttcttaatagtgacctcattgagtgcgcggtagtcaacgcacatcctcttggttttgtctttcttctccacaaagataaccggagcaccccaaggcgacgtgctcggacggatgtatcccttctataactgttcatcgacttgcttcttgacttccgccaactcgctggctcccattctgtaaggcctcttgtggatcggtgcagttccagttaccaagtctatccggaactcgatatccctttttggtggcattgttgtcagatcgtccggaaaaacctctggatactctctgactataggaatatcctctagtttcttagtggttttctccactgctacctcttgttcttcaccagcagcctggtttaaactaatcctggcttctgcggcactggagactggaagattaccacctctccttttgcattggtcaacttgatggtgcggctggcgcaatcaatcactcctctgtgccttgccaaccaatccattccaagtatgacatttaggtccttggattcgataagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactatcactatggtgggtcttattgaagctacccgggtggtagggacggtgctgtcggataatcatggtggaaggtccaccgtgacgtcccatcgtgtaacgaggcttctgacacttccctggggagtcctgaactgggctgccttcctcttacggttcattttgttacactgctcctcttgacgaatagccttgtccacaagcttctcaaagtcctcatagtctctagagatcaactggttggtcaattcatcatcaagaccagacataaacttctcctgcttctcggcatcggttcgcacgtcctcaggggcgtagcgcgcgaggcggttaaactcatgcaaatactctataactgttctggtttcttgttgcagggaacggaactctctcttcttttgtcccacaattccctcgggaacctgtgctttattgaaactatgacgaaactctgtccaagtaacctctgccccagccggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgcagctgtgcttgctgctgcacctgctgcatcacctgatggtactgttgctgcatctgttgcatcatcattgtcattatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccgaattaaacaaagcaaaagaagactcaaataaataaccgagcacgatgatttttatgcatagaacatttttcatgaactcaaataaagacactaatgcaactaaacaataaattaatgcatagactagttgcatggaaaatgatgcgcataacattgcccccatcgaatatagacaccacctaatgcataacccccaataaattcccgactgactgtcgaataaactgcaactaaaatttttctaaagccctagattgagctaattttttttttttaaaaaaaaaaaatccgatccgaaagaacgaccaagatttttcccgcaaaccaaagaggccaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccgatccttaactgccatgggtgcgaccagcataaccatgcacccacagcccaccattcagtgtattttaattaactaacaccattgcggtggcaccaatctaaagctataccaatagacaaagtctatgtaataaggtgatccccatttgtgtgctagttgaactaagcatggctaagcatttcctaaaccaacatctagtcattttgatacccaagttatcaatggcataaggtaaacaataaatggctgagtattaggacccatcccacatgacattgtaaaaggatgcaacatttaatagaaatgcgggatatttgtaaattgggtacaatatgatcaaacgtattgcatgacttgccttgctctcgcactgatgagatcacagcaacgtcttcgagaaactgcggatcgacgaaacggccgaaatctacgcgacaaacaaagcacacaagcaaaacaggctataagactactgaagcaggaaacaaaactatttttaatggattctttgcatttttcttgatttactgagacttgaatggacttaaacggagctcggatgaattacttatgaattttagaagataaactgtgtttttactaataaagaaaagtccttaattaattattgcgcaatattgccccagggctgacgtcatccaaggggggggggcggcgccgacatgcgggccccactggcagcggcacaaggggagagggagggggcggctggcaagtgggccccaccaggcggtggctcaaaggggaggcgagggaggcgccggccgggctcggctcggcctcaaagccgaccggcggccatggcgaccggcggcgacacgcgcggtcaccggcggtgaccggcggcgcgggagacggcggcggccagtgcgaaggcgggcggcggcggccgaagatgacggcacacgcgcggagggcggcggcgctcatgggagggagggaaggaaggaggaggagaggggattcctcaccggcgaacacggcggccggcgcgaaggaagaaacggcggcgacgaccggtgatgccgaggcgcgaacgggcggcggcggcaccctaggagagagcatagaggggttagggaagggaaggcgaccatggcggcttgaattgccggccggagacggaggggagagagggtctcaccggcgcgcgaggagaaaagggctccggcggtgattcgcggcaatgaaacggcggccgaagtgcgggcgggctcggtgagc

SEQ ID NO: 3195 - DNA, 1309 bp, Oryza sativa
  unsure (1)..(1309): unsure at all n locations
nnnnnnnnnnnnnnnnnnnnnnnnnnnnnnnnnnnnntcccccaccacttgcgggcgcgcgcgcgcggtttatgtggggggggggggagagcggcgacgtgggcgctaggtgcgggcgcggagagggacggagaaggcgggcggcgtggggaggtggggccgccggcggttggggctcggctccaaccggctagaggaggaagacgaccgacaggtgggccccacctgtcggcgcccgaaggagagagggagggagggagaacttcggggaggggaaaggggaacgggccggcccacaaggggaggccgagcgcgggcgacgggtggactgggccgacggcccaagaagaggaaaaaggaggaaaaaggaaaaacaaaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacagcccgaagacccgcagtgcgaggatttcgaggatcaagctccagatctcgagcaaggcaagctacctttgaacatcttgagcctatatttgaaatttaattatgttgcttaaaaatattatgcattgataggatcgcacttaatctgtttgtcccgtctgcaaggcagattggcggacctatctaatttgttgtatttgatccttcttttgttaattgttataccatgtccccttgtaccatctagttgcgtctcgatattcgtgcaccctgtgcgagtatcgacggacgccttcaaacttaaaatctgaataacaacttgcgtaaaacttgggttttacaaaagatttggaaaacccgacacctgggtcggtgcttgcgaactaaatgaatttccaaacccgcggaccggggaacgtccgggtgtacggtttcccgctctcgcacttaaggaccgatttccttggaatttcatccaaacataagacaagtacgaccacatgggtggaatgggacacccttggctgagtaactagcttatcaggggagccttgatgccgagagacatgtggattcgccggggtggtgtcggggaggacccctgggcttcttggcacagtatggtctgggacctaacctgttgttggtttgggactcctc

SEQ ID NO: 3196 - DNA, 512 bp, Oryza sativa
caaatgacatgttattccaggaaaacctgcttgacctgcctttcgtctgtactacaactgtctcgctgttgcttttctaagctaaactgttgacatgcttaacaggtgtaccttagaatcgaacctgtcgacctgagattggggtgactctgctgacaccttgcaactggcttcttcaagtactacccggattggtgcactgggttgaaccttcaactaaaacagcgacgaagtgagccaaaactcatcttcgagacctaccccccttacatggagtagtcttactttctcctgactaggaacaattggactattgtccttgaaaaataaccaacacttctcttgcttacaaaagccctcactttgaaaactgaaacttcaccgattcatcaaaatagagtaatgacggcgcactttcatcccagcaagatttggaacttaatctcagttgctgatgggagattcacataaaagtgactctcatttagctcatgaacacactgactcttgac

SEQ ID NO: 3197 - DNA, 999 bp, Oryza sativa
  unsure (1)..(999): unsure at all n locations
aaaaaccgtttgacaaagaaatgccgaagggcgagaggagacatttttcaaatagggctttcttaaagcttgtccttagggtttgaccgtttggtttcacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaaattagatctccactgatcaacgctacaccacgttgaacaggcccaaccaacccacctgtactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataacccttccctaaacatccacaccacgctaagggttcacccccacccctcaaaaggcagtgggcggtcccctcttgcgccgcggtgaatccggcagctggacaaccggacaccccggncgaaccaacttcatta

SEQ ID NO: 3198 - DNA, 1311 bp, Oryza sativa
  unsure (1)..(1311): unsure at all n locations
atatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagttcataaaaactaaacaaacatgtagagctcaattttagatgaattttgcaagttgaataggctcaattttcagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgnagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagagaaaaaggaggagggaggcggctcaccgagaggcgcggcgacggagggagcggccgcggagggaggcggcggcgctccttgggtcgacgacgcggagggacgcacggcggtggatggcgagggcgaggaggcagacgaggtgcaacacacgacgacgaagccgacaaaggtgacggcaagcggcgaccgcggctatggcggtgatgattgccggccggaaacggtgaatggatgtggtggctcgggtgtgtggtggaaaggtggtttcggtggtggcgagggagagaaaaacggtggccgagcttgggcttgtggcgacgaagccggcggtgggacggagcagtgctgcggcggttctagcgacgggaggcggcagccggcgctcacaaaggcaatggcggctcgggttggcagtggaggtggcagcccggtggtggattgggggagtgtagcggtggacgacgtgcggcgtggagtggtgatgccgacggcatgggttgcgcggcgcggcggtggcgctagcagcgacgaggtgcggctggaggcgacgaatgggtcggcggcctcggg

SEQ ID NO: 3199 - DNA, 914 bp, Oryza sativa
gatcggatgtcggaaaatgttttcagacacgaatgaaaaaactaatttcataacttgtctagaaaccgcgagacaaatttattaagcctaattaatccaccagtagcacacgtgagttactgtaacacttatggctaatcatgactaattaggtttaaaagattcgtctcgtgatttccatgcaaactgtgcaattagttttcgttttatctatagttaatgctacatgtatgtgtccaaagattcaatgtgatattttttgaaaaaaaaggggaactaaacaaggccttacttagcttcccaaggtaagcagcttgtgcgctactccctctataaaaaaaaacccaatctagaaggagatacatcccctcctaagagcaagtttaatagtatagccaactaatagttccaaataatctataatcaattttatagccaatatatataatagttacctataaacatatactatactattgatacatgatcccacctgtaatacatatattgcgtccattctatgctgcagcgggctataaattatagcctactgctcttcactttcttctttttatctatatatggggttagagttggcttatagattggtattgtatctattttaatacaacaaatttggataaagaactggccagaattccaaatttattattctatatgagaggctacatgttggtttattttaaaggacggagggattatatatggagtacatacgtatccatcttggtcgccgatatcgcgcgcgcctcatcttttgcaacttccaagtggtaagcaacagaaaccgaggccgagccagtgcagagggatcggggatcgccatggttgccgtgggatacatccggggagccatcgcctccgtggccgtcggcgcggcggtgagcctgctt

SEQ ID NO: 3200 - DNA, 1412 bp, Oryza sativa
ctgattcaaaacgatcatctgggatacattattgaggaacccaagctgcaggtaagctctctcacattcccaaattccatttttctctttttcaagttctctgcaaaccctaatatttaatcccctctctctctctcaccggtactgcaggtggcatcaacagtggatatggaggcaactccgtacttgctcttggttacagtacccatcctggtgcacacacgcgcactagctttctctccggcgttgagtgattgtagatgtagtatgtggcgatgcccctgttcctgaccattctgaaagctatcgctctgaggaagcattgctactgttaggtggtgtgaggaagcaagaagaataattttgataagaatcattgctactgcttagtggtgttacaaagcaacaattggcagtaccaactaccaagcaataacaacaaatctgacgcacatttgatttgcacatattttcagaaatattcagaatgtttgccattctgaattttgagcggactgcacatttttctttcttcttacatggtaaaaatgttcacccagattgaattgaatgtaatatctctcaaattcttgaaatctgaatgcaaaaggttatgatggcttgctgatatgaatgtaaaaaaatttgctggtttttccatcgaagtctctgtgtgaaaattatcaataccaggtttaattatgtgaacatgcatagtaaaattttcagtgcttgctgaagcatatcaataatgagaaatgcacttgtacatatataaggagatacattaaaatcaagcaagctgtcctgatcaactaatagttttcctgctactgcagatgcctcccatattctcttgctaccatcttcattcaactattcttcagcacctgaccaagtagtatctctagaaatagtaaatcaagttagaccatggaagccaagaacattgcatagctcctataccattcccttgaaaaaaaagaatataacaatatccagtatccagtacatgtgtatgcttgtaagaaaaaatatcatataggagaagacataaggtcttgttcaaggattacctcataggaaggacatgaagctccttcccaatcaccgttttcacctatggcaagaggaaatgcaggagaacgaacaagttcaacaaagagaatcgcaagagtcatggattagtgcgctcggaggacacacgatctgatagatgaggggataggaaaaccaatcgtgaggggggtttttgcaaaatgccagggcaagaggcgggcgctttttttgcaaaattacctcacctgaacactagcctttggatctagattggaggggcctgattgtgtgtgtgcatgagtgcaccagattcgtgaattttttttaaaaataatattattttaatggaaaat

SEQ ID NO: 3201 - DNA, 796 bp, Oryza sativa
  unsure (1)..(796): unsure at all n locations
agccagacatgaagaagacaggggcctacctttttgagagtactgccactgcacatgctcaccgggatgtggcatacaagcattatgtcaatgagatggactgctgcaagcctcacatgtaagtacttccaatatcacttctagtagacaattacttctttaattgagatactaaccaacgacatctcttcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcgggaagaaacaagattggccggttgaggacatctcaactggagttgaattacacaagtaaatatttcttatctttgtttgctttcattgtcaatgttcaattttgtaccatttaacccttgtcgatgctcactactatttcatcaccttctacttgtctaggtatgacagggtgagaacaaagaaggtgaaagactgggggctagagcataatagatacattgatgaatggagaacagccggaaggaacgataggtacatcgaaactatacaccaaaatcatcttttctcagagtaccttcgttggctgcataggacatatagactgttcctccgccctacttgaacgaaagccgacatagaggatgaccgcgactccgatgagnnnnnnnnnnnnnnnnnnnnnnnnnnnnnnnnnnnnnnnnnnnnnnnnnnnnnnnnn

SEQ ID NO: 3202 - DNA, 718 bp, Oryza sativa
  unsure (1)..(718): unsure at all n locations
gctcggtacccaacgtggaaaactctcctaaaacaggagagaaaaaaaccacggttgccagtcagtaaagatctttactatattatgtgagattacaatactgaacagcggcttacaggaagtatatatataggtgaaaccctaaaaggataacgttctgtatcgcttcgctccggcccaagcctctagcgacgggcctccgcttcgctccatccgaagttggtgtttatatgtgtgtaaatgaatttgtatcacaactcaccagcgaggacccctgtgcgcagcatgaggcccatagcaccactacaccttcgccgccattgtcgtcatggcgagaaaagcccagacctccgctgtcgtacgtcgccgcgtgaagcccagacgtcccatctgccgctgtcgtcgtttcctgaagctccactgcagtgtcgtcgtcgcgctagatttggccatcgctatcgcaccgaagccaccgactgctgcttgctagattcggcgttgtgcgcgcgaagacgccgcggacgcttagctaggatgttgattcgctgagttccggtcacgcggcctgcctttccgcacgaagcacgcaacaggtcagcaggtattgtcttcgatggaatcagataactttgtacagtctgcagttgtgccactgnnnnnnnnnnnnnnnnnnnnnnnnnnnnnnnnnnnnnnnnnnnnnnnnnnnnnnnnnnnnnna

SEQ ID NO: 3203 - DNA, 710 bp, Oryza sativa
ctgtaaattccaaagaaataaatcaactcgattgcattccaactgggacaaaaactatgtatgccgatgctcacctacaactgaaaacatgaacaagcttaaatcaggcgttgtctggtacaaatctgggcctgaaaatccacctagagatggcgttggtcgtagcactgtcggatgatttaggggcagttcagtttcggagaagtgatgtaaaaattctcatcacctgagtactgacgagtgacgacgaggttcagtctgtttggttgttcagtttcagataaatgctgatttgctgccgcgacgacatagcactacgtgcttgcagcgtgaggtgagatcactatatcaagctggctgttcattcttgtgaaaactgtgcagcatttgtgtacaatcactgccatttctccatgatttcaagtaggagaggacagtcatcgtgcattcgtcgtcagaaccacaaacagaagcttagtcagtacaatcactgttgctatgtaaactgaagattctcaattatgtagcattgtaggtactagatcagtagatgattgccattactcccgacaagtccttgatgtaagctgttactaggtcagtatatacagatcaccaaatcacaatgctaatttccatttcaacgtttcttctacttgaattattcatcatcttacatcaaaaggtaaagcttttgtgtgttcgtgaaa

SEQ ID NO: 3204 - DNA, 671 bp, Oryza sativa
atggtgcccgggcaccattgttgaaattgagtatatacccaattcaaatgagaatgaaactttttcaattacttaggtattaacattaactactttactaactagtttaaagcaagtttgaactgaatttgaacttgtttttgttagattttgattctaggtatatagcatccatacatataatttgttaggtatgtaatcatggattgtgaaataaagttaaatttgagttgttttgttgataagtataggtataaatcaaattattataactaggtatatactcacaatttgaaaattttgaaaaatttgagtgattttgtgcattagataccatggtgcccgggcaccatggtgccccatatgagtgtcctatatatatatatatatatatatatatgtggaagagtccatcttctattatatatattcatatgtgtactgcacattcatgggaagttctctacttctcttccttttaaacactggaagtaaataaataaaaaataatttcctagaactgccaacaacaaagtcgttgtagtatagtggtgagtattcccgcctgtcacgcgggtgacccgggttcgatccccgggaacggcgaattagtttttaatttttttggcacttgaaatgcaagatgcatttgtattttaaatgacgaaata

SEQ ID NO: 3205 - DNA, 667 bp, Oryza sativa
ggtgagaatgggataacactcttgcagtcccattatgtggagaagatcttgaatcgctttggctacattgatagtaagccttctccaacaccttatgatcctagcttgttgcttcgcaagaacaagagaaattgctaggaatcaactggaatactcccaaatcattggctcgttgatgtacctggctagtgcaactaggcctgatatctcctttgctgtaagcaagttgagccgatttacctctaatccgggaaatgatcactggcgtgcgcttaagcgagtaatgcgctatctaaaaggtactgtggaattggggcttcactattctgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatgaaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaaga

SEQ ID NO: 3206 - DNA, 543 bp, Oryza sativa
caaaaatggactgttgccagcagcccatgtacataaccgccaacgaaaatatgttttttggctggcggttaagttccgaatgtgaaaacgtttattttctctaccctttggtttcagggggttaacctaactgccagcaaaaatcagcaaagactgattttggccgacagaaaaaaccattttttagtagtgagtaaggctggcaaaaatcaaagactgattttggccgacagaaaaaccattttttagtagtgagtaaggcttcgtttgagaggcaggttgcatgttctcgtataactagaacaaccattagagcatgattattagccattataaacttaaaaagtagagttctttgattttttttaaaaaatatgtaaatatttttttttcacaaaacacaatgtttaactatttggaaagtatgataacggaaaataagaaaattgtcattattgctgaaaagaactcaaactaattccccttatacatttttcatttcaacagaaagcacatactaatacaactactcatcagtttttg

SEQ ID NO: 3207 - DNA, 700 bp, Oryza sativa
  unsure (1)..(700): unsure at all n locations
nnnnnnnnnnnnnnnnnnnnnnnnnnnnnnnnnnnnnnnnnnnnnnnnnnncgtattgcacacgtacgctcttgtcgatcaggcgtttcatactttcatttgccttgcttttggacagttaatttattattagtaccactagtagatcaacttggatgatttcttttgctggtgtaccaccaagatgttcagttagtaacagtaccaaattaggcattcatgcacgtgaggacatcgtcgttgtcgatttattttatcagtttcgacatgcgttgctgaggctcagctcgaggtagattggtggcgacactggctgacacggcggcagctacaacggctacttaggcccctatttagtgctcctactaattgtttactcctttcaaaaggggcaccacgttacagtagccgttatcggttagtgctgttgattacttgattagtcaattagtgttgcgtttaacagttgcttaatggaataatggttggtgctcagtgtccagtgtgccgccagaaactgagaaaagcttcgggctttaggctctgttcgttctgaggagataatagggagattgattctcggtttccgcgtgcacgctttttaaactactaaacgggccgttttttgcaaaaatttctataggaaagttgtttaaaaaatcataattattccatttttgaaatttaaaataggtaatac

SEQ ID NO: 3208 - DNA, 2254 bp, Oryza sativa
agaggcccattttgatgttactgagcattattggtttcctatgctagctggcctatcagatttaactttagaccccagaccagaagttagacactgtgcacttgaagtgttgtttgatcttctgaatgagagaggtcataaattctcctcacctttttgggagagcatttttcatcgtgtattatttcccatatttgatcatgtaaggcatgctggaagggatggcctttcttctggggatgactggcttcgtgataccagcattcattctctgcagttaatctgcaaccttttcaatactttctacaaggtaatgtatgttgttctcccctgctgattttagttgcttcctagaaattgtgtgggtctattagaatgtcaactgtgctgaaacattttattttctagttatttcctttatctttaaggcaatacaattcaatcgtcctgcacataaatcaagtgatccaattggaaagttgtttgttggttcttattgtggtctttgcaggaggtgtcatttatgcttccacctcttttgggcttgctgcttgagtgtgccaagaaaacagaccagactgttgtttcaattgctcttggagctttagttcatctcatagaggttggtggtcaccaattcagtgacagcgactgggaaacacttctaaagagcattaggtatctcctcaagttctattttcccattaaaattaattgtgcttttgttgttcacatattaatgttaatatcacttgtcagagatgcatcatacacaacccaacctctcgaactcctcaattcagtaggatttcagaaaccaaacaatcagcaatcactttcaagagaagcagagaccaacggtcttggtagtagttaccatgatagcagggaaggaggagcttcaataagtcatattgatgaacaggatggtcatcaggaaacaaatgcacagactagcctagacaattcagaaggtgtggtagtcctgaaatatccattaattgttttatacaatgacaagtgcttccatatgaactggaatactgataattaacctaattctgtctttctctaggtttgccatctccatcagggagagcacaacctgcagtttccccacggggtcagacctttggacaaagaattatggggaatatgatggacaatcttttggtcaggagtcttacttccaaatcaaaaggtcgtacagacgatattgtgccaccctcacctgtgaaggtacatgttttttcctcttgcacatattgattaggtattgatgaatattatgatttgaacattagcagatcgtactgtcattggtacctttccttgctatatcaatacatatgcaattgcatatccttataaaaatcactagtaatatttttttcctgttttggttcctatatatctggcaaaaatatggaaccgtgcggtaatttctggacacctgagttcattgtgtgtgaacagagctagctggaatgtttgaaatcagtaaatctgtagacacagttataaacttttgaaatggtattacttcgttgatatgctagccaattttgtttgcatattataagtagtaatcaacgcataattttgaatatatgtattctcttctgacatgttggctgttgtccattgttaatactatactatttgctgaaagtcatgttctagctcatctggcgtgacattcatgcacctttgaacttaataatatcagcaacataccatcattacacttggtactgaagtactgagtgggattttctccatagttggcttgtttttcatatgtatttaattttcctgtttgttgatcgaaggcacctgatgctgacggggctgacaaaactgacgatgaagagaatcctatgatggagactgttaggagtaatgtatcactcaattactgctacttggggccattgacagcatacaggtactccatatgatggttattagtctgatgtatgaacaaattctgcttgtgaacatgtactaacttgtgcttcttgatggactttgcagaagaggtactggagcaggctaaaaaccacacagcagactgcaataatggatattttgctatcactcctagaatttgcttcttcctataactcaacttcaaatcttcgaaccaggatgcaccatatacccccagaaaggtaattcttaaagactacatgcaatttaactttccaaaaggagttctctaacagttgaaatttaattgtgtaggcctcca

SEQ ID NO: 3209 - DNA, 1156 bp, Oryza sativa
  unsure (1)..(1156): unsure at all n locations
ttttccctttccttttcagttcaatcgcaaaccagcaagggggattgagtatttgttattaaataagttgatcgaaaataatgcaacatctgtagctcactttctcaagagcaattctcgttggtaaggtgattcaagaaacataatgagcttcttgcagtttttctcaagtgtaaaagaaggattagtttactgttattgctaggtgggactaaccactagtttttgtgaactgtaactntgcaggctatgattggtgaatatttgggacaacatgaggagttccctcttgctgtgatgcatgcttatgttgattcaatgaaattttcgggattgaagtttgatgctgcaattcgtgagttcttgaaagggtttcgccttcctggggaggcacaaaagattgatcgcataatggaaaagtttgctgagcggtatgtgtataaagtcttaatgctacttttatttgacatgtcaaccactggtctcaaatggtatattatgacttgcaggtactgtgctgataaccctggacttttcaaaaatgcagatactgcttatgttcttgcttatgctgttataatgttgaatactgacgcccacaacccaatggtgtggcctaaaatgtcaaaatcagatttcgtacgaatgaacactgcgagtgatgcagaggaatgtgccccaaaggagctcttggaggaaatttatgattccattgtccaggaagagataaagatgaaagacgatttccctgattcagcaaaaactaataaacccagacgagaaacagaagaaaggggtgttgtcaatatcctcaatttagctcttccaagactgaagtcagcaagtgataccaaagcagaaagtgagaaaatcattaagcagactcaagcacttttcaaaaatcagggacagaagagaggtgtttttcatgttgctcagcaggtcgagcttgttaggccaatgcttgaagctgtaggatggcctttgcttgcaacattttctgttaccatggaggaaggtgacagcaagcctagggttgtgctatgcatggaagggtttagggctggcatccatcttactcgtgttcttgggatggacaccatgcgctatgctttcttgacatccttagtgcggtaagcaaattattttttctatt

SEQ ID NO: 3210 - DNA, 530 bp, Oryza sativa
aagaaagcagctgccatgccaatgtttctattaagctttaccatactaaaacttgcagaatagtgacgaataaaaaaagggcatgtgcacttttttaggcataaaattgttcacctgctgttgacacattcaatttctgctcctcccttgtatgagaaatcacatttgaagctgtcaccgcccaagagatcagtttagtcaatgggcaaaaaataaagtaaaaaaactggaagtcatttgtttgccaagagaacaatgacaaccttttccagcattattcttgagtttaactggtggttccttgatgtctgaaacttccttgattttaggttctccaagcttttgaggagaccttcctaactggttttttgtatacacatcatctcttgattttctttctttgtacttggatagacaaaacatcaccattagcacgagaaccaccgcggataccaccccaacaagaatgtatccaacaaatttcattgcagaaacattgttttttcttgatggggcattccctgctggtg

SEQ ID NO: 3211 - DNA, 639 bp, Oryza sativa
gttgtatccgggttcgtggttggaggacgattttgtaattcgatgacaagttgagggatcttcggtgtactttttcctaaaatacggtgagaaaaacttgcatgcggcctataatagttgggcctcaacgggaatgcgggctacgtgcggcccatattagttgggccgagagctagaatgcggcccatattaagtggtgttgcgcattgctgctttcacagttcgcaccatccggcggaggaagatggaggcgcaggcgacccaccggcgagccggagaccgcggcggcggtggcgacggcgggagctcctccgcctccatcgccaagcacctcgcaaaccagagccaggtacctcgtgagcacgcgcccgcctttccctctccatcagatcgtttgctgcttgctgccccggaggttctgtgatgctgccgattcctgcacacgtttggctcaaattctccacgaattcgtggcttctcctctcggattttcgcccatactcatcgcaagaatcaagcgcgcgtagccaatcgcaccatcgcggttacagttcagcgattgcctcctcgttgcggctcggtgctcttttgcgctgctagatccacctgaaccatgccggctcacagtgttctgcagaa

SEQ ID NO: 3212 - DNA, 572 bp, Oryza sativa
tattgaagtggcagatagtaattaagaactacaatttggaatatatatagctcggcttcaagaaaagagtgtcgatccctcaagctgtttacatctaaagatgctactaccaaaggcaagtatcaataaacttaactgataatcaacacctaggaaaagcttgtcataatccagtaggattacctgggtgggcgtcctagaaaccactggagcaattttgctcactgcagctggtgaagtgcggtgttgctcaaatgaagatctttgattatggccacccctgttaacactagtttgtgactctgagctcttctcatctctagcaccagatgatggtcttgatgacccattcctcggtatccatctcttgtcctcgtatctacattttagacataagttaataacattagtccaacacattgttccaaaggttagatccataaacacccctacaaattactccctctggtcataaatgtttgacacttagcacaaagatttggtcaaccttttaaaattccagcaaccaattttatattaggataagtttataaaatccaataagtttatga

SEQ ID NO: 3213 - DNA, 738 bp, Oryza sativa
atgcctgcagtcgactctagaggatccccggcttcctgcttgttgatcaagttgcactcatgacagacttccttgatcttcttcccttggtttttcttctcttccttctcctcatcaacatcctcaacctttccctctttagcttcctcgttctcactagtaatctcctttgaatctgagagaggtttctgcttgttcgaggaatgccactcatgagagacttcattgatcttctcccctttcttttccttctcctcatcaacagttgcatcaaagccatagatattatcacctgccaaatagcatcaccaaacaatacatagtctttaaaacagggaaataaagtaacaataatcagtgaagtatatgaactatggccatcatcgttctgaatacgagtaactgaacaagccatttttatatgaaaaaaacgtaattatgtaaatgctactaaattgatgtattgtctgcacccaaaaagggaaaaacagacaaaaaaaaaacagctagcagtggctgcatccaaacgctgcaaaagtagcagctttggaacatcaaccaaggttacccgtgaaacaaagcgacgaaaacaggacagtgatcaagagctgatcagatcacaagggctgcaacatttgtactgttgttcttctctactccctctgtcccaaaaagaccgaaattcttcgattttcgtgtctaacgtttgatcgtccgtcttatataaattttttttat

SEQ ID NO: 3214 - DNA, 12223 bp, Oryza sativa
tggcttggaggtatgtattgagagctttgctctatgtatttcgacagtcagagatgctctaaggccctgagcatatagttgatatgtatggtgcacaaattgtttcggagttaaaaaatatatcatagataaagtagcattggaagaaatttccgataccatatagtagacgtatgttttgaatcgtagatgaccagtaaatagagttttcccttttgggtgcaatgtagctgtctaaaaaatgtctattgctgactttacttcgacctgctactgtagattctgcttgtgaagcgcatcgaggaagtacttgaccatgcttttgaaggtggatgccctctgagaccacactccaagctatagcatcaaccaatctgaagatggcgtttgatctggtatactttcctgctggttatgtacctattttggagattcatccataaaacaaggttcagatttccatgaaagagcaactattccacgaggtagaatctcacgccaaacgcaggcttgcagcgctgctgccaatccatctcggttgagcaacattcggaatctgtatacgagttatacaaaacagatgtgagttctgcacttctgtttgtgcctgcgttcccaactgcatatatttatagagggatactgtctgatgtacacgcatctgttgttgatttggctgtatatgtaatctatttagggaaaaatcaatatgtcatatcataccacaagaaggaatcatcaaagagccctcgaggctgttcctcaaaatgtcgttgacctatcttgtcccactggctcacgaataagattatagttgaataaatgttttgttttcagtgtattgtgtccaccagtttggctctctttttattccagctgccgtttatttgatcccattggcaaattgcgacatttttactaaaactacagtaactgtttttactaaaattcactgttttctcggtgagaattacaaccgcgaaaagggtgcatgccgtgtcgtgtaccatgtttttgttcatttacataaatcgaaaattttgtaaaacaaattggcaaacagcacatcataacgtgtagtacgttgcaacatttcactatccccgtcttcccatctatatcactatctcatctttccatcaggattcttcttgcgccttcctgccaaatattcaaaatgtcaattggtaactctttaagattaattgtagtagtgccgaaaacgaaaagtaggtcaataaaaattgatggtacactactatgaaatattacaattcactatgattactcattttttaatcagatataatcataagcttgaataagcatcatagatttatagtcatgtagaagaatgccataccattgaagtctaaaaactgttgtagtcctgttcaaaaagtagtttaacaaacaatgatggtacactactatgaaagaccacatccaccaaaatttactcatttttaatcagatataattatctagcttggaaaaaccatcatggattcacagtcatgcagactctacaggagaatgtcataccattggagcctctgttccagaggacttctgagtcaattgtggtgagatgtggatcatcaagcctcttccatgtcttgatggacttcacacctcgccactcgccgccgtccgacttctcaagctgcacggacaccaccctcgctctcctcgaccacccggccttcccatacgcatggtacccaaatccaccagcatagcacagctgaatgccattgagctttccacagaagtcgttcacatgatcatgccctatgaaggcggccttcacatccccagcctccaccatgctggcgaagaacccagagttgatcgatggcgagctgataccctcctgcttcactcctgtgaaattggatgatgtgaagctgctgaactctggcaatgggatgtggaagtacacaagaccaggcgctgccgccttctgcttcggttcctccttcatgtattttgtctgcatttcacaacattgtcattatgtcaacttattccacctggtgattctttttttgtgtgtgtacaatgtgcaacttaaagttcacctggagattcgaagaggtttgctggaaccagaattgctgtgaagctttgatccaaccatatccaccgatggaaggcaccgtagaatagtcaccactgtcaagaaaatagaggttgagcactgatttgttagccagcaatgttccttcaaccccaccaacttccaaattgtaatttccgtaaccatcaatttctattccttctgggttgaagcgagaaagggtgttcttcatgcccacaaggtgacgcatcacaccctcgcgtgacagcgtaccttcttggtcatggtttccgatcaccgcagcccaaggaaggttcatgttaatggctggggcgattgctgcatccatagacttggccgcatcggttgcatcaaagccatagatattatcacctgccaaatagcatcaccaaacaatacatagtctttaaaacagggaaataaagtaacaataatcagtgaagtatatgaactatggccatcatcgttctgaatacgagtaactgaacaagccatttttatatgaaaaaaacgtaattatgtaaatgctactaaattgatgtattgtctgcacccaaaaagggaaaaacagacaaaaaaaaaacagctagcagtggctgcatccaaacgctgcaaaagtagcagctttggaacatcaaccaaggttacccgtgaaacaaagcgacgaaaacaggacagtgatcaagagctgatcagatcacaagggctgcaacatttgtactgttgttcttctctactccctctgtcccaaaaagaccgaattcttcgattttcgtgtctaacgtttgatcgtccgtcttatataaattttttttatgattactattttcattattgttagatgataaaacatgaacaatactttatgcatgatttatctttttaaattttttcatatttttttcaaataagacgaacggtcaaatgttagacgcgaaaactcaggaattgagttttttttaggatggagggagtacggctgctagctcgatcagatggaggtgtgcagtaattgtccaagtgtatcatggatgtagccatcacgagaccagttcatcccatcgtggtagtgatctaatggaccaatcaacaatctagacctagacctcactgcatgattgggaatggcaacccccaccctacagatgagaattcttgaaatccaatccaagaatgagcttcagtggcccggcccacacatctttatcacttcggaaagggaaacccgtgacattcttgttgtactttagtactactagtacgagtacgtatcaagttcacagaaactacacttcctctgcaaaaatgtcagaggaggtatgaaccagtgtacagcaaattcagctcgctaatgacctcactagcacatataatacgaatttattgtactgtcaataaaccattacgagaatattttcagagaaaaagtactactcgggtaatattttcagagaagttgcaaacggattcgccggttcaccaatcatttactgttcgagaatcattaaacctatgttacatgcaatattacgtacctaaaattactgctgcaaaaaaaaaaaactcgtaagatcgttgggtcacgcgggttactttgctagagtggcaaacaaactgctgagtaatcggtatcagaaatggatttgttaaccaagattcgtaggaaaaggcgacaaagaagttaggtgggatatacgaaaattgatcagaataaactactcatagttgaataattaattaattaatcgaagcactaacaaggaatgggtggaggaggaggagattgggtgggcggggcagaggaatccaaccggtgaagacgacgaggtcggggtcctcgtcgcggaagaggcggtagaggaaggcggtggtgttgaggtcggagcagccggcggcctcggaggggagcacgtcgaggcaccccgtccgccgcccgtccgcgtagtgcatgtccgccacctgcaccaccttgaacgtcccgctcccgccccggaaccgcagccccccaccgccgccgatacccttctccttcctccctgctccggcggcggccgcctccgccgccgcggcgacgagcagcagcaggtggaggaggaggaggaggaggcgccggtgggcgaggcccatgttggcgcggtcgcggagtggactggactcgggaggaattccggaatggacggtggtgtggatgcggttttgtttataggaggagggattttggacggctcagatttcccgatgcgatgcagggtgctccttgttttcggtgggtttgaaaccggaaaatccatatgtattatgtaccgacgccattatctcttctcctaaagaaacaatgggataattgcaggttaactaacgactttttaaccgacggagcgagtgaaagccgtgggcgcgagtaggggtggtttttgaaaatttcttcatcttggcacacagaccaatgataagtaattctatttatcatccatttaaacatgctactagtcattcctcgtaaacaaacaatttattaatatttatatttctcaatgcccatgtagccaatcatgtgtggaagaatggataatcacgcattaaatctaagaaagttattaagagaataggttgttggattgaaatatgcctatcaaaaataaatttttcagatttagaaatatgactatcaaaagtagatggagggagtaataaatactgagctattcggtttcggccgttttggtttgatcttcggtcataactaaaatctgagatggaaataatcacactggtcactaaaaaatcacaaacaaatcatagaaatctttagttatccccattcaaaaaaactaaaagaattcatggcacgttgatccataagagcggcagaccgacccggctcgtcgaaggcacctgggctagtggtctttatggcggcgttggatttgcaggccccaatcctattgtatgtagacgcttctgctccaagttggtatccgttgtcgcccgtcgctattggagtggaggcagcgtcgccgccagaaacatgtgggcgcctattgccattgaagtaaagggggcatggagtggcgtggttcaaccacacaaggaaggaggggtggcatgcggtgtgacgaggaggaaggaaagccaggaagaaggggtgaattgaatgagttaggattataggcatgtttggattgaagccaattattaccctaccaattatttggtagttttgaatagtatttgttagctatttggattaaggccaaatcttactaattcaatagagttagaaataacacaactttaccaaaattttggtagtgccaaacttgctcaagatttggcattaccaaaatttttgtagggcttcaaaccaaaacaaccctatgtttgaagctgtttcagtctcgatcagttcggttcgatattttatttgtggttatttttgctgtccctataagcatgcaagtaaaaacaagatgctgccacggcgatgagcaacagcagcaggaagaggatatgttggagggcgagcgaggcgccgaggccatgttgatgggcgttgagtggagtgaggaggaatccaggaatcactggtgaggtggatgcgactttgtttatagtataactgggctttggacggctcggattccccgatgcgaagtagagtgttccctgttctcaataggtttgaccccttgattgcaagttaatgacttagacttagttcaaatgtgctcggtagtccataaaacgagacaagccattagagtatgattaattgagtattaattattacaaactaaaaaaatagatttatttagattatctaaagaaactcttatataaaaagtttttcaaataacaccacatttaataatctgagaagcatgctgataggaaataataatcttgcaacagcaaaacaagaaaagaacggggccttaaatgatgaaaacgatattatttctacgaaaatgattgtggatcgatcggagctctttatatatttatcaatttaactaggtagtgatgattgcactataattccgaaagaaattagaaaaattaagaattttatacagtaagatggaaacgtgaaaaacgatgatgctgccaccgttttcaacgagagaggcagagcgcgagcgaaagtgcgaaaccggtggaaaaatccaacgtgagatggtcgtcgtgcaaggaagctgcggacgccgcggtggaccagtccactacccgcatcggcctggctgggccgcggcctctctgcctggccgaggagctgcacgggttgggctaggccccgtgcgccgtgggctgatcgggagcaggagcaagccagcgacaatgctgcagtgcatgtgagcagtgacgcgcacgcgctgatgccctgcgtctacctgatcgggtggatgggaggcgtggttcgcgtgcgtgcgtgcgtgctaacgtgctcgcgcggcgcacgacgcgcagtcgctcgtcccggctgccaaccgaccaaccagtcctgccgtgtgggatgaaaactcgaaaaaggaacgtcctagtagtagcagcagtagtaaacgcgacgcaggcacaaaaacgctcgctttaatcactcacaagacgcgacgttactaacgaatgacccaaggattttttctaccgattcttgaacgacacaaggattattcgacatgattagagcaacaaggctgtgtgacccacccgtggccgtgtatactcatggtcatactccctccaaatgcaccacgacattgttcgaaaaccaacggctatgccaacggttacccgtcctgtcgtccagcctcggcaaccataaagcaacagatccacactctcttttagattctcaccaacaatctcaacgtctcctcctcctctcctattcttagcaacatctatataaacagcgacagcgacaaccaaatctaacgcaccataaataaataaaaataaaaacagcaacaataacgcagtcttgcgtcttgccttggcaacgtcaattccgatggcgacaagagcagcgttgtgttggcgccacgtcgccgtgttcgctgccgcgctgctcgcggcggcggccgtggtggtggccggcgacccgggcaagatcggcatttgccacggccgcgtcggcagcaaccttccacctccggcggccgcggcggcgttgctgaggcagaacgggatcaccaaggcgcggctcttcctccccgacccggcggtgctcccggcgttcgccgccgccgggatcgacctcatggtcggcgtgcccaacgagaacctcaccttcctctccgccgcggggcccgacggcgcgctccggtggctgcagtccgccgtgctcgcccacgcccccgctgaccgcgtccgctacctcgccgtcggcaacgaggtgctgtacaacaaccagttctacgcgccgcacctggtgcccgccatgcacaacctgcacgccgcgctcgtctccctcggcctcggcgacaaggtcaaggtctcgtccgcgcacgcctcgtcggtgctcgcctcgtcgtacccgccatccgccggcgcgttcgacgccgcctccctcgacgtcctccgccccatgctgcgcttcctcgccgacaccggcgcgcccttcatggtgaacacctacccgttcatcagctacgtcaacgaccccgtcaacgtgcagctcggctacgcgctgttcggcgcgggcgcgccggcggtgagcgacggcgcgctcgtctacaccaacatgttcgacgcgacggtggacgcgctggcggccgcgctcgacagggaggggttcggcgccgtgccgatcgcggtgacggagaccgggtggccgacggcggggcacccggcggcgacaccgcagaacgccgccgcctacaacgccaagatcgtggagcgggtggcgcgcggcgccggcacgccgcggcggccaggcgtgcccgtggaggtgttcctgttcgacctgtacgacgaggacggcaagcccggcgccgagttcgagaggcacttcggcatcttcagggcggacgggagcaaggcttataacatcaactttgcttagaacttgcctgtatttgtaatggtgttgatttgcgaatcaacttgctatatattgcccccattacattttttttgccccttgtgtttctctctgttattcctcaacatatgaaacttcaatattgcatctgttgattgttatttctcaaacttcgaggatgcaacttgcaagcatattgaatccatgttcttccaaatgctgaatcctcttgtatgctttctacaaattctttaaaaacctttattatgtcgctactccatgttcagaaaaattgttttgataacaatattcacaacaagtcaacaacacttctttgattctttaccatctaaaggagcatttagtacattgagaggatcttttagttcttatataagaaatttgttcttatggctttttgcttggatatgtgacactgctaataccatgaccccactggttacagattaagtgagatgtacctgcaaattacagtaaaatgataaaactggtaagaacaaattattatctaggttctgcacaaatcgaagtcgtcatttcagcaaacaattttagtgccatataagataaagtgatgtgctgacagtgtcacagtacctgttattagctgcttctgtgctagagcaaaccaaatccacggcacattcttccgcattgttcaaggaacaggttcaaatttacagatgcagtcatatatatttccattgaaaagtttttctgccaatctctgattcttgaccatcgccagctgcaaataaagtcattttgttaaccttgtaaaaacacacaagatttaagtatgacaccacaattcaattattcaaagatttaatgtagccttcttatcaatcccgaacatactgacaagtaaggcaataaatttccagttgggttcaacccatagatgccagaaccattacttcaaaaagcaactacgctgttagaccttaaaagttctgttttaaaatatttttccttttcctcctactaagcactccccttcccccatattgtccacttccggactttcttactcttatacctccactcccacaccattggtgttgctccaccaccaccactctctacccaaatctgggcagagattggtgctggcatgctgggaggtcgattgaggactgaggcgtgcaagcagggctctggcagtgcagtggtcgctagcaaagtgtcagcattcagcaacgcagtggctgttgaccaaatggtgcatatttcattcaaggttattgtatttttcctctgatggttgcatttgagaattgtctctatcgtaagtacatccctaccatggtcacactcagtggtggatgtaccacctggcgaccccaggcagctgcccaggctcgtcagcggataatccactaaaattccatgtaattaggaaaaattgagatataatttcggtaataaatactagctatagtgaagtttgcccgggctctaaaataattctagatccgatactggtcacactgttgattcaacatttttttccaagatattcagtacaataattacagcagagttactttgtactggtatttagccaagggaatgacaagtttgtaattgtgcgcatcaataaatcagctgtttgcagaaacaagtaccttcagagtatcgcacttaaaacgggcattgaggttggtatgcagagatcgccccatgccctctaagattaactgcacaacatttaaaacaacaaccgatatatcaaaccacataactttccaatttattttacatgagaaaatgcattcagttcaaagagctacagtctatcttaccaaatctgcatctttcgctgcagcagcaagttctgagctaacctgccggaaatcaatacacggactgccacatccattctcaacaaccataaggggaactgatactggttcatctttcagatcatcttggatgccagccatggcatcaaagatcaatccacctgcctctgcagctttccgaagtataccacaatgctgtagtacattacaagcaacaacagaacttaagataacaataggatggacaagaaaatagaatttatattcatttgtaccttcgcagcttcagccacaattcctggaagctcattagcggtaacatcattcaaagcaggcaatgaatttgcaaccaaaaccacctacaaaatcaacattttgttaccagctcaagtcaactgtatggatatcagatctgatacaattaaactcaaataatattaaaatggactataataaaggtgtgtgattttttttttacatttaatagttggatgcgtgaaaatgatatgtacatttgtctcgaaaaccactttcataatattacaattttattgggttatacaaatatactaaaatagaaattagtggtcaactttgcatcttggaaaccatgtcaatgtctaaaacgacatgtttataaacggaaggaatatttcacagggccggtaaaatttataagtcatctcaattctaggttataaaggacaatctcccaatctatcattcactgtactttgatgtgcaggaacacaggaatgttaattaaatacattgttaatatccaaactttcctgtttccatgattaaatctcttgaaacagcatcatgtctgttacctataatttgaacacaaatgtgcataaagataacaaaagggcgacttgtctttagcttattgtttttcttaacttatacctcagttccattgcgtaataattcccgtgctaaaggaatcattccaaggaccacatcagcacccgagttatcaacaaaaagcagtgctcttttgtatggttggcccttcttatcagcaagcattctctttttaaacatatcaaagtcatcaatctgaaataagagacaaaaatataaacacagcaaagcaattataaaaaagaagtttgcaagtaatttgaaactttgggtaaatcttgcagtacaaatataacatttaaaaggtcagaattggaatacttgcccgccaaggacgttgcatcttcttgcggctcatgcgataaatttctattatagttcccttgtgataaaggtccacacaagctcgagagccccaatcaaatatgtttgcagcaaggacaccctcgattagtgcaagcaatctagcttcctgaaaacatagttgcacaacaacaaatattcagatcaattctgttgggtgctgagctaagcagaatgacgcctgaatgacaagccctgctatctcctacctcattcatactatcaagttccatcagaagatcaggtaaaacagccagtgaagcttcattttcccttcacacacaattaaaaccgtaagattagataaaagcacatgaacacatgaacgtacacacataaagagcgagaaagacaggaactaacctttgcttaatgctaacatatgcatcgacaaactggaattctctcaggcattcttctctcagctccaacaggttggctaaaccaaacttcccataagcagcaggctcctccatcaacctaaacttaaccaaaagagttaggaagctaagtgacatagtgtaatgagttttacaatatcaatctttacagactaacagattatcaatgctcgattttgaatgaagaaaactgaaatatactccgtactaactaatgtcatgtaatggcaactgcgtaccttgccaaatgagcagaaaaagcatgtgcgaatgcgtcacccctccttttggcatcatcagtcccaccttcactagcaaccgcctaccaacaataacatgcgcacattagtacaaaaaagaacatttttcacacattcacaagaggaattgaggtggagattccaacataaacagttacttgtgtattcataaattgctaacaaataaattataacgtataatattgattgacctgttactagttataatgccaaattttcttaataagaaatgttgagtttgtgggaacatttgagtgagtataatcattcttaggtgtaaaccaacaaaagcaataaaaaaaatactgcaaactggtggcatgttattgggg

SEQ ID NO: 3215 - DNA, 557 bp, Oryza sativa
  unsure (1)..(557): unsure at all n locations
nnnnnnnnnnnnnnnnnnnnnnnnnnnnnnnnnnnnnnnnnnnatgctggttgcttgtagctgtataatgactgtgttgtcttttctttctgaaggaccgagccaatgaaatatataagaaggtggaagatctcaagtctatcaggggaagaaatcaagatgccatattagctgcctgtttgtatattgcttgtagacaagaggatcggcctagaactgtaaaaggtacagtttgttctttgctgaatgcatttatctgaatgcgttctgaatgcatttatctgatgcgttcttgtttgatgtgatggcttattgcagaaatatgttcggtcgctaatggagcaacaaagaaagagataggccgagcaaaggaatttatcgtgaagcaactggaagttgaaatgggtcaatctatggagatgggaaccatccatgctggagatttcctggtctgtagtttgccatgtattctaatgagnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3216 - DNA, 1251 bp, Oryza sativa
  unsure (1)..(1251): unsure at all n locations
nnnnnnnnnnnnnnnnnnnnnnnnnnnnnnnnnnnaataaaaaaaatactgcaaactggtggcatgttattggggcttgtatttagctataacttatgaggacccaatgggacattgttttaggaacaggatgagataggtagcagcacacatgcacactcatatggagggaggggagcatgaaaaaaataattatcactaagccatattgtcaaagaaaactctggtgtcttatctcgtaagttatacaaggttattgcaagaagtacaccataccttgtccacaaggtcaggcaaatggtctgacaaaatcttgaaccattacctggcattggacatctcagatatcatcaaatgattcaattcctacaagatatctagaaataggggaagcagaaataatacttgtactcattcaggtcgagatcaatcgtgtttggttcatacctgcaatacagataatatattacaacttacgcatgatctaaaattgagctgcacatggcaattgttccatcagaccatcagcaagcttatgcacaataaaaccacttgtcctcaagcaattttggcatgtatatgtaggataaaaatgctttaaataagttgatccacaatgtcagaaaaaaggtatagaactatagatagactactattgttttaattggtaaatacagtaagagctgcttaggtgattcggtgaaagagctcatatttcttaaccctgagctaacacaagatgattcttaagttcaaatcaagacctctgtttggctggggtgcagtgcagctctttatattaaaaaaaatggagactgcaatttcaaatatttagataatatgctaaagtatctcaattacttctgcctaaaaatgttttgagaagtgatgactttgatgctttctttagctttttgaggcaaattacccattattcacccaaccttttggaccttttacagtaccaaaagtgtgcctccagcttccataatgaatttactgcaggtacccttatatttcaaaattgcaataattgttatagagaactggatgactgtggcttacatctttggatcttctaacagcggaaatacatccaatgtgggtacaagatggagaacaccaacattcagagctgcacttgcatctgaccgcaaaatgtctcccttggcggtaggcctctcaaaacctcccatacctgttgtcacaggaaatccaacaggtacggggggtaccgagctcgaattcgcc

SEQ ID NO: 3217 - DNA, 750 bp, Oryza sativa
  unsure (1)..(750): unsure at all n locations
ctccgcccggacctcaagcgcggcctcctcacngacgcgaagaagcagctcgtcatcgacctccacgccaagctcggcaacaggtacccctttttccatgcatatacacacacctacgttacttgctctacctcgtctagcccacacacgcaaatgcatgcatacaaacgctaatagatttttcatgcatatgcactgtgccatcttaaaccatataggattttcttttgccgggtaaccatataggattttgatgtggatagagctggattaactctctatacaaataggagtagatcattaaaaagctcagtagtactagcagtttgatagcggtaataactaacaccgtatagtaatttaataaggtccaagaaattgagagaactactactagtactgtatgttagctacctgcatgcccattatttgatacgaagacgactgacgacatgtgtggctgtcatcaatgtgtgaggtcgcaaagccaccaaattacagtactttgacaatgaagctcataggtcgtcaatcactcatgtgaactaattaaataagtgtatatagcgcttacatgtacgtgacatcacggtcacgtaggtacgtaaaccttcatcactactactactgctgtcatacgcaagctagcagacttgtctccatgtgtactacgtcgccaagaaagtatcttannnnnnnnnnnnnnnnnnnnnnnnnnnnnnnnnnnnnnnnnnnnnnnnnnnnnnnngc

SEQ ID NO: 3218 - DNA, 546 bp, Oryza sativa
  unsure (1)..(546): unsure at all n locations
nnnnnnnnnnnnnnnnnnnnnnnnnnnnnnnnnnntttatattgatgttaattaatctagacattcattaatatcaatataaatgtggaaaatgctagaataacttacagtgtgaaagaaacggagggagtagttggcttcatcgcacaaggcgtccaggcgatgaagcccgctaacgtcgtttgcaatattgggccaggcccaaaacgcaacaagcacggagtggacgggctccttgtgtagtaggccaacaccttgggctccttacacgaggaacggctggcccagcgaaggtacgggttgcgttagcgtggcaacaaacacaacaccggacgtggccacgtgggaggattcatggatcatcacgaataacccccctccatcctcccgaaaattacagatagcaccatgcggttgaatttcgtccaaaaattcctgtcttgttatactacctgaagaaatagatgctaagaacaagggtgtaactgnnnnnnnnnnnnnnnnnnnnnnnnnnnnnnnnnnnnnnnnnnnnnnnnnnnnnnnnnn

SEQ ID NO: 3219 - DNA, 1567 bp, Oryza sativa
  unsure (1)..(1567): unsure at all n locations
cagcgattacggggagctcggatgccgggagctacgagtacgacgacgaggccgaggaggactacgaggaggagctggagcaccacctccgcgtccaccaccacgagcacgccgttggggagggtcgtggcgagggagagcgagatggggagggggctgagggaagcgagttcgaggaggaggggttcgacgaggagtatgatgaggaggaagtcgagccagagctagaccccgcggagtacgaggacgatgaggcttatgcacgagctctgcaggatgccgaggagcgcgaagtagccgcgcgacttatggctctcgcggggatcagcgattgtgagtagaaaaggagtgctgtttcttcagttcatttcacatgtttcagttattgctgtcgataatttcaatttgatattgctttgtagggagacctgtggagcctgtagaggagcatgcgaatgatccacaggtaatggtctatttttcttgttagttggacaaattgtgtttgttctgatatgtggaaatcctagagttggatgaaatgatcttggagtaataacataaatgatgatatagtctccttaattcgttgttgttgcaataaaatttacacctacattatgtatgacaaccgaaatcatatggaatttacacttgaagtgatgaatgtgccttgcaactttccttgtttccacgcactgttgataaacgataagactgcccccaaattcattttttgggtaccttccagcatccaaaatccatcttattttcagttgaacctggaattctttttcttgctcaccttcagtttcatatttgagtgataaactcatgagcatccaaggtttttatgtactttttatcacatttacagatcatgacttctataagaagtgttggttgtttacatcaggtggatttttaatcgtttatactttagtagagcttgtactgtccattagttgagcaatagtaagaccagaggtggtatgtggttcatgctgtggcttgtcaaatttgcatgctgtcctgtttactccatggattttggcatgctatattatctccaatggaagctgcatacttgaacttgggaaaatgtcttttcattttttccttactccattactcattgataatcagcttttatgaactggaaaaacgtcatttaacacgttgatatatttttaccaaaacccaggatgcgtggcaagaggttgacccagatgagtattcttatgaggcaagtttcattgttatatgttagccttctggcacctggcactgcatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3220 - DNA, 7986 bp, Oryza sativa
atgaaatttttttataattagtattttcattgttgttagatgataaaacatgattaatactttatgcgtgacttatccttttaatttttttcataattttttcaaataagacggacggtcaaacgttggacacggaaacccagggtttgtcttttttttgggacggagggagtagttgttaactgctacatttcagaagatgcgtagtctgaacatttgcagattctaacaatgctaatattgatttaacctttcatcatgtagatttgatacatctaaaaatttaggagactggtatattttatttagccataagaataaacatatcccatagcaattactaaattgagcatttcatttcttcatggttacttggtcagtgcacacatttcagtaatagagtttcatgctcagttaaaggaattaacgcagtttttaattagatcaacacatgtgaaaaaatggtaaattaaatggcagacttttgtttaacagcagtgctttgctggcattattatgctttctggctctaaacaaatttgctccgcactcaaagtacatctcttggggttcatgcatctatatgaactgaaaatatgatgaatagatgatggattgctgatcgtctactccgttgggggctcccccaccccatccgctgtgttctatgcgaccagcatgaagagaatagatcacatcttggtcgcttgcccggaatcccgacacctctgatggtgggttcttagggtgattaatcagtcggcctgcctccttccatcagtggctttgcaccagtaggaaagtaggaagaaagtcgcgaaggatctctgatggggatttcatactattgcaacgctggtcacctggatgatctggaaggaaataaagagttgggtgttcaatctccagcagcggccctaggcggaagtagcgaaagctatggctgtagaagcagagttatggcgcctggccagggtggcagtgctggcgcttggtctctagtttcaggagtccctaggtcgtctccatcgtttgctgagattatagcttcaagtcctttgttgtacctctcaggtatcccgtcccgcttcaagttttcgtttgttcagtttataaataacatttatttctcttaatacaaagatgtgtttcttgcatattcccaaaaaaaattctgcatacttggtcatgttcttttttgataaatatgtaaattctatctcggttttcgttagcacgcttttcaaattactaaaaggcacatttagtacgaaaactttctatatagaagttgctttaaaataccaaataaatccacattcttgtaataattaaaactcaattaattatacgctaatggtttatctcgttttgcatgcacccaaaaatctaatgccactaacattttcggatggcaatgatagtgccactaacattttcggatggcatgacgtgcagtctcaagaaggcgagtgtgccaagactgacgtttacagtacagcatgggcatcatcatcctcaagctctgaactggcaaatctcccgctggcaatagcatgggtggtgacctgctgcagtatagtgggtggtgtccattgtcaacaaggtgtgaacctgaaccaacgagaggtgttcgcgctcgccatcgccgccaagcggatgacggacgagagaagagaaaggctgcagcggcggacgagacacagtagacgttgacaagagaggcggcggctgcggctacagaggagagatgccgatcagcgatggatttgagctcgtgagccgagtcaagcgaggctcatacacaccgaggtttacaaaaccagtggtacccacacgataatcacgcctacaaaaaataatcacgcctaccgtcggggcacaacaaaataaaaccgtgataacccattaacatcaaataaatttataaactaatttaattttgtgataaattctatacggtttgccacggttaccgtggttaccatacggtaactatgctaatcgccagagtgcggtaactccacctccgacagtaagagaaaccctacagatccatactatttgtattgcaccggaagacgtaacgagcgagacgtccgatcctgcgggagtccacatggcaatcatcggggggtggggctgcacaggagctgtttgcagccggtctccaccaaatatttttccccatcgaacacctgctagcgagggagaaggtatcaatcagacgctagcatggagcgacggcctggctctcgcttcgcgtactcgaccgtgtgtaaatggagaggaggataaaattgcgctacgctgtccttcacctcgatattgaaaactctctttctttttcgaaacgaacagtataagacaggacaagtttcaagtattgatatagcaagagaaaaatacaagtttatagtctggaagactatagtcaggaaaaaagaaaaaaaaacaaccgcactacgcgtctacaacaatacccgctgcaagagcgaaacaggagatcttcaagacgatgcctctaagaagggaacgacaacaagagcgcctccgctgcttgtcccggggagccaggacaaggttctcacctgaagaaagtaattgggagagacaagaaaatgcagcaacaccccaaaaggaaagcggcacccgcatgcgtcgttgttgccagcccgaaggcagagctttcgcccaaattttcacccctcccaagaactaaactactgcacactccgctaccaccaccatcgaaagccttcgacacacactgtgccggtgtcacgctgtcggccaatcatcacaggggagctcgaccctcgacactcgctggatccatccacgtagttgggttgggtttgatcccccgtgacagagtaactgctgactctaccacgatcccgttgcccgtgtcacctcgggccactagaccgtttcgccatcaccttgccaccctctcatgcgccaacttcctccctctttgccatggtggccaccatcccgctccacctccgctggcgtatcgacctcgtccactgcttttgtggctttgtgcccacaaccagctctggtaccgtcactgcccacgccatcatcgccctggaatctcctacacctcctccgtcggcgctccagccccgctccttgctccccacccccggtagagggagtaaggggaagagaaaggggagagaaagagagagggtaaggggagagagagagagagggaggaggaagaagggaaggagaaacagatgatgacatgtggatctcacatgacgtcacgttagcaaaaaccacccctcaaaaacgtctaaaaattaaattgcaccgtttaatagttgggggggtcgtgagtattgtgcggttcaaagatacgattcagactcagcaactagtcaaggagaacgatgggcccattgcgtaaacggcaatcgggctcggattcacggtagtacgtactgtaaccttttttagttgcaacaactattccgagttggatttttttttgcacgaatattccgagttgaatatggcagcacgcgttataaatttgccctaggcggaggtatcgcaacaaaatctgcctggaaggaaggaatagtacgcagggacgcagaaagaagacaatcgattgatacatgcaaaaccatcatatccattcatcagcaattcagttcagaggcatcgatcaccatgagcaacagcggcagcggcactagcaacatcaaggatgagatcgacgcggcgttcgcggcgggagcaatgccgccggagtggcggccgaggctgctggcgtcgcagcgactgggcgagggcgacgtcgacaggatcgcggcggccatcgccgaggttcacgcgacctaccaatacgtcgggtcgaccaaggggaacatcggttatgtggcgtttttgttcgtcctcggtgtgctgttcttatgcgtggctggccttttcttccgcgaaaacaactacttgaatggagcgttagccgtgcttgtggccgtggccttcatagtgatcattcctatgataatcttgctttatgagttccatcgatggagggccaatatgctaatggcgcaaacacgaactgtcctcgagcgctttctgcttccacctgtttaactgaactccatccgtcctataaaaaacgaatatagaaccaaatatgacattgcagtactataaatttaagatgtgtcatatcggtactaggttgttttctatggggacagagagagtactgctctagcttactctattatatgatgatgatggtctttttccatcttttcatgtaaaagaaaaaataaactgtgagattatttggattgaagctaatttttatatcgacaaatgtttggtatgctactagtttttttcctatagtaattggaaattctatgctaccaaaacttggtagcgccaacagttgcaaggtaattttgttaggccaaaaattttgaacctaacaaacccttacctcttttttacctctcttaccattagactttctccatgattgctcgtcttaagtccaacatgcattcgaggatgcactggtttgggcctatttgacctaatatttagccatggaagcctcgataattagtacgaaaatgcaagaggtaaagcgctgattgccatcactagaggagaggggaaggggacatatggtggtacgcatggatgtgggacctgtgggtacggggcaaggggtaaacaccaatggagtgttccatgcaagctaaaggagtgcggcggccttgacattcagaatctagaattacagagcaagtgtttgctaagaaaacggttatttaggttatgtcatgaaggaggagtatggcaagatcttctactgaaaaaattatgcccacgggctcacttgtcaatctctctttctctggctcgccggcatctctctttctctggctcgccggctggaacacgccgtcctcgccgagccaccgctccggcctgtactccaagcagtcctcgctcgatggcgtatgcgctgtacgtcacggaccaaccggcgcggacgagcgtgccgtcggggagtgtgtcgtccgccgcgcacgactgacgccggcgggtacaaccgcatcgactccgtgagtgcggcatggaggtagtgcatctcccagagcgcatcgaaccgaaacggctcgccgaggcgtgtgtcggtcggcttcctcaccgcgcggacctcgtcggcgatgcgcgccacgacgtccggccgggacgacaagagacagaagaaccagctcagccccgacgccgtcgtgtcacggccgacgatgaggaagctgaggacgatgtcgcggaggacctcgtcactgtgctcgtcactcgccacaaacctcgacaggacgtcgtctctgtcttgcacggacgcgctctggcgccgggcgcggacgatgtccatggcgaaggtgtggacgtcggcgatggccttcctcagacggcgtatggtgccgacgttgagccacttcttgatcttccaggagacctcgatgagatcaaagaagcgtccgacgacaaggttctgcgcctcgccgaaggagtgcatgaaatccgacctggcatcctccatgaccccgccgtcggcgaggcagggcaggtcgtgcccgaacgccaccatacagatggtatgaaacccgaatcgctggagcacgtcctgcaagtcgaggacgtcaacatcatcgctatcgctcgtcgacggcgactttgacatcaccatcaactggtccggcggcattcaccacccctccgcggcaccctcgatttgaggcacgcgccaccgtatccctgccgggccagtcgccattgcgccgccgccgagctccctgagagctcggtgccaccgtgcatcgccatgccgtgcgccgggatgccgccgtgcgtcgtcgccgtcggcggtgaaccccggcgatgcgccgccgccccgccgtggccgagccgtcccggctcgagccggcagcgttggctgcgcgcgtcacgcgtctgctcggctcagtactaagcgcgaggaagaaaaaggggaaaagagaagagagagagcaggtgcattttggtacttacataactctttctctctccattttgactggaaataataaaataataggaggagtgtccacttttttacagtgtccacgaaaagattcacgatcttcggatgtctcatagcaaaaaccgtaattttttggtgccctatagtaaattttgccttgttggatagataactccttttctgataagttgtctgtagaataccgctacagagcgttcctgcggaagcaaagaaggtaaacctttaacaatggggaccaaataatgcaagcgtgtttgatgaaacttaatcccagtcagcttttcaaaatgaactggcaagacacaagcagggtcgtcgtcaacttttcttttcgctagttctcaggcccggccgtattctggtttggtcaacaaacaaaaggatttgcacacgaaactgatgtgagatgcaagctactaagcatgaggcaactgataaactccctaaattcaaccagataacgtagcgtatgcacataaccagtcagtaaaccagtgcgtacaatatgttgagtggactagcacggggcggctttgacgatccccacatgttcaatgtaacacgactaggcgatctttatgaaacttctctgcaaacaaaaattcgtaccacaagaatcgctctgtagctttgcccggtaagcaatatagttcctactacaaaattgttgtaattaaaaatggggcctgaagaccatggctcattttaccaggactggaataccacattgcaaacacgaacataatcaaaagacaccatcatcagttcacacgccaacttcccattgtaaaatcacgacaaccatgtacccagaagctaaattgaaccaaagtatcagcacattcgcaactataaacagtcattcaacgacctatgtttaagaagactctagtgcacttgtcattaatagttatacctcaaaatatcaagtaaaaaaaaggctccggtctcggtcttggtaagagacacagaaggtcggacactagaacataactgttattcagagtacataaaaatgggtgaagctggaagctttgtatccttctacagttcttacaccaccccagatggaagccgtagcaccagctgcccaccgaccaaactgcacccagcaaacatgcattagatgaagttcacaatcaaattaaatagttaaactagtgaccctaaatgtacctcttcacatagtagtagcagaaatcagcaaggatgaatgtctgcacgatttccgacagaagcaccatagatggccacaagccatagcccagagcagtcaacaatcgaccacgagtatccaatacctgcaggatgaatttgttgtctttaaattaacataaattccatgcatatataaagtgtcaaattcaacattgtggatagttttttgtttctgaaaacccatgagtaacaactattgaatgaacaagtacagaaatttccccaagatgtccttaaccattaaaaaaagagcttttaagatgatgcaattatactagaaaaaacaaatcaaggtaaacaaggaagcatcatgaccaggttgttcattgatgatacctctaaagtacatgagttgagaaaactaacataataaggtcatttatcaaagtagaacggctaccataaaacagacaagaaatgccaaacctcaaaaaaaaaacattattgtaaattaagtgttgggattctgtgcgctgggtatggtacagaagaaacaaagaaagtaatgacaaaatcaataaacaggggaacacatataaaagtaagcttggggtttgtttagaagacgaacctgaagaacccagtgtgcacagctaagaaaccttgcaactcccaatgcaaacacatagtgtgctgtgaacggctcaacaatctgcaaaagatgg

SEQ ID NO: 3221 - DNA, 2703 bp, Oryza sativa
tcagaatgcgaaacaacaactacttatagataaatacttaatgagccaataactacaacaaaatcaaagtgccagttagtttggtaaactcaccacataactcacatatcagaaatcctgagaaatagagctatcattatctagaaaaagcaaaaacgaaatggtgatctagaaacttatgagaagtttcgtattagtctgtcaaactacaatataattttgtaagaccatcaccccggccagattatgcttatcaacctaaacatgtatgttatatgtaatagaagttcagtggttcttaccacatagtacaatgcaaaattgtccttgtccaccatataagttggtctcaatttgaaccggatcatgtagattacaaaaagtgtagctgcaagtgtagcagtatctagcacagtatggatgtcatactccataacgaagctgcagtatagtctaacagctagaaacaacgcagttaaatcctgagacttgagggatagtcctgcaagagatacgatcataaccgagcttttaatattcttagttatccgtgcattaatacagaaaaaataaatcacataatcatggaatgaaatcataaagaagctataacaaacatatgcttctctgtatcgtcgagcatacagtggcatgcaactcattagtcacttctcttgttcaaaacaaaactatgaaacagtactttgggttgcaacctattgcaaccaagaaatgaatggaaacattctgctccagaaaccttgcccaaatatagaaatagctggtttctctaataaaagaatggtgacatactactccctccatttccaaatgtttgatgttggttagttcaattttgagctccaacgtcaaacaaaaagaaaaggaggaagtactattctattccagccaaagcacaaaatattgctccaaacaaaccaactcaatcttacagtaatcaaaacaaaactatacatctatctctaaatgactttacccacaaccagtttctaaaacaggacaggacagggcatcaatgttatctgatcgctgatcgatcctgatcgccaagggactgatcaggatgattaatcgtcgatcagcctcgattaatcgacctgatcagtactatgtataccagtactaataaaacaatcatagtactaataattgatggcaagatagtcacttacttgccctagtataaagcaatcacaatataaagcaaccagcagtagtagcacatattcacatgtactaaaccctaagacgttttcaaaaagtgatcaataggtgctctgatcggacgattaatcgtgcctgatcaacgattaattggacaatcagatttctgatcgaactgatcgaatgaatgtccctgatcggagtcaggggaccgatcaggatgattaatcatgattaatcggatgatcagatagcactgagggcataatcatggaatgaaatcataaagaaatttaaaaaaaaatatgcttatatgtatcggtaatgattcacacattcagtggcatatgctactcattgcaaaatggtacctgggtttgcaacccgttgcaaccagaaatgaatgtaaaaattctgttccagaaaccttgcacaaatataggaataggtatagctggtttctctaaatgactatacctacattctgtttctaaaacaggacagggtaaacaatacaccgggttccttggttaattctcaacaaactgcaccatcctccgcaagaggactatatagcttattacccagccatgtgaaagcatcgtgcagccaaatctcctaatgaattaatcaactatcactgcttcataagatggcacaacctgcagatcagcaattaactatttctcccgtacccaaaaccctataacatcacagtgatacgtgtatctcccgctccatacaaatctgctcgcggaaaatcacaactaagcgtgaactgtcagaaacattttccgacaaaaacaggaaggagcctcagaaatcaaacagatcgagtgaatttcagaacatgcagagcccatcgcctcctagatgttcgccttagcaaaaccgccaattctcccagaaacgacttcacggtcgacgagacgaaacacaaaaatccacaaacagatcctactccggagctacgcggttgcggatccggcgatctcgacggatcgacgcgcgcgcgcacgcgcgcgcgacggaactggcaacaccgtacacgtgagccgagaggggggggcgaaccggcgcaggtcttctccttggtgagcttgtagatgagcacggcgatgccgagcgcgtgcgcggcctccgcggcgacgaagaggttgtcgtggtcgtggacgatgaaccggatgaagacgagcgcggccatgccggtgacgacggccaggaaggccttcaccttgggcggctgccgccgcacccacgccatcaccgcgtcgatttgacagcttcgttcctgtattaaccctggccgtaacctaacttaatcgccgatcagaaaatccgcctatggttatttgctgtcatagttaataggcctgcacttgaccgccctcgttaacagccgcctagattcaatggccaatatacgtgtccgtgagcgtgtgcattaagcttgttcgtgtgatatatccacatgcagggttgcctgaacgcttgtagcgccttagcagccgctccgtt

SEQ ID NO: 3222 - DNA, 4327 bp, Oryza sativa
ccatcgttttgtggtgcaacttaaagaaaccttatctataattttattagtagcattttctctacacgtcttccgttttttctatcggttctggtgatactaaatttagatacataaataaaaaaaattatatccatgcaaaatgcatattaaccatgtgttagttttgtgccttttttcatagataaatagcttgtctttttttaagtagggaaagatagacaacacgagaagtgtgtattgtgagtaacatttatattgttataaacgaacaatttaaattgtgttatggtcttgtctagcttgtgtagaagatataataattgtttgttgactaaatactcgtctatatgcttttgtagtgctgggtgctggagttggtcggtctttgtagtggtgtttgaattctcgtaactactacaaaattccaagacatgtaagtagtgtctctgttttattgtttgatagattttgtattctaccttgttttgagaaaaaaaacctacatataacgatgtttgcaggcatttctatttatgtagtgtcatcattactaaagttcacatattaatgaattgttgcagtttagactttagagttgtgtcgtgttctttttatcacgatgctcgtaatattcataaaacggttaaatgacacaaggaaaaaagttagtatctataacatgttcatcaactcatcttgtatatggcatgccttttatatttgcaaattagtaaatggctaattttgtatagggcatacctcctccctctataaactctcatgtaattaaacctctcatgttaatatatttacagtatgagcctcttctactattttcccgtaaaagaaaataataaatgactatttacttgcatcccaaccagatgttacatatgaaagtcattgctgcaaagctaattgaagcagatattactaccatcggaatagtggttaggctcctcagacttcgaagtcacaatcttattattaacatgtggatccatattttgttgagcccacatatattaaataaaaatatcacgtcacttcaagtgcacatgatcatggaccgtaagtgcttattcacttcaccatcatttttatatttaccaggttttactgttatcaaattttaagaaagtagcaatctaaacatgtcttaaatattataccaaaccataataggttaatttttgttgtatttaatgaacacaccctaagaacccacggtcctcaattggctacttcctccgtttcacaataagtcattctagcatttctcatatttatattgatgttaattaatctagacattcattaatatcaatataaatgtggaaaatgctagaataacttacagtgtgaaagaaacggagggagtagttggcttcatcgcacaaggcgtccaggcgatgaagcccgctaacgtcgtttgcaatattgggccaggcccaaaacgcaacaagcacggagtggacgggctccttgtgtagtaggccaacaccttgggctccttacacgaggaacggctggcccagcgaaggtacgggttgcgttagcgtggcaacaaacacaacaccggacgtggccacgtgggaggattcatggatcatcacgaataacccccctccatcctcccgaaaattacagatagcaccatgcggttgaatttcgtccaaaaattcctgtcttgttatactacctgaagaaatagatgctaagaacaagggtgtaactgaaaaataccccgcccatcgtctctctcttctcccaccgttcacaattcctcttccccttcccacggaatcctcttcctccccatgctccgacgacgaccatccctccgattccccggccatggaagcagacgagccggccgccgccgccgcctccacctccctcgactccgacgactccttcttcgacgccctcgactccctcccttccccaccctctcctcctcacaccccttcctcctccaccctccgccgccgccgcccgcgccgcggatggagtctgaagcagcacgaggacgacaccgccgcatcacctacgttctctgattcatccaccatcaccgtcgtcgacgaggccgtcaagcccgactccgaggagacaagctcacaccgtcctcccccgcctcccgaggaggaagacgaggaggatgcggcggaggcggcggtggagggggaggtggagggggaggtggaggcgagggacgcgaagctaaatccggcaccggcaccggcaccgacgccgacgcctccgccgccgggcattctcgagtccctcgccatgctcgtcatcaaggcggggtgttccaagtcagcgcgctcatcagctgcctcacgttcccgattcggctgctgcaatggtggttcctcctcgtgacggaccctctcggattggtgcggcgagcgagggggtgggcgctcgaggtggctgggcacgccacgggcgccgcggccgcgcgtctcggcggcggggaaggggtggggcgcatggtggcgaggctggcgtgggggtcgctctgggcggtgtacgtctgcgttgttctgtgctcgattctggttatggcgttcctcggaggagggctcttggtggggaaagttgtggaggagcccattcaggttactgagaccctgaattttgattacaccaaaccgagccccgtggcatttgttcctgtacagcggttggtgccgccgaatcagcggatgcagctcgaggtgttcctgacgctgcctgaatcggattacaaccggaggcttggagttttccaggtacattttgctgtttgtccttgtcagattgattttgcattggtcattcctttgataaaagggaaaatgatattcgattgaagcagtgtcgagtaaatgttgttagaaacccatattaacattctaaactgtaaaaatttatgacatagtccctgagcatacttcacaaatgagaagataccaactgttaactcagttgtgcactgagatgttatataatttgaagatttgaaatgtttagtgaaaagttagcaggattaaaaggcttatgtgttgttctgtagaatcggttctcaacaggggacattatgttttgagttttcactatttcactcagccgtagttttcttatgacaacctaaatatttttaggaacacaaaaggacatctataaagcatgatagttatactgttttttccctcaacttattactgtatcaatttaagacatgccaatagaaatttttttttgagagaccaatagcaaaacaaattatacactagaaaagatacaatcttacttctaatataatatgggtctcaaaggaatctggtggacatgtgacacctactctaaaatgttgatatctaacacaaaaaaaactttgccatacagatgaatcttgagcatgataggtgtggtgcatgtggtgtcactgcgttatgctgcaaatgctaattgttgggtaattgagtgagctttatgcagacatgtgttacactagcaacatggctaataaggcattgatagaggaaacttttctgtccataaggttgcgtagcgggacaatatggttatcaatgagagagttatgttaactttcattctgtagctcaaaggtccaatatcatgacggaacatataatttccctgctgtagcgtgtcaagggagcatatacccagtttaagttttctttaattattttgagttgagatattataaatgtttcatacgcatactttttggtctttcatattagataccctttttttagtaacatcgtgtttagcatgtctctattttcaatctgatttcccttctttcattgagtttaggtaagagcagaatttctatcagcagacggcaaagtgatctctacctcaagtcaaccatgcatgctaaagtttaagagtgcccatatgcacttcatagaaacttttctgcgaagcgtgtctcttttgtctggctattcctcagaatctcaggtcataagactaaaaatgaggggcattacagaggcttcagaaccagtaatgggaataaggataattcttgaacaacgagctgaatttagtcctggtgcaggcatcccagagatctatgccgcatcactaaagcttgaggcagaactacctctgctcaagagaatactctggaactggagatggaccctttttgtctggagtagcatggggttctttgtttttgaattattgctggcccttatttgctgtagaccctgtatatttcccaggagtggacataacgctgcaactccttaggctagctcatgtaatgtacacttcaaaataaatgcaa

SEQ ID NO: 3223 - DNA, 431 bp, Oryza sativa
gaaaaagttgttacttttcatgtacggacgcttaagcaccttgagatagtagagaatgactttgttttcaatgaagtagaggtataaacatttctaacgtttaaaatttacaattcaccaccaacgccaacaaaatggatggaatcacttgaaagctcacgagttacggagagtactggaccgatccacctataaagcgcagttcctcggcttcattaacacgatcatttagaaaccttgctacccgctttgccgatacaccctggaaagtagaaacattcttttcacctcgtcatatacacaaggagaaactcatgtgagcaacttaagctgacaacgtgaaaacacaacaatgatggtccactagtggtgctacttgccaaggtatattaaaaaaagggtccgcgctctcattctactaacaggatagg

SEQ ID NO: 3224 - DNA, 6005 bp, Oryza sativa
  unsure (1)..(6005): unsure at all n locations
nnnnnnnnnnnnnnnnnnnnnnnnnnnnnnnnnnnnnnnnnnnnnnnnnnnnnnnnnnnnnnnnnnnnnnnnnnnnntaaatgaggtcactatgcaaggtttatgttgagaattgagcttaagagtttatgcaaaccttcactgctagccatctaacatatccagatctcctgattgcatgcattgatggagcataacaggtacaagcgggcctcattttcacagaagaggaagttgagtacagagtgcgcaatgttctggccagtgttgaatcatctctctctaatgcatcatacctatcgggaaaccctcctgagatagtggtttggagtgcctcattgtatgactacaaggtaattttttatctcaggttatcattccctattgctatcctctagcaacctaattatgtttggcatgctaaaatcattccaccagaatccgagggaattgtcaacatcacacaaccaatttttgaaggaaaaattaccgatgaacacacctcttgctgccccgtctttacctgctctgaacatagagatagagacaggtgtatttcagttctctttttttttttggttagtgattatatccttgatcatttttggtgtgtgcattgtgatacttgtgggctactagctaatatgttcaggtattttacttttcttttttccttcttgtagtatagcgaaggcaaccgaatatattttttttttcaaaaatgtatttcacttttctttgaatcaaatcaatccatctcttttccttgtgatcagatttcttgtgctattgatgcctctaaacgcacacacaacacagtgtcaaacttaaacgaaatcctctttagctacacatacaaaaacatcctccttagcaatagcatggtttaatctcatcatcctgagtatgcattacatcagtgctgcgtacaagttcgattcaacgcaagctgccaatcaccagagcctttggaaaggccatgaaacggccctgtcagtttggtcaccttctcccctcaaaaagaactgaagcattagcactccatgacagcaactgaagcattaagcacaccatgacagcaatctggccccccctgttctgtctagagtgacatcctttcatgacagtcactcatcatacatgctggagtatgtacttatctagcatcctttagctttgatgatgtatgtagagccaaccttctgagtgactttgcatgataacaaagcagcataagtacttagaaccagcatcagccattggtattagtacctcttgcccattattacattttgttattctttatttggtggccatctcaaaaatgcttaagcagagttcccatcagtgaggccataaacaaattaaagctctgattaggattacccaaccaacccaccttatctaagcacaagctttctttcaccagggccttgtctttgagtctcaccaaacctgacagtgacacaagcaattaatcctggcctctgaaatatgtcaagttgcagatgacaccaattccttttgacaagttaccccttatcatcccttcttccttcctgccccctaatgataggctaaggtcctatgctcagtagattatgtattatggattaccacaccacgcttcccgaacccctaatgaacggtactatatgttttacaaaaactttcttcatcaacagttttaagaaaaccttttcaaatcgacttatcaaccaatatttacttcattcatttgcatcctcaaataatatgatcataaactcaatttcagtttatcatccatcttatgctaagaacgcccttcaagagatcgtttacacaagaggagtgaaagaacatgtagttagtgattgcagtgagtagcaatctaagaccctagcttcgaatcttcgtaggagcaaatatcatattggattgtttgaggggctaaattttcaatttaaataactgtgtatattcggttggattagaggccgaataaaaattaaccatctctaaaaaaaatatttacaaaagaggtaaaaagcaagctactaattacttgttgctatcaaatggccaccactaggagtagtactagtgtactactagccctgttgcttgctctctctgcaatcctcctcggatttgttaatgattctgttcttttttttcatttcgcccttgtcatgccgtctgatcacgtgctgtgatggatgttaacaagctattgctcctgggccaccagctcgattttggctctgctatctgctgcattctcgctgtctccttcgtgacgcactcgatccccctctcgccggctagatttcttgggcagttgctacgctaccgcctcgctcgccgacgtgtgtgccgggcaaatcgaaaggcaaggatcccggcgagcgcactcccggatcggatggtgagatctctctggggcctttttgcagggcacacttggcatctgcttcttctgatgcggatgtttctcatgatattgcggtagctagatatgcaattgatagtgcagcgataaggggtgtatagtttcaacatcaaggtcctatatttaattccaacgcgctcacaatttcttctttaaaaaaatgtttggagggacatctcttcaaatctagtttttttgacgcatacatttctcagggtaaatatcggtacctcttctactctatcttccataaactagctacttgcctgtaaattctaacaggtcaggcatatataatgtatgtttggcagagctccaacttttaaatttagcttcgggagaccagctccactttcattttgtgaaagtgctccaactagctctactcccattttaggtagagttgaaactgttttactgtgagctggagctgtgccgaacagacccataaccagagagaaaaagttgttacttttcatgtacggacgcttaagcaccttgagatagtagagaatgactttgttttcaagaagtagaggtataaacatttctaacgtttaaaatttacaattcaccaccaacgccaacaaaatggatggaatcacttgaaagctcacgagttacggagagtactggaccgatccacctataaagcgcagttcctcggcttcattaacacgatcatttagaaaccttgctacccgctttgccgatacaccctggaaagtagaaacattcttttcacctcgtcatatacacaaggagaaactcatgtgagcaactcaagctgacaacgtgaaaacacaacaatgatggtccactagtggtgctactggccaaggtatattaaaaaaagggtccgcgctctcatcctactaacagtataggaaatatggaaggagaaaaaacatagagtgttttaacgcaaggggctcttggcaatagctaataggttgccaaaatcaaggagactaacatcctcatctttttgctaaggcttatacttatcaactaaaatttaaaatttaaatcttaaatttgaagttgattttgggtttttttatcgaaatttatttttcagcctttgctttttagatagttaagaacacgtatataaaggttttattcacaacttattttttatttgcaaatatgccgtttggcttattcaccgaataagcgaaacgattggactgtataacctaggacctagcatgagcaaaacgacttcggagctttttttttttgaaaggtttcggagcttattctttagctttgttctactttttttatagttctctttcacacgtatacaactcttctttttctcttattatatttaaaagtaaatttcataaaacttgaagtagtttaatcaatctatcacaaaactacaaatttttaataacatgtatcacaaaactacagatttaacatcataatttttttatataaaattacagatttaaggtatgatataaaaaaactacagatttaacgtcacttttatcacaaaaactacaacttctataacaccaatagtgctaagatataaactctaaactaaatctatagttttgtgatatgatgttttaaatctatagtttgtgataagtttggtgctaaatctgtagttttgtgatacatatctttaaatatgtagttctacgacagtttgatcaaagtatatgtagttttgtaaaatttactctatatttaattaatgaaattgtcacgatctagtacggttcgttcatttgtttttatttctagcatactacttcccaatccaaccggccactgttcatgattatctatatttacagatgtattgctaggcacgattttttttaatcaagtaaatttctagtgaatatcaccttaagtttaattttaaactcctaaaagtgtatatatccgtggatggaggaagtagatgccttctccttgaacaaattggaagtggtcgtattactgcattcaaagacatgtgttgaatgttctaaaaaaagacatgtgttgaaatgtcatagggcaattgttggatgagttagaatatatttatttagctcgagtctgatttgctgaacataataaattaataattaatagacttctaagagtgactttaaaaaataaggacagttgctccaaactagccctagttaagtcagaagggaagatggataagatgcaggtaaatgttcatttttggtatatccttttggcttgttctgcagaagatacaagcaagtacatgtcacagtattagttggaaatcaacaggctggctgttggatttgcagattaacttaaaagagactgtcacttgcgaagttggtatgactgcaattgccgctcttcgaccctctaaacggatgatgaggcaaatgaatgatcccgcgaatatatcctctaacataaagaaaaaaaaaacagataaaggccataaacaaactctgaaagaaaagtgttacaacattttatatctagccagtaataaatatatagtaccaaagcttactggtccatccatccgtatgactatgttctgaaccttcaaaacatgaaagagtcatttggttacaaaattgactttagttatgagtgcaacttgtcgtacaaaggtcaatggtcttggtgtgttcttatgtggtctctaactactacaaaagaaaatcatccgcatacttttaggctgtgtttagatcagaggtgtaaagttttagtgtgtcacatcggatatacggatacatatttaaagtattaaacatagactaataacaaaacaaattacaaaatcctcctgtaaactgtgagacgaatttattaagcctaataatccgtcattagcaaatgtttactgtagcaccacattgtcagatcatggagcaattaggtttaaaagattcgtctcgcaatttacacgcaatctgtgtaattagtcattttttcgtttatatttaatactccatgcattcatgtgtccaaatattcgatgtgattgggtgaaaaattttaacaggtgatctaaataaggccttagtctatactactgcatttgaggtctcatttatgtagagtatttatggagagaagcttcagaaattttctaaaagactaaactgtcaaaatagtacaatactaggacttcttatattgcagttgtaactatcgccataatttattagagctggcaagtttctactcttcgttcttagttaattctccatcaattcattaaggcaacatccaagttactgattaaatcttactttggatccttctgaagcatttcaaatgtcactgattgtgaaattatgcttagtgtaatgttgccgtagacccgtcaaaaaaaagttcacaattattactccctccgtattttaatatataacatcattgattttttataagtttgaatattcatcttatttaaaaaaaatatgtaattattatttatttcattatgccttgatttatcgttaaatgttcattacgtatgacttattttttttatatttgcataaaaattttaaataaaacgaatggtcaaacatttgtaaaaaac

SEQ ID NO: 3225 - DNA, 7190 bp, Oryza sativa
  unsure (1)..(7190): unsure at all n locations
nnnnnnnnnnnnnnnnnnnnnnnnnnnnnnnnnnnnnnnnnnnnnnnnnnnnnnnnntctatagggtgtcgatctcactgtcgtgcatcttctctatgatcttttcagctctcacatctccggtaaaaatccatagcacatctctcagaaattttgcatatcacatcgagccaaatccttttatttttaagttcaaaaaaaatccttttatttttaccttttcactttgtgttctttgggttgcttgctttccttttcgtttacccctttcactcctttttctggcaaacaagtttgtcaaaactatagaataaaaaatgttgtcttcatcaactagtgccgtagtatatatgtaactttatttgtccaactcaactgcaccgttgaattagggatacctagctacctactcaatcgttaataactatcattaagaaacagataaataaccatcatgcaagtgattaattaacaggttataatataactactaaaacctcaccaactcttcacagagaaatgttctaaaaaatagattcactaattaagtaaagtaagcaacacacgtgcatgctttgcacataagaatgtaccctacaatatctgaactcattagcagcacatacaccattgtatatatacacaaactagtgagctaatattattgtacattacccacccacatcttttattgaaaacatgtataggtactacaccaacaaatagttctatctctccaaaaaaaaaacaaagatctaagtatctccatttgagaagtaataacacttctagttaatggcacaaacccccgaatcaatctcaaggggaaaatacacaacaacatgcaccatctacgcataccctctctcaaatgcatcaatcccaaccgttgattggttttccgaagagcaaaggcctcgacttgtgatcaccctccgatcttggccggccatgcctagctgctttcacaatcttgatgcttttattaattatacacttcacttgattatctacactgatagcaacacaattaagtaagctgctgacatcttctagctagaagttggacccatttgagctgttgaccatggaggcatcgaccaccaagctcgagtctcccatcccaaaatcttggtagtcgagcagccagtccgtcgtcatgccgacgtcccacggcagcgccggcgtggcgccggtggcggcgatgctactgaactcgtcgacgtcgttgctggccgtgaaattgagccatggctcgtcaccggtgggcagcaggtcctcttccagcagccacttcaccagagggtcctggtgatggctactgctgctgctgctactgccaccggcggtgctggcggtgttagtgctcgactccggcgggctgtcgccaccggcagacacggacatgtccctgacgacggcgtcgtcaagctgccggctttgctgcctggtcgcctcgccggacttggacgactccgccgtgacggtggactgcgaggtggtggccgggctctcctgcttccggtcgaggggctcgtgcgtcaccgggtcgatgcccatcttgatgagcttcttcttgatgtgcgtgttccagtggttcttgatctcgttgtccgtcctgcccggtagcttggcagcaatcttggaccatctgcatagacacaattaacatcaacaatagaaaagtagtagtgattaagtttgtactagtagtaattctcacggagacatcatgcatacgtgcatgcttaagtaagaatgaaaattatttactgatgggaatgtttacgtagcacacgactgaaaaaaaaggaataatgtcaatttcgtaacagtagttaatttggatggagaaaccagttggtgatttcagccgggtgcgctatgcattcacttttaattatatttctaaaagatagatagaaataaaaaaagcaattcatccttgtcaatcattttcgcaggtaccccggcttgctgatgaaacattgaaaccgcatggaattaccatttctacaccatggaataaatggtgcagatgcctgttctgttaatcattagagtttgagggagacatggaagtatgatgactgaccaaactttactttctccataatttactgcctaggagcatttcttatgcaagtttttacatagccgtgaaaacatgccaccactttcataagcaaatagaaatattttactgatttgaagcgcaactctcaattaactagagatcacaacccatctctatctcatttgtttctttaagctatctaaggagtagccttttaattaagagtgacaaaacaacaaaggggttggtagtgtactttttaaaaagctttcttccattttccaatgaggcaactggacctaagaggatgctttctatttctgaatcaacgtgtagggttctcttagccacagaaatcaagctagtgggagccagcgctctagaatgcacatcaagaaagtgaaacaagaaatttccaatgttcttctgcgagactattttccatggctacgaaattgtatgccacttggacaccatataacagctaaggatatagagttcagcggttgtgtctaagagctgtcatagaaaggcttttatgctactctctagtttacaaggagcatatctaatatgtgtaaacccataattaattcagtgttgacataaaaaaatcaaaacaataaataagtaacattaaatttggagaaagaaaatattgtggatctcattgtgtagtacagtccttttgtttcttctacattttttttcaaaatatcggtatcagttggtacgacagtgatttgcacaaaaattagctatcttctgccaaaagtaaaagtaggcacttaattaattctccataacagggaccacaattaagcatgttcatacttggctaatcttgtacatctcccctccatcattgagaaactaatacacgcatgtgttgtttgatgtttcctcgtactatggcaataggtcaccagcatgtcatatgcttctcctaccagtgtggtgctatcttttttaaaaaaaaactttacaaatctggaagtaattatattattatttttttgctccaaattagattatttattaaatttccattttagttgattgaagaattgtgtgcttaatttttcttaagagcattacatgatggaatcaagtgctgttcaaactccaataaatagcttctactatctaatatataactcatcagattcttctaataaagaatctaaacaatgaatgaattgcaagcggccagtcacttgtattttctttacaatattgttctttgggtttaaattaactgttgggcttacaatattgttctttgggtttaaattaacaaaagcaagctagctaggtcaacagtgcgcaactacaattatcgtcgttttgcacacttctagtttttcctatcagatagctggcatataattaacttttgctataaagaaaatgcatacgtgctaacctcgtgtttggtttggatcatacaaaacaaagatagatagaaaatagtgtgattctagataaggttttccattctgtcttctccacgttatatctatgcatggcgatcgaaagttctagattctgactggccggccttcaccagtgtagaaagtctcgtttcttaaatggatttctcgtgcaagtagggttactatgtgctactgctaaatattccaagctatgttttgtctccttcaaagcaagaaacaagtaatccacaccttagacagcgacatgaaatgcatgcgagttagaggccagagtctacccttaatttggctgctaacctgtgatggttacattagggagttttcttccatggttttaccaaccagtggacagtaattcgtacgtttgatcctgtgtgttgacaaggaacgtacctacgcgctaatccatgggattaattacttcatcgtatactgggtaagatactttcttggcgacgtagtacacatggagacaagtctgctagcttgcgtatgacagcagtagtagtagtgatgaaggtttacgtacctacgtgaccgtgatgtcacgtacatgtaagcgctatatacacttatttaattagttcacatgagtgattgacgacctatgagcttcattgtcaaagtactgtaatttggtggctttgcgacctcacacattgatgacagccacacatgtcgtcagtcgtcttcgtatcaaataatgggcatgcaggtagctaacatacagtactagtagtagttctctcaatttcttggaccttattaaattactatacggtgttagttattaccgctatcaaactgctagtactactgagctttttaatgatctactcctatttgtatagagagttaatccagctctatccacatcaaaatcctatatggttacccggcaaaagaaaatcctatatggtttaagatggcacagtgcatatgcatgaaaaatctattagcgtttgtatgcatgcatttgcgtgtgtgggctagacgaggtagagcaagtaacgtaggtgtgtgtatatgcatggagaagggggtacctgttgccgagcttggcgtggaggtcgatgacgagctgctcctcggcgtcggtgaggaggccgcgcttgaggtcggggcggaggtagtttgtccaccggaggcggcagctcttgccgcagcggagcagcccggcgagcttcggcacggcgcgccagcagcaatggccgttggtcaggatgaagctcatcagcttcttgtcctcctccgccgtccacggccccctcttcacccccagcttgtcgcagcacggctgcctccccatcctttatatatacacacgtactgctcctcctccgctgccggtgatcgccgccgggaaagtcgaccacggcgagctggagccgctgctgtttcgaataggcagaggcgaggcaggttaagttaattgattagctaggcgtgcatcaaagcaaagggggtgggggcgtgacaagtgcctcgcaactgcaaccggagcgtgcgggtggaagggcgtatatatagctaggccctcctgctccaagctctttttaatctccggtgatggcgacggcggcgacggaggcagctcgctgacttagctgcgcccacaaggctaaacaccaccaccacttgcagtgctgcacacacacaaaaaaaagaagagattttgatacgtgtagagggctcaaggagtagtttgcggcttgtgtcgcacacctgcatgcaccccgcccggcctggagactgttcctcgatcgacgctctcctgagaaagaaagagtaagagatcaatatgtcaagatacattggtacagtctcaagctctcacgcactcttgagtaagggaaaaagtgactttccagatgatgctacagagcttgcacgttaactttggtgcgttatcgatggatgaaaatgatttttatggtaattattcaacataataaaaaaataaactattgattaaaaatagttctctgaaatattgatggaaaaagtttctataaaactcataccgtttagaaatactagtaaactaagtaaacatgctcacaataatccataatctgtaagctaccgagaatgccccttgaaagatcgattaaattattattacactaatcctccttccgtaacttcttagaatttttttctcaaatataacaacatagtaaaaggtgatttttattactgaactatccttagttatattatcgtccaactaatccagacctataggctataccaccacacaacctttactcctcctttaatagctgtgtaaatggttaaaacttattatattttgggacggagataatattattttattttcttaattttgcatcaatctcaaggcatgttggatggtagatcaatcgtttacctctgcttcaataagctgctgcatccgcgcgctgcaaattaagatttcctttttcagagggtaagtgtaaacatcagcaataacgtacctccaccacacaaaagctacagtccggtgtcgctgaaggctttgccacttccgttccccacggttgcatgtctgcctgcccgcccaccttgccgtggttgcgcccttacgcaatgatcccatcaaccattccgtcagccacaaaaaaccacggccccggcagaacaggcatgcaaagtggtagatgcaatgcaagcctgcaactcgcagcgctcagcatgcagcccagccaacctcctcggagcaagtggcatcgtcgtcgacgtcgtagacggtcgccatgagcaagcaacctcgctcagccgtgtgtccagatggccggaacgggtacatgctttgtacgacggcgacctctggcccgggaaagaagactcgacgaaccacagctgcagccagacgtctcgtgtcagccataccgatacgatccgtcagagtgtcaccttcctccggcctgtagttactgactgattgacttgctgtaattaacaggcaagacagccggccaaccgttgttcctgtgtcagtatcaagaaacgacgtaagataaggtgcaaagatagccagacgatccatgaaatactgtaaaactgtagggaactgttaaatgaattcttaggtggttaggtttcactacttcagctatgctattccagcaaactgaagaatgattgaatgaatatgtagagatgggccggtcatctgcaacagctaatgctactgaaaaggcgggtcaccatttacaagtacagatctagtttctaagtgcacttcagcactgcttgtcaataatgagcactggaattccttaagaccagttttattattcaactacattattaagggcacaaaccaaaaacaagaagacagggagctcattcatgatcaggttcagtatttcagaatcatgaacatggcggatactggtgcggtgtggttgaaaaatagtgctaccaatgcctgctaagtcggcaggagtctattttatgattatcttttactagcttctacttacaaatttacttgatgcgaagttggaaggtgcgaagaaccacggagaaacaaggtgacatatcagccatacttagcgaacacctccatagaacctgcatactgtagtactaattgacatcctaaaattggcaatccaaccagggtaccgagctcgaattcgccc

SEQ ID NO: 3226 - DNA, 1225 bp, Oryza sativa
ctagcttctacttacaaatttacttgatgcgaagttggaaggtgcgaagaaccacggagaaacaaggtgacatatcagccatacttagcgaacacctccatagaacctgcatactgtagtactaattgacatcctaaaattggcaatccaaccaatgccagacatccatgtgcttatctgtcagtatcaaaaaaaaaatgatgttaggtcccagagagaaacaatacctgaaaaaaatgagatcgtacccaataataagtagttttcagctacaatattccatcaaggaatataaaagattgttcattacagaataattcgttagtctataacaaggtgcagtagttccacatattagaacaattttgagctgcaccatgtttgcccactgagatgaactccgagttttgtactctgaaattgtttccaaacaacataaacgagggtactaaaactcacttctgctcaggaatgacgtcaacagacaaaagtaaccatctgcaggtatataactgattctccgacaaggtaatgaaatgaccgttctctgtaacaaaaaaagtaacgtcaaatcagtgttctgcgcttcagaaaattgaagtgggaattaactctcaacaaatattttgtgccaaatgtgtcaactaatgtggcagatcatgagctagtctaaatcatatcttggcaaatcccaggaatatgtaatcttgtgtaggatacgaacctatttagatactaatggtaataaggtatctgatgttggcaatgaaatgctggactgctagaatgctatttgcattgatggacgttttaatagattctttcagctaatagaactgatctggagtgagaaagaaacagtgttattttgccaccatataatatgggttttgctggattagcctgcgtagactatacagtgtataaatttgctttgtcaagatccgtagtcaatgaataacagtggacctcttagtatgagaaaggtacttgagcatagtgaaaatatgaatataccaaatgtaaatcaaatagacagatgagtgtttgtgggaaaaaaatagagacatgagagtttccacttgtccagactaatgactaaaattcaaaatttcacccaaggaacagaagaagcaaacagagagtggcagagtgagacaccctttaataatatagaattatatataataaattagcaattttaacacaaactagtgattcgcag

SEQ ID NO: 3227 - DNA, 628 bp, Oryza sativa
  unsure (1)..(628): unsure at all n locations
gtaaggcgcgcttctcgtcggtgccggtgtctaagtgcgcagaagtgcgcctcatgaagcagatgggacttctcaccccgggtgaaccggtcggggatgcggcggtggaggcttatgcaaagtccttcgacacaccgcttccgtcgcatgtcattgccggtctgcgggtgctcacacgcctggatgaagtgcacgacatcccggtgccaggagaggaaggaaccaccacaacgacggtggtctgaggcacgcgctgccgcgccatgagagaagtcgtcagctgtcatgattgtccgcatcagtgttagagctgcagaaatggtcttccatcatcatctgcatgtatcctttacatttctctgcggtcttaagctgctgctcgctgtatggtcgatgcgactagcgctcccatgcagcaacggccttaagccggagctccttagtcggttgatacgaatagcgctcccggtagacaccggccttcagctggttagtagcagagtagacaggctagaagatagtgaaattgcttctacatggtcatgtttggtttgtagttgtaggtcatggaagaaaatatatagccctctatnnnnnnnnnnnnnnnnnnnnnnnnnnnnnnnnnnnn

SEQ ID NO: 3228 - DNA, 593 bp, Oryza sativa
  unsure (1)..(593): unsure at all n locations
nnnnnnnnnnnnnnnnnnnnnnnnnnnnnnnnnnnnnnnnnnnnnnnnnttacatctttggatcttctaacagcggaaatacatccaatgtgggtacaagatggagaacaccaacattcagagctgcacttgcatctgaccgcaaaatgtctcccttggcggtaggcctctcaaaacctcccatacctgttgtcacaggaaatccaacaggtacgggtgctgtaatctgagtacccttctgcacaaacttctccatccatgatatctgggaagaagtacagttccacatgattattaatctagcagccatacatgatgaatagatcaaacagaataacagggagccagagaatgttaaccacgagccaagagtaacaacaggtggaaaagatttcaactcatcccagcagctgtttataggggggaaaaagaagtccaagagtgtgcgtttcagttcatgtgttcattttagttggatgagtgtggtttccatttcaatgtggacttctttcaagcaataaatttgttctaaaacaactaaaaccccaatgaccaacaaaaccattaagggtaccatgatcaagagtagatgt

SEQ ID NO: 3229 - DNA, 1026 bp, Oryza sativa
  unsure (1)..(1026): unsure at all n locations
catatatatctccacaagcatgtcgattgtgctgttgtctccacgctggctcagctctagtaactcatcgaaactgaaagaaaatcatacttttaggagttctcaaacttctcagatctcaccagaaatgtatgatgtccatgagcagaagaagaaatacctcttgcactttgtcattaacctccccaaaccccagtatgtaccaccaccaacatttgttccacttactcgttgaaactttccatgcccatcaaccttcaaaaacgacgaccaacaaaatccagcaaaccaaaaaaagaagtccaatccaaaaaagatatttaaaaaaaaaaactgcaaggtaccttgattatgctaacaccagaccccacattaacaagaaggaatggaaacagatcattctggtcaatctgcacgtattccttttggccatccatgtgcgtaaaggcttcatggcgtatagactgaaaacacataagtcttactaatgtaatttaattttttgaatgtgaacaatcttcagataaatttgaaatatgacttactgccttagtccattacatagatcatatagaatataaaactgaatagtctcaacctaaatagggtagggtaactcagagatagaaaccttcagcaaaaaatttgctccagctacaaggcagtccatttcatcttccttttcaagactgactcccaatctctccttgaagagatcagcatatttgaatgctccaccacctgttgcctttccacaaaatatcatagtcaactaaaatatataactttaatgccatcaagataatgataactcagtcagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3230 - DNA, 849 bp, Oryza sativa
  unsure (1)..(849): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtgcaaccacaacatctgcagtattgccacagcaagttaattgaaggtagaaaaagatagacagtggaagctaaaaagaattccggaggatggatttggatgaaaaagaaggcatgaaagaaccaatcaaatacacacatctaacacagtgtgtatagagaggaagagaatcatgcatagatgaataaaacgtgcttaccaacatcaggttcaagtgtagcagcattcaattcagtcacaagcttgctgacagagtccttcgttccattctaaattgagggacaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3231 - DNA, 8607 bp, Oryza sativa
  unsure (1)..(8607): unsure at all n locations
tgaagttcgacaacctgtttccccgatccattggtctatactacttaattttgtttcttgcaagcacaggatgcctgctctggccagctcggctgcttcgaggactgcctctcttcgtgctgggttatttagtccgcgaacattccaactgagaattctcagatgctgtaacatttgggcgaagtataacacacaatttttttccaaaaggatcgatcccatagtgttttccaaatgaattagttcataagcagatagagggctatatattttcttccatgacctacaactacaaaccaaacatgaccatgtagaagcaatttcactatcttctagcctgtctactctgctactaaccagctgaaggccggtgtctaccgggagcgctattcgtatcaaccgactaaggagctccggcttaaggccgttgctgcatgggagcgctagtcgcatcgaccatacagcgagcagcagcttaagaccgcagagaaatgtaaaggatacatgcagatgatgatggaagaccatttctgcagctctaacactgatgcggacaatcatgacagctgacgacttctctcagggcgcggcagcgcgtgcctcagaccaccgccgttgtggtggttccttcctctcctggcaccgggatgtcgtgcactccatccaggcgtgtgagcacccgcagaccggcaatgacatgcgacggaagcggtgtgtcgaaggactttgcataagcctccaccgccgcatccccgaccggttcacccggggtgagaagccccatctcctccatgaggcgcacttctgcgcacttagacaccggcaccgacgagaagcgcgccttacggccgctccgccgtgacggcatctgcaccaccttgcgtccgcaccccttcgtcttggccgcgtcgggcggcgccagctcgagcagcgcctgcaggatgatcggcggctgcagctgcgagaacagaggagataagacgaccttttcacgttcaccttctcctccgtggatgggctgagtctagaccgtggcctggtgttgctcctcgcaatcggcctgctgcaccagggtgggctggtctcctgtggaagcttgggcctcgtcatcttgagtggactgagcgaggaggtccatcttgggggcctgctgcgcatctgggccgagatggcccatcttctcctggcccaactcagctgccgactccaccttatcctctcccagtatcggttcttccccacccgtcctcttcgtcttgttctccgcctcccgtgaagacttgggaacgatctctgccaggagcggcagcatcgggtcgtggtccccctgttcgtctgagaaggggaggagaggtgaggagcataggatctggatcagagggtcggggagactcacgagagcgtcgactggctactggtcgccatcagcctggccactgacagcgaccaccttggttgttgcgtcgcctgcatcgcccgtgccgtcctgaccgcgaggagtcaaggagcttggggagcgcgtgcgacgggatctacagcggcaggagcatcgggagttgtgcctggtccgtgagcggccttggcgcccatcaccgtgcgctcgctggcggccggaaggatgcggcgtgcggctccggtgtcgcgccccttccgccgcccgcgactcaaccgactggccccttccaatgatgacatcgcgcagcgagcggcggcgtggtggaatatcctcagcgtggcgccgccgcccgtcgtcatcctcatcatcctccgggtcttctcttctctgcggcggtgccctgcatccccgcctcgctgccgcccgtcgccgaggaggctgggttccgtcggcgcagcccaggtaccactggaaggtgcgcaccgtgggtatcgggcctcccaaatcagacaagtccgaggagggcagtccgctcaccccggaagaaggcgagcagggcggtcctggagtccagtcctccatctcgtccagatggactatgacatgcggcagcctccccctcggcggcggcgcgatctcgtccggaagcggcggtgtgatgccggaggtgacacgcctagctcccggcgggaagaaggtggagagcactgttcatggcaggagatcaggattctgcatccacatccagcatgagaagatggccgtgttctgccgctgaaccgactcatgctcgatgcaatcgaagaggtagatgggacccatgacgccctccaatcctgccctgttccatgcgtactgcggcaatccctccaggcagagccgcacgcgaaaccaccaattcgggtggtgcacatgcctgtcggcgctccatggcgtgatggtgaaccttcctccatccagagtgatgaagcctctccgcgctgccgcggcctacccctctgggaaatcgaagaagacgaagaaatcttaggggtgatggcgcgtgactcgcaagtctgagatggggatcccaacctgctgggtcagtgcacgcaccacctccctgggggatgtctcctgtccctcgacctcggccgagatgagtgcgccatgatagcgaaggcgctccaactcgtgctacatgagctccgtcatcggcaccattgcatagccgactgccggccgttgattcggcagaccaggtatgtgatccatggtcaccgctggtttgtgcaaacgatggaaaaccaaaccagggcgggtcgttgttggttgctgttggttcttgctgggaagtggtgggaagatgagtcgggattgaatggagggggcttgcttggggaaggtgaggcgggagtgaatgggttgctttgatttgtttgggcagcggaaggagatgtgtccactgcgtctacaagtatagcagcggatgggatccctgcaagctgctgcctggtgatctgaagcgtcagcaagtatctacccttcaaggcaccgtaaattattgggattgctgcctgaaatattgatatggttcctccaaagattgaaccatattgttggataaaagtggccgtggccttaaacaacaaaatagagacaaattaactttcacatgttatattgtcatcataactagtaatatggaacatttgataatacaaatcagcggaagcacttgccgtgcaagatctccttgaacttttctctgagatttagtggattgaaggaggcagctgggcgattgaagacggcctgaaggttgatgaagaaggatttttgcgcttccgccaccaaaactttggttttaccgcttgccattttgatgaaagatcttgttcttctgcctcgatttgagacttgcttgtagctcttgccggggctacgattatcgactttaatgttgcttttcctttggccttcttctctgcatcttcctcttgtgccttttcgggagggggcgtaatggcgctccgtccctctcctctctctgcagtaatgtcgagctcctcttcctggcttcgggcattgatttcctgatggaaagccttggacgccggagatggagaagctgctttgcgtgctttggcggtctgcggattgaatgtctccgctgaatgttggtgtagctccagagcaatgacgtcatcctcatcctcctcggcatccgttccccaatcaaggggctcggatagcagtggcgaggcctgacttgcttggggcgaaggcgtgactgggggaggtgagcgcggttgtgcggtggccgcctggtcggagtgaccagaggcgcagggctgtgggcgccggtgacggttgccccgccggcgctcaggttgacgagctccctaggctctcgctctctcatcatttctctccatgccaaatacctaacagaagttggtttaagagccgttctacaaatcctgtaaaaaagttatgatggtgattaatggtaaataacactcccaccacaactctatactttttttttaaaaaaaaagagagaataatatataacacataaattagagggtccacatgtcaaccacctcatcaccaactcctacattttataaaaaagaaaaaagaactgtgaggccaatatataaatatatatatatatatatatatatattagtaacaactatattatatataaattaagcgtagaaaatgagggtaataataggttaatttttatttttgtaaattgaaataccgttgtaccgcatggacaataataagttttctagttaattagatggagtaattaatataatgttgttggcattcgggcagcaagccgattgcgccgtgcagaacgtgtccctcgacacgctgttcctcctcgtcatccaggccgccgctgtgtcatcgtgctccgcaagttcatctacctcacgctcctgcgccacgcagcccacgccatcttcttctcggaatctgtccgtactccatctgattagaaatgggcgggcgagattaacttggtcgttcttgcggcaggcggggatatcatgcatggggggtatagctagcctccctcctgcacgagacatgatttgttcatgtcgacgtcgacgtccagagcgtagagggtgcggatggtacgtctccgagccgatcgaggcgcgcgcatctcttctacatgttccagatcgatctggaacgacatgcaccggtgcaccacggtcacgtacgcgtgatcgatcgagcgtcgccacctgccttgatctcgttgcgggccacggatatcggccggctcggtcgccgtacgtctccacggcgatcgcgaccaacatcatcggggacgggctttcttgcgctgacgtgggtccccaccttcttctggtcgccttgcattggttcctcgggttcaaggtggggcgggttgtgccgctaacccgcttggttggcccgccccactagcccactacccacatccgctaacccgcttccaaaatccaaagaggcggattgatacatgcaggcgacccgctttgcccaggagcgccattgcatcctccttctgttcctcttcctcgtagctaccgtgccagtggtgccacccgtcctcgttggcttttactcgctccgttttaaaatatttgacaccattgactttttatacgtgtttgaccattcgtcttattcaaaaaatttaagtaattatttattctttttatattatttgattcattgttaaatatactttcatgtacacatatagttttacatatttcacaatttttttaataagacgaacggtcaaacatgtgctaaaaaatcaacggtgtcaaatattttgaaacggagggagtacagcatacttacatcgctataagctttgagatctgtggcgctgtgcagtttgaaacgacagccgcatcaacctagctatggccatggcggccagccatatagcagcttaagaagaaacgacgcgacatcgacattatatatgtatttttgctcgattcagtctgggattgagggattttgatctcttgatcatgggacacgatatgacgcgaagactgtttggctagacacgcatatatcaagccgattgcgaagagaacataaatccctaactggagcatgtcaccacggaaagcaagaagatgataccagcggatcggcaaagtttgcacagcattcatcagcaataccaggcacaaaaatatggaatgtatggacagcatgaaatgcgttccagcacatgtcgtggatggaatctcactgaggtgatgatcaagaactacatcgaacacttgacagcactctccggttccagcggacggagtgacggtagagctattgacctcttgtgcattcacggacggcatacagagaaacaagttgcaattgacgcagtgacgcagcggatttcgttttaagtggtatcgtgctgtgtgtggcacagtgtcgatagtgcggctgctccgctactgggtgttctgcaatacgcatgccaactaatgctgtgatatttagttggtaaaatttactacgggacacttaaaagttcatggtctttgctgcagtatatccaaaaaacacatatttgctataggtcaccgtaaaaacatgcatggtgattagctgttgaacactagacgcattattttattatatttagtacaaacgtagagagaaacagtgtggaatgcaccaatttgcccccgtgtccataggttgtaaggtgattggatccgatgcaaacctgacccagaccattctcactcctctgacccggtccatttttactcccctagtatgggttcagttagaactagacctgaatgggtttaaaacaaacatgccccatagacaaaattgtcttttcttaaagtttctctctccatttgcaccggataaaataaaataatttgttcggtgttcaacagctaatttacatgtttttacacgttctttgagtgtcttgtagcatagaccataaactatgagtgtcatgtagcaaattttgccaatttagacatatcaccacatgcgcaattagcatgtcacacccaatgccaccgccttgccgccgtcgctgttgccagaaccctaggccaccactgtcaccggagtcagagctcccgtcgttggcggggaggaggatgcagctacggatctanccgagcatgtgcagcatcaacatcccgagtagcaacggcgtcatcgactcgatgaaggtgtgggtggcaccgtagccataaccgccctcgccgctcgcggggggtgtcagggccgccgtggtggtggtggatggggggcggggtggtaccggcgcgctgtggggctcggctacatccttccctttgtcttcatcctcgccgccatctcggcgctcgaggctgacgcaacaagtgctcctcgagcacctcgcggtcggcaaagatgccgatggtccatggggcacgctcgagcacctcgcggttcagctagctggccatcttgcgctgcgctctttgtggtatggcaccagcagtagggccggcggggacgtcctccatgcaacggtatacgtggatgttcttcgcgttcaaggcgcggcgccgcgtggtcgatcggcgatgtgtcgacctggcagatggaggtgaacacgttgacgcccccagttcacctgcgtgcaggcgtcgtcgatgcggcgatcgatgtcctttgtcgctgtcctggacccgctagtggtaccgcttcgagcagtaaaatcgatttgtttggtgtcagaacttatctaatggtgttatagtatactaactatacttagatcatgatgttatagcatatggataaacagtttcgctataggttttatcgtcggtgtcagacccgccggcttttttactgtagatctgcgcccctggcttcgagccgatcgacgtgcttgcattcggccggtatcgaacaggtttaggacctggatggtggcttatgcgcggggcgtcgtcgcctggagctcgaggaggctgagcattgccagcgtgtaattagtagtagggatgcggggcggccggacgggcaagcgggtttttttagcccgtttatctcacttctagtttattttttcttctaaattttatactattatgtagaaaataaactagcaagcgggtttttatgcgggttacgggactacccattatctctacgtattagctatccagcacccacaacacgattcaatagaacacgagatcaagatagtttgatggagatccaactgaattcgccgtcaccaatcacagcaagtaacatatgtattttcatttatccaaggagacattccctcgttaatttattgcatgttacttaaatataaaaaaattatatcactatatgaacatgcaagtttaaatttcacttctaccaggtctaagaaaaggaacaaattaaattgaatatattcactgttatatctcttctttttatataacttgtaactcgaatttaaatctatatgattgtgaagtaatatacctcaagttaatcaatcttgtcattggagtacgtctcgctcgttttggctccaggcccattgcaaataggacacgtatgagcctcgctcgcgactcggctaccaagcccgtctcggctcataggctcagatctcttgatcataatgctgctgctttcttgcactcaaattatcaataagcattttcattaagacatacataaatgatcaagctaattgtctcttgctgattgcatttgcaaatggccaaatgctatgtactagtattatatatgcatggttaattatatgttcaccagttgcagggtgtgcagataggcatcgatgcctccatggcgatcgagctgcgagatacgccaccccaacctgctgccgctgagggcctattacctcgcgcgggtcctcggccagtcggtcccaatagcggcaattaagctgctcgtcttacgatatgtagagtcagttttatctaaaataggaatggagctgagtgaaactctcttacaaaataaactgtagggtggagctgggtttagtagttggagctttactaaatataaccttagacttcctgcacaacggcagcttctcccaatttctccacggcttgcttcttcctagcattgtgcgggattacatgattgatcaagattgatttgattagctagttcaatttgggcttctacat

SEQ ID NO: 3232 - DNA, 712 bp, Oryza sativa
  unsure (1)..(712): unsure at all n locations
nnnnnnnnnnnnnnnnnnnnnnnnnnnnnnnnnnccccagtcacgccttcgccccaagcaagtcaggcctcgccactgctatccgagccccttgattggggaacggatgccgaggaggatgaggatgacgtcattgctctggagctacaccaacattcagcggagacattcaatccgcagaccgccaaagcacgcaaagcagcttctccatctccggcgtccaaggctttccatcaggaaatcaatgcccgaagccaggaagaggagctcgacattactgcagagagaggagagggacggagcgccattacgccccctcccgaaaaggcacaagaggaagatgcagagaagaaggccaaaggaaaagcaacattaaagtcgataatcgtagccccggcaagagctacaagcaagtctcaaatcgaggcagaagagtgcggcggcctcgacattcagaatctggaattatagaacaaggagaaaacggttatttaggttatgtaaatagagtagtatggcaagattttcttatgaaaaagtactcacacttctgataagggttgatgggtgttaaggctgatatcttaaagtttgggacttttgatatatagaacaacactcagctgagattttgataacaacactcagttgagaggatcgtaggatagataactcctcttttgtaaagtgtctgtagaataccgctacagag

SEQ ID NO: 3233 - DNA, 684 bp, Oryza sativa
cgagctcggtaccccaaagataatactactaatattaagcaaaggctagtggtaactaaagtattaacaatgtcataagcactggagaaagcattattcaccatttggcgttcatgctgcatagagaagaaaaacaaattgctaaaaaacaccaaggcaagaagggcaggaatctcaatccaagcacaccttagcgtaagcatcatattgacggtcatctcgaccagaatactggtgatgagttagttagccatggccatagctaggttgatgcggctgtcgtttcaaactgcacagcgccacagatctcaaagcttatagcgatgtaagtatgctgtactccctccgtttcaaaatatttgacaccgttgattttttagcacatgtttgaccgttcgtcttattaaaaaaattgtgaaatatgtaaaactatatgtgtacatgaaagtatatttaacaatgaatcaaataatataaaaagaataaataattacttaaattttttgaataagacgaatggtcaaacacgtataaaaagtcaatggtgtcaaatattttaaaacggagcgagtaaaagccaacgaggacgggtggcaccactggcacggtagctacgaggaagaggaacagaaggaggatgcaatggcgctcctgggcaaaacgggtcgcctgcatgtatcaatc

SEQ ID NO: 3234 - DNA, 643 bp, Oryza sativa
  unsure (1)..(643): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnntatacattagtctctagatttatctttctagacacgaagttaattaacctttgcggcgccatcatcccgtgcaacaccatctccttcctccacctccacttgtaacgccatcgcctcctccccttcctctacctccacgttgatgcgatgagagcgtggctggcaagtagggaatttgcaagcgtcaatgactacgtgtgggcagggaagagatgggaaagaggatgtgtgcatgggagcttgccgagggtgtggcggaagcagcaagacaaacgtcgacgacgccgttgttgtcgggacggagactaccagcggcgtggtgggtgaagtcacagggagtcgaggccgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3235 - DNA, 724 bp, Oryza sativa
ctatagggcgaattcgagctcggtaccccaaaaaccgtaattttttggtgccctatagtaaattttgccttgttggatagataactccttttctgataagttgtctgtagaataccgctacagagcgttcctgcggaagcaaagaaggtaaacctttaacaatggggaccaaataatgcaagcgtgtttgatgaaacttaatcccagtcagcttttcaaaatgaactggcaagacacaagcagggtcgtcgtcaacttttcttttcgctagttctcaggcccggccgtattctggtttggtcaacaaacaaaaggatttgcacacgaaactgatgtgagatgcaagctactaagcatgaggcaactgataaactccctaaattcaaccagataacgtagcgtatgcacataaccagtcagtaaaccagtgcgtacaatatgttgagtggactagcacggggcggctttgacgatccccacatgttcaatgtaacacgactaggcgatctttatgaaacttctctgcaaacaaaaattcgtaccacaagaatcgctctgtagctttgcccggtaagcaatatagttcctactacaaaattgttgtaattaaaaatggggcctgaagaccatggctcattttaccaggactggaataccacatttgcaacacgaacataatcaaaagacaccatcatcagttcacacgccaactttccattgtaaa

SEQ ID NO: 3236 - DNA, 584 bp, Oryza sativa
  unsure (1)..(584): unsure at all n locations
nnnnnnnnnnnnnnnnnnnnnnnnnnnnnnnnnnnnnnnnnnnnnnnnnnnnnnnnnnnnnttttataagttgagggtcggatcatacctgctatgcaggggcgaattttaaactcgacgacaaattgaccgagtcccatcattctaagcccactaactctcctgaatctcccttgcggacttgcggttcgaacagaccaaagcttgggccctcgacttctagctttcgcagcctgcagtattggtaagccctatgggcttacagcccacgtgtcggcccaactcatggctgctggtgcccgtgggcttcatgctgcatcgagttcaaaagaaagggggaaaaaaaggaaaggaaatcgtaacactgccctaagcacgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3237 - DNA, 13146 bp, Oryza sativa
  unsure (1)..(13146): unsure at all n locations
nnnnnnnnnnnnnnnnnnnnnnnnnnnnnnnnnnnnnnnnnnnnnnnnnnnnnnctcagctttgtcgagggcgttgttgtttatgaagaccttcccctaaatatctcatttgagctgctgcagcagaacaagatcctgaaggtgatccgcaagaaccttgtgaagaaatgcgtcgagctgttctttgagattgctgagaacaaggaagactacaacaaattctacaaggccttctccaaaaatctcaagcttggcatccatgaggactctaccaacaggacgaagattgctgagctcctgaggtaccactccaccaagagtggtgatgagttgaccagcctcaaggactatgtagcccggatgaaagagggccagcgtgatatctattaaatcactggtgagagcaagaaggctgttgagaactcccccttccttgagaagctgaaggactatgaggtcctgtacatggttgatgccattgatgagtacgctgtcggtcagttcatggagtttgagggcaagaagctcatctctgccaccaaaggactgaagcttgatgagaagtttgacaatttgagcatagtgatgaaggaggtgctcgttgacacagtggagagggatgttttttctgaccgtgtggtggactcttcctgctgtccagtcactggcgagtacagctgggttgctaacatggagaggatcatgaaggagaatgccatcatggacgagctacctaacaaatcccaagtgaacaaatgtgccccaaagcaaaaggttgatatccttcctgtgaaggagaatgctatcaggctccaaagcagtgaagagagagaagttaatactaaattttctgttaccggtgagaggattttttttaataaaaaaattacaatatgaagcatgcatcgtctgatcattcgtgttttgctgacataataacctacaggaatctgtggagatggaagatgcctattccgatctatagtacatggtgcttatattaaactaatgatgattccacctgatgataatcttgagaaagatatggctgatgacttaagaaaaaaggtatgcttgtaatgttcagatttacttgcaatgtgaatctatactgtttcttaaatactggaagcaacacagccatttctctgtcaatttatcatttaaaagatctgtttaaatggtgccattgttaggtttgtgatgcgttggagaaggaatgtgctgacaaaccctggttagttctacctgtccttggtttctctgcttctaaatattgaaatattgttgagttatgcattcttatgcttctttatgagacatcaatttgcaggcttgttgaggtgactgccattcctatatcaaagagatgaggaaacctcatgtgtggggaggtgagatagaaatctctatggcgtcacatgttttaaagtgagtactagccatgatttttgatactttttaaattatccatatttcagatgcagtacatattagttcagtatcctatcctattggaatgcttatgcatgtacattgggcttgatggattcacttttactatgctaggatgcccatcaccgtgttcgtggtggaaaaaactggaggtttgagggtattcaccaaatacggaaaggagtatggacggaatgcaatacaggttctttttgatggtaatggacattatgatgttctgagtttgcggtagtccaggactgcaggacagacatttgttcccccttttttttttcttccccaaatacacttgctgtaaaaatgtaaccggagtttaccaacaattaaaaatgttgttctttccaagcgccaaccttattcgattctcctgtagcattacatatcatgattttgcatgtattatgtatgtttctgtcattacatctgcaaggctgcatgaaagcagcttcaggttgcttaccctgcaaaacttctctgccgcgtgagtcggctagtgcctggtggacacaagtcgacaccgtctctggacaaggctgtggagagagctcacctctttgccggccgccggcctacccacctgagccgccggttgtgctgagtttggttggtgggcagctggttctacgacttccatctggggtggtgtaagagttgtagaaggatacaaaacttccagcttcacccattttttatgtactcattcagttatgttctagtgttcgaccttctgtatctcttaccaagaccgagaccggagccttttttttacttgatattttgaggtataactattaatgacagaagtgcactatagtcttcttaaacataggtccttgaattactgtttatagttgcgaatgtgctgatactttggttcatttaaacttctggctacatggtggtcgtgattttacaatgggaagttggcgcgtgaactgatgatggtgtcttttgattatgttcgtgttgcaatgtgatattccagtcctggtaaaatgagccttggtcttcaggccccattttgaaatacaacaattttgtagtaggaatcatatcatatcatatcatatcatatcatattaaatccttagtttttacaacccactactagcagtgatttgatcaacctcagcccaggaaaagatgctacagtactacagtcatcacccagcatgcaccgtccgatgtccacgcgttgatttgatccaaccgtccacgcctcacatgcacatcgctgcgcccggcatagcttccccaatcccctcgatcctcgacatcctctgcgcctcccttcccaaaatactcaaatcttcatcttccccttgcgagtcgcgaagcccgccgccgccaccttcttgcggagctagcggccggggtcgtcgccttcttgcgagccacctgcaagcgccgccaccgttccgcctgattcgcttgctcgaccggccaatttctcaaggtggacgaagggtgcacgcccgctgccatagttgccttcgtccacctcttcgcacggtgttgacaacatgtgcagtctggtaagccaagccctagcctgatctgcttcttatcttcagcaaccttgcttttatcctttgcagcgatcaatttggatgacttattttgtgatgaatctatctgtagttagggtatgggtatggagtagagcagagcaagccaagccctaactcaatctgcttctccatcttcagcatccttgcttctatcctttgcagcgtcaatttggatgacctatcttgtgagtcagttagggtttgggtacaagctatggagtggagcaagtgttcttctagccattgtgctgccgtcaccttccttgggatagtgaggtatgatctccccattattttctatctggattaggccctaatcttgattcaggtttgggctaggcccatccagccagaagtcatacgatttttcaataaaaagaagtcctccgattgttgccgtttggccacttctcactgccaaaacaatattaatgtctggcatcaatatctaatgaatattttatttattttccttgcatatcttcattttaatccaggacagtggttcgtcagctccctgatccccttttatcattatgttgtccaattaatttatttcaccatcctttactctacaattgataatttacatggccattgttctatgcccaagaaatgcatggatgatttcaagtaaagttgatgaagagtactgtcctatctctaccaaagtttgtcaaatccacttgcttcctgttgtagtgtagtattgcttaaaagctatttttcatatcatcctgccatacacttaaatgcatattctattttccttgcctcaggtatttaactttattttgttttggtacatgtgatcccaatactatatgatgagtagctcagttactactaaaacagatatatgcaacacagtttccctctccttttgtttaaatacctagctacatatttatgtgccatcatcctatctcaaatatatctatacgatttttcaatcatccacaacaacacatgggcatatttcgtttcatttatctttttttattttctaatagtgtacttgcttctttgagtggcttcgtttgctaattcctatgtttttcatatttcaggttcaaggcttccagctacttggcaattgctctttagggtttctctacctgttattgcctggtattatttcagttttttgggtagttccttgggaagtcttatttgttgtccaattgttatatccctatgcatgatcattatttaattagttgttttgataaacgaccttccctactctattttttatcatataaaccagtattcggctaaactgtagcatatatttttgcatgggtcaatatttatatttggcagcatctcactgaccactttcatccattttcgttttcaggcatgggcgcatggcagagaccacaatatgaggcaaacattggaccttagctaacacgataactgaatattgtgatggcattttagtggtttgttgcgtattttatatagctcatgggtttatggcttcctacaggctttcactgatgcttttgtgaccgccagtccgggtaatttcaactttctcatgctattatatactgatgctatattacttagcatgctttagtgtcacaccccgaagttctttcccaagcctaaattgaagttataaatggtctcaagaaaatacctgtgtcaagcaagagtaaaccttaataaattaatgcaaataataatcggaattggcatgtggaatttttcttgagttttacatgccgaaatacgctaacaagatttttagtggaattttcagagctctcgaaataattttaaccaattaaaattgagcacatgcaattttaatcccaggaaaaatcctttttccttctttttcctttttctttcttttcttttctctctttcctttgaatgggccgtcggcccattcctcctttttctccccctcctcccgctgggccggccgaaggctgaggcccagctaagccgcgcgggccggccgcccgcctccctctctccccgggacgccgacaggtgggccccacctgtcggggtcgtcccctttctccggccgcctgaccccacgtcgccaccaccgccgaaaccgccgccgcgcccacgtcccgccccctccgggccacgttggccgccccggtcgtgcgccgcgtctcccgcacccgcttccccctctctcccgctcgcgcccgcgtctgagatgaccgggattcaattttcgaatcccgcctctctctcctctcccactcccccacgtcggccggcgattcccgcctctcccggccacgtccggccccttctctccctatttaagctccgccgccaccccctctctctttttccccttttcgccgaactctcccgagctctccatcgctcccgcgccgtgcacccgcctgccgccgcctttcccgccactccggccgcctctagccgccgctagactcgccgccgcgccgcgccgtcgccgccgtcgggttcgcgtggccgagatccaccccgtccgcccttcctccgtcgagattcgtcgccggaacccgcatcccctcgcgctccggtgagctcatccccttcggccatggatgccggtcgccgtggttcgtctccctccctctaacctctcttttcctcccttagggcattccggacctcgtccgcccgtcgtcgccgtttgcccgtggtcgccgtcgccgttcgccgtcgccgttcgccgtcgtcttcctccgcgccggccacccttggtgaggcgtcctctcccctctattcccctccctctccttcctagccgccgcttagcgccgccgccttcgcgtcgcctttgcgccgccgcctccgccgccggttgccgtcgccagcaacgcgtgcgcgcgcgcgggccgtcgccatcgccgtggccggttggccggccttgagccgaactgagccgggtcgccgccgcccgtccgatcggccccgggcgtggaccaccctcgtggtctcggtccacggtggaccggcagccttgggccgctgacccggggaccccacttgccggcgcccctctcttcccttgagccgctgacatgcgggccccgccgcccccttgatgacgtcagccctgggaattaactgcgcaataaattatttaaggactttttgttatagtaataaacacagtgaatcttctaaaattcataactaattcatccgtgctccgtttaagcccattcaagtctcagtaaatcaaggaaaatgtgtagaatccattaaaaatggttttgttctctgtttcagtagtcttatagcctgtttgcattgtttgctttgtatgtcgcttagattccggttcttccgacgctccggtgtacttcgaaatagtcgccgaggttccttcagcagcagagcaaggcaagtcatgcctgttacttgaacatgttgatcctatattgcaaatgctctattgtttttcttcaaatactgcattgttttataatgttagtatgggatgtttacctattgttacagccatgctattttgataccatgctcctttgttagcttgggttataacatgaatagactttggactaggaattgcttagccatgcttagttcaactaatacacaatggggaaaatcctattaatgtttagactgtaggttctaatggtaatgttggagtagtgacaccgcttcggtgttggttaattaaaataaatcacatggtgggctgtgggtgcatggttttgttggtcgcacccatggcagttaaggaccggttcgcgggatgccctggaagaacttatcgtacttaccacaagccagcgtgggcaacggctgggcttgtagtgtagcttttctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtttaggtggatggttgggcttgttgcaacgtgggatagcgttggacagcagatgattaatattgattaattattgcgactgtttttttctttaaacttctgtttataaatgctcgctttatgcaaatgaaccactctagctctcctatgataattccctgcatcatacccctattccggtatgacttgctgagtacagtgggtagtactcagtcttgctccattttccccaaccccagagtacgagtatgtgtcagatggtggtttctccgaggagtaggcttcgtccgtgccgtcgaggatgcctgtggagtggtgttcccgctgcagatcaagtcaaggcttagctcctgttatctttcgtttttccgctgcatttatgtaagacttttatgatgtttgtaagacgtggatctgaatgtcaacattgtcgtttgtgtaccccggctggtcctggacggggattttaatacacattctgcttggaattctattcgggaatttctgggcgtgacatttaggaaattagaaactgttttattctgttgaaattatgctttgttgtttgtacagtgtgggatatgcatgctcttcatcaaggttaaaatgtggatgtattttccttttcttattggtggctaaaatagatcgatgctaattaatgacaagctggcgagaatactgaactctcatatctccagaattggctataaaatcactggttctgggtcatggagcagtaaaccttaatttctatttgttattgctaatggccaatttgtatagattgtaaaacatatacaatatgagttgccactgccatatatatgatgtgatgtccgttgtccttccaaattaatcatcgcccaaggattcgtttttcctaggatctgctggtatcgaattaagaatgttgtctactatgtaccgagatccatgtttgttagtgtaagattgctcttaaaaaaacttttggtttgattacatcacttcaaaactgagaacattgttagattatatgccctttttgatattgcgctattactgtggaacagtgttgcatgttatcttgtgatatgcccaattctgatcttgagttattataggttgcctcatatgcccgcgcaatgcgcaggggacacaactgtgatgtgctgtggacatagttttgtttgactatccttccaaattaatcatcgcccactgattggtcttcctgggaactgctactctgctaggtattgaaatactaatgttgtttattttacttttgttgatgtaattgtattatgcaccgagatacccgttgttcgtgtaacattgattatataaaaaatattatggtccaattaaatcactcaaaattgagaacatcgtgatattctctttctgatcgagttattattattattattgttgtgtagctctgttatgtgctatgttgttttcaatcatgcttattttttactattatgatttttttttatgattaagattatcttggatgatgtcggcgcatcgcgcggggggcacggctagttatattgtttaccgggcaaagctacggagagattcttgtggtacgaatttctgtttgcagagaagtgtcataaagatcgcctagtcgtgttacattgaatcgtcaaagccgccccgtgctagtccactcaacatattgtacgcactggtttactgactggttatgtgcatactctacattatctggttgaatttagggaggttatcagttgcctcatgcctagtagcttgcatctcgcatcagtttggtgtgcaaatccttttgtttgttgccatttcattttgaaaagctgactgggattaaggttcatcaaacacgcttgcatgatttggtccccatcagcaggaacgctctgtagcggtattctacagacaacttaacaaaagaggagttatctatcctacgatcctctcaactgagtgttgttatcaaaatctcagctgagtgttgttctatatatcaaaagtcccaaactttaagatatcagccttaacacccatcaacccttatcagaagtgtgagtactttttcataagaaaatcttgccatactactctatttacataacctaaataaccgttttctccttgttctataattccagattctgaatgtcgaggccgccgcactactttggtttatccacagtcctacatccatgcgtaccaccaatccaccatacgtccccttccccttacatctagacatctagtgatgccaatcggtgttttacctcttgcattttcgtactaattaacgaggcttccatggctaaatattattgggtcaaacaggccaagaccagtgcatcctcgaatgcatgttggactcaagacgagcaatcatggaggaagtctaatggcgatacgtaagagaggtaaaaaagaggtaagggtttgttaggttcaaagctaaattttggcctaacaaaattttggtagtactaaaaccttgcaattgttggcgctaccaagtaaaagcaacaagttttcctacacaagaatacggcacatcatcaaaaacgtattgaccgtcggataaaaagtttgaataaacaatggccattagataaaaaagtatatgcatttaaagaaaaacacaaatgagctaaatatatgaaaatttctggaggtttatagtgccacctcttaaactcatgaacaaagaaagagaggggcaattacgatgaaaaaacaggagccttctagtgattcatcatgcctagattcattttcctaagtggtatcaaattctcacatactatgttgtttttctttacggagggagtgtactctagtataatttagctaaatctataattggttagacaatttatacttactagataaatgaacttacgtcaaaaccttcttaaaagctaactaaactaataaattatatatagaagttttttcgtgggatcaaaagtcgagcaaagtgtgactatgtgactagttttaattattataggcaaaaactagtagcatactaaacatttattgatataaaaattagcttcaatccaaacaagctcgtatatagtttcttttttcttttacatgaaaagacatcatcatcaatacaatagtaagctagaccagtacagattaaataggtggaagcagaaagtgctcgaggacagttcgcgttcgcaccatgagcatcttggccctccgtcgacggcgctcataagccacggttactataggagtgatcactacgcagggcacggccccaaccacggcgaacggtccactcatgtagtcgttttcgaggaagaaaaggccagccacgcataagaccagcacgccgacgacgaaccagaacgccacacaagcgacggacagctgggtcgacccgtcgagctgcaggttccaatggatctcggcgatggacgccgcgatcctgtcgacgtcgcgctcgcccagccgcggcgacgccagcagcctcggccgccactccggcggcattgctcccgccgcgaacgcagcgtcgatctcatccttgatgctgctgctcatggtgatcgatgccgctgaactgaattgcagagatgatgaatggatgatgatatctggtgactgcttgtatcgatcagttgtcttctttccttcccttccaggcaaattaaaaactaagtgctgccatatccaattcggaatagttacaactaaaaagaaacgaagtacagttctacgtaccttgaatccgagtccatctctctcttgacggttcgtcgtcggtcgtttgactgacatggatgcatttcgtcggagagtaccacccactggagacaatctttcattcaaagaagtacgtagccgccgtcaactgcatatgctgtggattcactggaatcaggaggtgttgggtgagagtaagcaagcaggagccttactgagctcactgggactatcggcctccggccatggcaagatcgacaaagtccgtccgatgtgcaagcgacggtcgacggagatcgtgagttgaacgacgtcccactgacgtagaatcatctatgtcctttggagtgactattctttttagttctctttgtttacactttaatttactgggagcacactgcacattacgaaatcgttcatacattcatccttgctgatttctgctattacatttagggtcactagtgtagatatgtaatttgatagtgaactttatcagcttcaccatttttatatactctgaataagaattcctttcggcgtctcgacggagctctttttacttgatattttgaggtataactattaatgacaaaaatgcactagagtcttcttaaacatagaccaggtcgttgatgtgactgtttatagttgcgaatgtgctgatactttgtttcaatttagtttctgagtatatggtggtcgtgattttacaatggaaagttggcggtgaactgatgatgctgtcttttgattatgtttgcggttgcgatgtgatattccagtcatgataaaatgtgcctatatcttcaggcctcattatgaaatactccctccattcctaaatatacttttatgtgtatatatatatatatagttttacatatttcacaaaagtttttgaataaaacgaatggtcaaatatgtttaaaaaaatctacggtgtcaaacatttagggaagaagtgagtacaacaattttgcaggaattacattatttatttttgttgcagggaagtgtcatgaagatcggctagtcgtgttctcgtaacattgggcatttgggggtcgtcaaatgccaggtgctagtccatttaacatactgttcgcgctggtttactgactggttatgcgcataatctacattatctggttgaattgtagggaggttagcggttgtctcatgccatgtagcttgcatctcacatcagtctcgtgtgcaaatgtttgggtttgttgaccaaccagaataaagcccggcccagggaactagcgaaaggaaaagttgacgatgactccctgcttgcgttgtcagttggtttggaaaagctgactgagattaaaattcatcaaacacgcttgcattgtttggtccccattgttttttcgaacggccaccctcttacttgaacaggtttggtccccattgttaaactttgccttctttgctgcagcaagaatgctctgttgaggtaacgaggatctattttagaagcttgtggagttacactactgttataaacaacttttataatatctgatccccaaataatctaaattctcatctaatttatgagaataaatagcggtttcttagaatctcttgctaaagcagaaatcacaaccttcttcatctcatctcacagtaagttcatttttagcttcttctatttgtcctaaaataaatccatttttaagtaatcattatatcaaaatttataaaagtactagtataaaataattacattgagaattgataaagtgaaaaacaattacattaagatttatgaaataggggtatttcggtaatactaatcgtttaactcgacacgtccatctcctgcagaacaacatgaatacgtcgaccatatcaccactgcaaacaccgtatcgagatcacctacgacaacgaagcgagacgcgacagggagagcctacccgcacgtttcttcagccatccaaaccgtagctgaaaaaaccagacgcggtaggcgacccggaccagtcagcccagtcggacggaccccctctcgccttgccgcgacgcgaccgagccgacccgaaccgaaaccgaaaaaaaaaaagggcaaacccaacccaacataaaatcgcccacctccacctctcgcattccccttccttccttctcttcctcctcctcctc

SEQ ID NO: 3238 - DNA, 4424 bp, Oryza sativa
tagtagaaagaaagaaaaaagagtcaggactcgagactagtcagttcattttttccgtaccctttttctgaaacaaatctgccttttgatttgaaatgactaataacatgtaggtttggaacgtgtgattctcgtgtgaagttctagagcggttcatatatccagtagatttactgatgcatctctggttacgcttgggatctatgtgtggggaaggactcttcgttgatagatttctgaatttgggataatgcgataaatatcatcagattgtaaaaagtgtaaaaggaatttcggggcgtataattaactttgtgcaccaccaaatgctcatctcatgtagttgtattagtattatgtaccttgggagcaatgataaatctactacaaaaggtgtgtagcaccagttgcttgaggcatgtgaggtagccatttagcttcctagcaagctagaactagtgaaatgttactttttggcatgaggcatgtgcaattgcaatagcctcttctactagtggatctataggaagggaaacttcgatgaagaaaaacgatgttaggtttatttggtttgattgaaggagatgcagaaacacgatgatttactgctatggcagtttagatatttttcttatcacaggatttctgcaatactctgacatgatatctctaatctcatctccaggttaggtcttgtggctacaatcaaggtaaacattctgactgttactttccatgatatattgggtgaactacccctattttttcaaagttgcgcttgcttggcagtgtacatacttgatagtataatgcctgcatgcacacaacagacttgaaagtttatataaaattcatcaggctgcttccatgctgcacgattccatgttatgtggcatgacttgtttactctatagtcagcttttggaaatattaaccgctgcttctttggacatatttcatttgctacgaacagtaacacgatgctggttgcttgtagctgtataatgactgtgttgtcttttctttctgaaggaccgagccaatgaaatatataagaaggtggaagatctcaagtctatcaggggaagaaatcaagatgccatattagctgcctgtttgtatattgcttgtagacaagaggatcggcctagaactgtaaaaggtacagtttgttctttgctgaatgcatttatctgaatgcgttctgaatgcatttatctgatgcgttcttgtttgatgtgatggcttattgcagaaatatgttcggtcgctaatggagcaacaaagaaagagataggccgagcaaaggaatttatcgtgaagcaactggaagttgaaatgggtcaatctatggagatgggaaccatccatgctggagatttcctggtctgtagtttgccatgtattctaatgagtccttgtctgaattgattgagtgaactcttgaataaactgataaaacctgcagaggcgtttctgttcaactcttgggatgaacaatcaagctgttaaagcagcccaggaagcagttcagcgttcagaggaacttgatataaggtttgacattttggattcattatgaaccattctgatgatcaatagatcctttgtcatggaagttattttatccgttttagcttcagtgtttatcacctctaaatcactgatgcttagatcaatgcattgactagaggaactaatcagataaacgagttgcaaatacagctatcagcaaatctatattcttaaagcaagtagcatacatatcctgtacagtccatacatacaacctcattatccccatttatgtattgggaaggggcagggctgcaggagagctagtttttgactattagacacaaactttccttattagtcaaattccaagtgtgcatcatgacttattatattcacacctccgtgcaaacctatgctgtgcaggaggagtcctatttccattgcggctgctgtcatttacatgataacccaactctcagatgataagaagcctctgaaaggtttggaacacagacccgttctatgtttaacttgcaactgtttaactcgttaataacaccgtgaaaatgttgcagacatatccttggctactggtgtggcagaaggtaccatcagaaattcatacaaggatctgtatccctatgcttcaaggctcatcccaaacacctatgccaaggaggaagacctgaagaatctgtgcacaccataggaaatttttttcttttcttttttgtcacataacatggaaattagatttgccagagaggagtaatgttgtccttggatgtgagttttactggcccatgtatcactgcacctaattttatgtgcatggacctgttagaacaaagttatctcgaatcgaagctaagttatatgcaaagcttatttaggaatggcaaaatttcatgcattaccttgtgagcaactttttaaattgttgattgataacgaccaaaacctacggaggagcgataagtttcacaaactaaaatgatctgcacgccacatatataaaattttgcaagtggtatcatgttcatgaattgccaggtagtggtgtattcgtatatatttttttatcggaactgcagatcttgtagggaaaaacaaaagggaagtgaatcttgaaagagctttgcagttcatgccatactgccaaggctcgttgcatactgccgaggatcgtgccgcatgatcgatgcatacaagggaaaaaaggagatcccttccctctgcgttggcacttggtagctcctgtgctgaagcagcggagcctttttcttgtcttgtcagccaccaattctccaaatgcagaaatgctgcgaggtgcggaggacgcgctcgttgtgccagccgcccagcggcgcgcgcgcgcggcgatcgaccagctgcgacgcacagagtgcagtggcgcaccacggccgccgtcgagcgcgggcggtgggatttggcaatgccgcccatggcgcgggcgtccacccgtttgacgccgacgcggtcgccgtatctttccttccctcccaacttgctgacttgcaccttgtttagattttgatacatggtgtcgagttgtcgaccggagagggtggagtattgacaaatgttgatgtacagtgatggttcgtttgaaaatatcattcgagactcaaatgaatgaataaaatattgaatggttgataagttctttttagataaaaaaagctttctaagaaataccgataatttttttaccgtgataatatatataatctgtagaaaaagaagggccctaagagcggtcaacagttaacacctctaaaaaaacagttgatacacaccaaacacgcaattgcccccaattcaaacgggtgtcttgtgcctacgcttagaaatcaatcatctaaaacttagctgactggatctggtttttccaccataagtagtttagttactgggttgtttttattgtgtaaatattgaaaactggtattttgttgtgtgaacactgttcaggctttcttgcagggccagtaaggtgtggaggatcaacgatcctacggcaacatcgattattatgctcaacaccacaacattccttgccttccacagatgtcgggtaacaccacatatagcagcaatttttcacgtgttattggtcactcactcactaacaaataataggctctcgtaacgccagccaggtctatgagaaaaaacaacacagtggcatcttgcattattccctcgtgtgccaaaacaagcacggtgattgaacacgaagtatctctatcaagcaatatggtgtggtagccgtctcgctgcctctgggtcatttatttctacagaagggttacatcaggctgcaactttcttggaagtcaccgagttgataatagtggcaaaatccggaccctgcaaaacggaatgttgcgtaatgaaatacaatacacaattacacaatagcgggttcattggtttaagaacacggcaatcaacaggctgtatttcaggatatgatgttaatttatcataccttcaaagaggcaccaccaacaaggaagccgtcaatatcttctttctttgctagctcggcacaattggctgcatttacagaacctgtaccagaacgaatcataaaatcagtgaggcatattgccacatcctagctggcatcaaattaataatggtgcaaatattctctgaagtcacaagccttagcaggtactgataccactagatcgggcttctagatatttaccacaaacaacatatttcaaggaataaccaggctttcaattgcttatataagagaaaaatagaaaaatccattttgttagatgctgttgttaaggacattcataacagagtgtttcataatatatcaatgtcctaaattctgccttccaatatcaatttcatggggt

SEQ ID NO: 3239 - DNA, 3697 bp, Oryza sativa
  unsure (1)..(3697): unsure at all n locations
nnnnnnnnnnnnnnnnnnnnnnnnnnnnnnnnnnnnnnnnnnnnnnnnnnnnnnnnntatctctatcaagcaatatggtgtggtagccgtctcgctgcctctgggtcatttatttctacagaagggttacatcaggctgcaactttcttggaagtcaccgagttgataatagtggcaaaatccggaccctgcaaaacggaatgttgcgtaatgaaatacaatacacaattacacaatagcgggttcattggtttaagaacacggcaatcaacaggctgtatttcaggatatgatgttaatttatcataccttcaaagaggcaccaccaacaaggaagccgtcaatatcttctttctttgctagctcggcacaattggctgcatttacagaacctgtaccagaacgaatcataaaatcagtgaggcatattgccacatcctagctggcatcaaattaataatggtgcaaatattctctgaagtcacaagccttagcaggtactgataccactagatcgggcttctagatatttaccacaaacaacatatttcaaggaataaccaggctttcaattgcttatataagagaaaaatagaaaaatccattttgttagatgctgttgttaaggacattcataacagagtgtttcataatatatcaatgttcctaaattctgccttccaataatcaatttcatggggtgaagagaggagaaacacagtgaaactcatccaagtgataagaaaccgacctccatatataattcgaatgccggaagcaacctcaggtgacacgttggttttcaaccaatcacgaacagcagcatgaacttcctgagcttgctcaggagtagcaactttcccggttccaatagcccaaacaggctcatatgcaattactacatccgcccagtttgtaatactgtctgaaagcaacatgttgatacatgaatcttgtcttcagatgatgtaggctcatcaaccattattaatttaactcaagatgaagaattgtcacctgcaaaagccttcatctgcttaaaacagacgtcaaaagttttccctgcttctctctcttccaacagctcccctatgcaggcaataacctttacattttgactcaaggcatatgcagccttcttcccaataaactgcatttataaacatggtatgtcacaatcccaatcagaactactgcatgtcaacagcaatcatgcatctcaaaggtgccttcagaatgttacaggctaacagcatggacaagtggacaagtgagagaactaccaatccagtagcatctgtgtatatagcgcttacctgatcatcttcaccaatgacatgtctacgctctgaatgcccaagaataacccattggcagccaatgtccaccaattgctccgcactatagacattttaggtgaaacatataaaaactccagtgtgaaaacaagaaacaaaaaattatctttttgcgcttgcttaaaattcaaagctaccataatcccgtaaaaaacatcgaacagaccgccaccatttatcatcaatttacacatggttctgacgccatgtaatgcattatactaaagaaaagaaaattgcaacatgtttttagctttacctgatctctccagtgtatgctcctccttttccaatccaaacattctgagcagatacctcaatacgatcagttagtgagttcttaacctgatcaatataaatgaatggtggtgcaaccacaacatctgcagtattgccacagcaagttaattgaaggtagaaaaagatagacagtggaagctaaaaagaattccggaggatggatttggatgaaaaagaaggcatgaaagaaccaatcaaatacacacatctaacacagtgtgtatagagaggaagagaatcatgcatagatgaataaaacgtgcttaccaacatcaggttcaagtgtagcagcattcaattcagtcacaagcttgctgacagagtccttcgttccattctaaattgagggacaagaaattatatcatcagaaccaatcatactgatagtaacatatctgaccaaaaagtcgggaaacatgtcttgatatagttagcataagctctcgataaaaagtgaagcaacatataataccgagatgattctccaaaaggaaaaatgagcaactgaatcagctcgtcctaaggatggcctaaagaagatgctactatctttatttttggacaagatactgatgcacactttcttaccctcggaccactagaactaatttattttggacaagatactgatgcacacactttcttatccttggagcactagaaccaatccctgtctacgtaacagtagttgctcgactccatgaaatttgggcaaatgagaaagccagggactgagaagatgaagtctgaaaaaaattatacatttttgcatataagatgcatattccccaagagaactgcttaagccaaaaacgactacatcttgtggcaccaaaagcgactccatatctagcaaacacgaccaggtgtggtgtagatcacgatgtattgatgacgacaaaaaatcccattcattccgctcatctttggaatgtcctaggcggcaaccacaaggcgccaacgactcaagatcacgaaggtgcagcagcagcagaatctccatccatcatcgctctgctcataggtaccccgtgcgtctgcaaaagttgattgatgaggaggagcggatacttacgcacttccagttgcctccaacgaagaactgcaaggacagcagcagcagcagaaagaaagaagcagcaagtcgtcagccacgagcacaaaagggcaacgaagggaagtgtaattaaacgatagcaggaaggaggatggatggcaaccttgccggatccggccatggcgacgacgcgctgggcgcggcggcgggagcacccgaggcggagctgctgcggatgcgccggggcggcggcggcgacgcctgcgcggcggaggtcggcgaggcgggagaggtgggaggacgcgagggacgacggcgccgccattctctctctccaatccaacccaacccaatccaatccccttcgtcgcgcgctgcggttggtgagagcggagctcgcgagctgaggtgaggtgaggtggtgatgatgcgggcagcggcgcagccaccaccaaccgcggaggaagggggaagagaggggagagcgacccgtgcggaggtggagggccacgcggctttgtatggccgcgcgcccacgcgcgccttatcggcccacggatagggcgcccagggccgtggcctccgccacgtcgcctggtatttcctgggccggcccgaccgcgacagcccaagcaacactccacaaggaatgttccagaatctctcttatgctttgtttagttcctggtccaaaatattttttaaagtatacggacacatattaaatcgaacgtagattaataataaaataaattatagattttgtctgtaaactgcaaaacaaatttattaaatctaattaattcattattagcaaatatttactgtagcaccacattgtcaaatcatgatgtaattaggctcaaaagattcttctcgtgatttacatgtaaactgtataattggtttttttccgannnnnnnnnnnnnnnnnnnnnnnnnnnnnnnnnnnnnnnnnnnnnnnnnnnnnnnnnnnnnnnnn

SEQ ID NO: 3240 - DNA, 2311 bp, Oryza sativa
cagccacacccaaccgcgaaggaagggggaaaagagggaaaaccgacccgtgcgaaggtgaaggcccacgcggctttgtatggccgcgcgcccacgcgcgccttatcggcccacggatagggcgcccagggccgtggcctccgccacgtcgcctggtatttcctgggccggcccgaccgcgacagcccaagcaacactccacaaggaatgttccagaatctctcttatgctttgtttagttcctggtccaaaatattttttaaagtatacggacacatattaaatcgaacgtagattaataataaaataaattatagattttgtctgtaaactgcaaaacaaatttattaaatctaattaattcattattagcaaatatttactgtagcaccacattgtcaaatcatgatgtaattaggctcaaaagattcttctcgtgatttacatgtaaactgtataattggtttttttccgatcacatttaatgcttatgtatgtgtctaaatatttgatacgacgaaaaaattaaaagttttttaaaaaaatgaatctaaacgcggccttagcttccctcctccgctccactgactgtaaattggaaggttttttaaaaaaatgaatctaaacacgggcttagcttccctcctccgctccactgactgtaggcccatgtaactgggggccacacttcgtgacgtgacgtaacgtgaccactcactctccgtggggaccagcgaggccctcgcagagttgcacacgtacgggtagaggagaaaatgcgcgtatcacatgacactgacaagtggagtctagtgtaatacttcctctatattttaatatatgacgctgttgatattttatccaacgtttgaccattcgtcttatataaaatatttatgtaattatcatttattttattgtgacttgattcgtcattaaatatttttaaaatatgatataaatattttcatatttacaaaaaaatttaaataaaacgaatggttaaacgttggttgaaaaatcaataatgttatatattaaaatatggagagagtacttaccccgacgtgtcagccaaaaatacctttcatcccgtttataaaaaatccgtagttataaaatccaaaaagcaaattaatatcactatctccacttcagtcgttttaatctttttagttctaatcaaatttataaaaaagtaatatttttacaaaaaatataaaaatattaatatccaatttaataaaataaattgatactataaatattacaataattttctataaatttagttaatattttaaaaaatagctttaataaggtcaaaactacttcagaacggagggggtattattgagaagctagaaaaaaaatacagtgttctaaaaaaaaaagaaaaacaaattcagcctttattttcatcggcttctcagactcggtctcgacttcagactagtctgtctgaacgaggtcgagtcggaggagttgcatcgctagcttaacccgaccgctttttaaatcgaaatcccgcagttaaatcagagatttatgcagacaaaagaaaaacacacacacagcaattactattctccaacccaacacgccccccgcaccttccgtcctcataaacgcgagtgggtttaaactcgagttgtttttttgttcgttaatcctcgccccctctttctctctaatctccgccaaggcgatggcggattcgaaggggagcggcggcgccgcaggagacaagcccggcgccgacgcgagccccgccacgaatccggccccgccagctgccgccgtggccgtcgccgctgcggccgcggacgccggaggggacgacgacgtggccgcggccgcggaggcgcggcggccgttcacggcgctcagccaggtcgacgccgacctcgccctggcccgcgtgctccaggagcaggtatatgtgggggagatctcgcggtcgggtgttgttgctagggttccgggacctctcgattgacaatttgacatggttgttgtttggatcggctgcaggagcgggcgtacatgatgcttcgcatgggcggaggcgtcggcgagggcagcgattacgggagctcggatgccgggagctacgagtacgacgacgaggccgaggaggactacgaggaggagctggagcaccacctccgcgtccaccaccacgagcacgccgttggggagggtcgtggcgagggagagcgagatggggatggggagggggctgagggaagcgagttcgaggaggaggggttcgacgaggagtatgatgaggaggaagtcgagccagagc

SEQ ID NO: 3241 - DNA, 775 bp, Oryza sativa
  unsure (1)..(775): unsure at all n locations
taaaggggaagcattaggactgagtacaatacaagatgatagcatggatgagccgttcacagaggatgaaatctgggaagcaattaaaaactctccaaaggaaaaagcgccgggcccagatggtttcactggagctttctacaagagctgctggcacataataaaaaaggaaattgtggacgcttttgcaagctttcacaacctcacaggagggaactttggaagcatcaacaaggccatgataacactgctgccgaagaaagacttgccacgctcggtgaatgacttcagacccattagtctgatccactctgtggcgaagcttatatccaaaactttggcaatgagactggcagcacggcttggtgatttggtctcgcatgcccaaagtgctttcatcaagaagagatgcatacaagataacttcctctatgtgcgcaatatggtccggtccttgcacatgcaacggaaaccatccctcttcttcaagttggacataacaaaggcatttgattcagtatcttgggaataccttgtcgaaatgctgcagtggagaggctttagtcagcgctggagaaattggattgtgcttctcctatcgactgcatcatccagaattttactcaatgggatagcgggagaaccaactacacacaggcgaggcctccagcagggtgatcccctctcgccctacctcttcatcctagcaattgacccgattcaacgannnnnnnnnnnnnnnnnnnnnnnnnnnnnnnnnnnnnnnnnnnnnnnn

SEQ ID NO: 3242 - DNA, 4804 bp, Oryza sativa
  unsure (1)..(4804): unsure at all n locations
agaggctttagtcagcgctggagaaattggattgtgcttctcctatcgactgcatcatccagaattttactcaatgggatagcgggagaaccaactacacacaggcgaggcctccagcagggtgatcccctctcgccctacctcttcatcctagcaattgacccgattcaacgactactcaataaggccatgcaagaggggcttctatctccgttatcaaaccgagcagcgcggttcagaatatccttatatgctgatgatgcagcgatctttataaacccgatcaggaatgatgtcaacaacttgattagcattctcaagttcttcggcgaggccataggccttcaagtgaatctgcacaagagctcagtcgtgtccatcaaatgcgcagagcagaacctgtctgaggtgttggaaaatttcaatggacagcggggcaattttcccataacatatttgggattgccgctcaccccaggccgcatcaagagaatacacctgcaaccggtgatggacaagttgcaatcaaggttagcgggatggaaagggaagttaatccagcaatcagggcggaagacgctagtcacgtctgttctcagctccataccaacctacttccttaccgccttaaagccgcctaaacagttcctcacagacatggacaagattaggaagaaatcctctgggccggcgatcaagagattagcggngggaagtgcaaagtgaattggaaaaaagtatgctccccaataaagatgggaggactaggcgtgttggaccttgataaattcgcgagagctttgagactccgttggctatggtttgagtgggagtgccctgacaaaccttgggttgggacaacacccccctgcgatgagttagatgagcaaatcttcgcggccacaacaaaggtaacaatcggtaatgtgcggaaggcaaaattttggacatccaaatggattggacaccagccgctgaaatacctagcgccaacgcttttcaaccactctaaaggaaagcaacgcttggtttaggatgcgttaaccaatgacaaatggattgaggatattaggcatgagctgtccatgccactgatccgagaattcttcgcagtgttccaccttatctgggataatgagacaaacctggaggaaggagttgaagacaccatcacctggagatggacaaataccggtaaatacaaagcaaaatcggcttatttagcccaattcgccggtagagaagactcaaaggccgccactttgatttggaagacatgggcgccatccaaatgcaaaaactttgcatggcttgtcctgcaaaacaggatatggacatccgaccgcttgcaactccgacaatggcccaataactacttttgccaactctgctacaggaacttagagacggcgcaacatttattcaaggattgtccattcacgcgagaaatttgggacaaaataatggctagaatgaaccacaaccaacccttcccggtgcacaatccggacgagagcctagttgactggtgggaatcaagaacaaagcaacaaagcaaatgtcaaagtaaggggatgcagtcactgcacatgctcttgagttgggaaatctggtgcgagaggaacagacgagttttcaaagataaagaacttcaaatccctcaactaacggcaagaataatggacgaaatannnnnnnnnnnnnnnnnnnnngcaaaaaatcttgcgagaatagcgccttaacctctcatcctttgttgtaattttcctttttttctgctctcctccccctgtctttcccccttgtcaccattggtggcatttgtaccgtgcttatcttctgaaatataaaaccagctaagctggctaaggtttcaaaaaaataactttttacaggagtacacataatgcagccaggcgtcgatgaaattcttacacggtggacgcaatttcaaaatttgaaatttggagacaattgcgtggaggggtccggacccggccggcgtggagggagaggctgtgggtataaaagctaaaccagatagatctcccagttacaactcacaactagttcgcccctcgccccctcctcctccagaatggttcgactcaaaatattctcatctctctctgcatcggcggcgaggacggcgaggaaggcgatgcggtcggtggcggcggcggtggcggcgtcctcctcctcaccatggacggcggtggcgtcgccttctactacaccggcgttctctacgacattcgcttcttcgtccccctggatcgcttcatcgcctactccagctcgggcgtctcgtcggattttcggcggcatgccgaggactgggccatcacccggcgtcccgggagcacctttgccgtcaccttcgtcgctaaggatgtacgcagtcatgaatgaggtacgttcacgcaagggtgatagatggactgatgagtcggccgggccgtaggtgatcgacggagtagagcgcaggtgatcgacggagtaggtgcgtgtaggtgaaggggacggcgtgcgttacgacatacttgcggaagcggcgggcctaggcgaaaactcggtgaggacgcgttgggcgctaagctagctcggtgaccagtccggcctccagatgcggaagggggtccagaggaatggtgattcgcgtaggactcgggactagtcgtgcttgctctggcctccggatgagggtgcttgttctggcctccggatgagggaggcgatcgatcgaggaaatggtgattcgcgttggaatgggggactcgtagtcgtacatcgtgcttgttccgcactccagatgaggaaggggatcagaaatggtgattcgataaggaatggggactcctcgtgcttgtgctaggttagctgctctcctcttcgtccggctgatgagtgggtactccctagtcgtagaactgcactgcgtcgtcttcgtcgccatggatggcgagaaaaagctagtcacgaggcaagaggaggaagggttgatgggccggccggcccaatttggacatggcccagactggaaaaccgagcgcggcctaccactacgagcaggttgcggcggcggaggcgagcggagccgcggtggtgcggattgagcggcggagccggagccggagccgcggtggtgcggatcgagcggcggcggtggccggcggggaggcgcaactggtcgccgaggggagcatggcgcttgacggtggaggtgcggccgacggcagcgcggccagcagccgggccaccagcccaccaggtacgttcggaggggagggcgcagggcgacgcctgagaacgtgtgtgtggtagcagctaccgtggcagtcggcagggcttttgttagttttcttaggattgcttttgttttcatagttatcttaggattacttttgttcctggtatggttgaacttgaatggtaccaaacttttctctggaaaaagaaaatgctagcacactgaacatgccctttgtcgtcctaccgcacaattcactcatatttcaacatttattacagataagtagtttgagttgtaaaacgtcaccacaacttttatttgttaaattattgtcacaggacaaattgtaaaatttggtaaaagaaattgtaaattatttgtttgatttgtattatcaaatgctccatattactagttatgatgacaatataacatatgaaagttaatttgtctctattttgttgtttaaggccacggccacttttatccaacaatatggttcaatctttggaggaaccatatcaatatttcaggcagcaatcccaataatttacggtgccttgaagggtagatacttgctgacactagagctttggaatgctagcattacgatcattaacttggtgggaaacacgacgtggatgatctattctgccgtcaataagggagttgagctgtcaatgttaatgactaattcagtcgcttgtggactgaacatctaccacttgctgtctatttatagacacaacaaggaaaggaaaaaagtaagtatcttttcaaatattttttccctttgttattagagcattcacgttctaacctattttgttctacaagacaatttgtcttgtaagttttatatgcatcagttttctggtaatcctggttttgctggaaacaaatgtgggagacgacatattgagactgctggagcatttatttggatcactgggaaatgttatgattgttttgtgccatctagttcagatcaataacttggtaagtgacttattgaattctttcaatcaaagagtatactagtttcctaattattgtctcatttgaatttgcagtggtactcaactctgtcactagaaattcacgttttcatactgttctatgtaccaaatatactatttgctgccagtgaattggttttgattgtctacaagcagtacagcatgaaaatttatgtccaggtaagtgtcacgacctgaggccatgacaggataaccatcatctttaacagtctgtgataccagtcatgttgttaatttgtttttttttctccttttagctctcatacattttgaacacaatcttctatgtgatgagctccctgtcatgattcgcgcaatgattacaagtaactctcaatctcaagtatacagggctctattaaaactcttcacttgttttttctccttgtggtttgcacttattgaacacaataatttgcagataatccagattctgacaatgaagcaatcgatatcgagaatcaagcaattgtaaagattgatgggcaaaagaaacatcacaatgagcgtc

SEQ ID NO: 3243 - DNA, 838 bp, Oryza sativa
  unsure (1)..(838): unsure at all n locations
nnnnnnnnnnnnnnnnnnnnnnnnnnnnnnnnnnnnnnnnnnnnnnnnnnnnnnnnnnnnnnntaatggactaaggcagtaagtcatatttcaaatttatctgaagattgttcacattcaaaaaattaaattacattagtaagacttatgtgttttcagtctatacgccatgaagcctttacgcacatggatggccaaaaggaatacgtgcagattgaccagaatgatctgtttccattccttcttgttaatgtggggtctggtgttagcataatcaaggtaccttgcagtttttttttttaaatatcttttttggattggacttctttttttggtttgctggattttgttggtcgtcgtttttgaaggttgatgggcatggaaagtttcaacgagtaagtggaacaaatgttggtggtggtacatactggggtttggggaggttaatgacaaagtgcaagaggtatttcttcttctgctcatggacatcatacatttctgttgagatctgagaagtttgagaactcctaaaagtatgattttctttcagtttcgatgagttactagagctgagccagcgtggagacaacagcacaatcgacatgcttgttggagatatatatggtggtctggactactccaaggtaatagcaccgatgatggaaaccgtcttgttaacatttcatgttccataaagttatcacacaatgtagacctatgtttgaaactataaattgttaaaatctgctagtcagacttggtacttgcacaactccgatgtgtcagaaacttcagaatagaggtccttcaagtgcccaaattttcttttttactaatt

SEQ ID NO: 3244 - DNA, 1814 bp, Oryza sativa
atgtgataaaagtaaattagtaactctagcaactatctacatattctcaaatccctgttcataatgtggtaaacatcaatctatgaccaccaaagcaatttgcagtattaaaataacattagtacacaaaatttgtggacaatccaaaccccaaaacataaatgatttcgatttttaacaatacaaagaaatggttgcataccgccacgatgtagttgtttggaagaaatgaagtctaaacattcatttagcttcccagtctcaaacttgacaaagtggagcctccctccaagaacaggatagctcctcctgccaccatttaacatcccaagtctcctcttcgtagatagcttacgcttgtcctcactggagtgctccgcatgccgagaaaaatataccagttttataagagaacctagagaaaatatacagttcagtacttagtaaacaaatttgcatgaaatttgggaaccaagaagagaataagagattgtagctctcattttggattgctagccaaaaatggagcttctgaacaataaaactaatcaccacattcgtcattactagttcagaaaccaacgtcacaaatccagagtttacttaataatccaaagttattggtgagatcaactagcaacagcacacataaggtgtccataacgtttagtagcgagcacacacagcatgcaaatgcaagtacaacagcattacgaccaactgctagcttgttcacactgatattagagagagaatccatcaagcatttgattctaagcttccatgcacttaactatctcccgtgcactctacactaactacttccgccagatgacttgatgctactgagctgattcgaacgaggaacggaaggtgccaacccgaaatcagtcggaaacggggggagtgtgagctagctccgccacgaacgtacgtaccaccgatgtcgagggcgaggtgggagatgtcgtcggactggttaggcagcaggatggtcgggttgcggtcctccaggttgccgtggatcgccgcgccgctgaggtccagctgcggccgcgagcccgatcggggcagcatcgccgcgggcgcctgcgtcgccgccgcaccaccaccaccacccttcccctctcccgcctcccccaccgcctcgtgcttcacgccccctccccctccctcgtccaggatcgggtcgctattattgttggccgccattttcggtcaagtgaatgcggtggagccgccaccaaccgcccacctgcccgcgcctctgccgccgcgaccgcgcgcgtggtgatggtggcgggcggctaggcggctaccgcctcgggggagatcgaaaagcgccaaaaacgcgagaacaaaatcggaatccggtggcgcgcgcggcggaatcgttgggcggatggagctcgatcccggggggtgggtgggcggcggggatgagccgatgaggggatttgtggcttatggttttggccttttgggaggttgggatttttttctctctctttcggtgcctctcctctctcgctgaacggctggagcctggagacgatgggtggaaaagtcaaattttgacctttttggcctttagtgtatcaggtgggccccgactgcagtggttgctcactgtgtagtcaaagtctaaggttcagttctatactccaaatctaaaattcaattttgttgttttccgttactacgtttctacaattttttacagaaaatttgtatatagaagttgtttaaaagaattaaataaatcaatttttcatgtttacaataattaatatctaattaatcatatgctaatg

SEQ ID NO: 3245 - DNA, 4004 bp, Oryza sativa
  unsure (1)..(4004): unsure at all n locations
tatagaagttgtttaaaagaattaaataaatcaatttttcatgtttacaataattaatatctaattaatcatatgctaatgagcttttctcgtttcatgtggatcgtaaatattctcctctcctgatcccgtaagatctgaatacgtgtaagcattgagcttgtaattgctcgtaagtcccacaaagacttgatccagaccaggatcccctgtagtcaattgtaccgcgcctttatcactaatatgtgtgctcggatatcattggacccatatgtcagtgataaaagcatgatgcagtcgactgcatagtatttcaatccacttgatccctattcattctaggtttctaataaaatttatcggtggtaaaaaaagaacaatgtgattcttattaatagaaaaatagtattgttacgtgatgaataagtgatactaaatggataaattttcacgacttgtaacccaagagtaagtaagaggctagaaatcaactaatttctataacgtttgaatgttataaatcaagattttttttatagatatctgatcttctttgaagagattatgacagttaccccttttctcaaaatctttaacgccctatttctttcagcttaagattattataatttagattattaagccagattactataagctagattgttacctaaatgagcttatcagattataataagctgggcttcagattataataagctactttaataatttgtctgtttatttcagcttactctcaataatctggattataataatatcaagctgaaagaaacagggcctacctctcctatacaatatatcttttcacccaaattttgagcttttggagaactttgacaattacagtttctctacaaatctttaaccctctgagactgaaattatctaacttctcacccaacttttgaggtttggtagttgtggaatctaaatagtgaatggaaagctagattgccaaaagttgagaatcacaactttttctaaattttcaccaactgctttttataatctcaagcccccttaaacatagctatattatttcttttcagtgacccccaagaccaaagattaaattttaatccattgcctccgagaaatgaagtctatggtttagaaaaacattcctgtgcaaaagagcaatgtcggaccattgatacgagcgaggaacaatccatttatgattctctagttgaaagggtatagtcagattatgaacattttagcttgcactttgcactgatggaacaataatagtttgtcactaagagcatatgacatattttatttcttaccgtttcaaaatgtcaagaacaaaatcaaatcacaaaggttatcatgtcaattcatttacttaggtgtatagaaagatgcatgcattcatttggttgatagtacaagatcgtacaacatgattagtggattaggctgaaggtgatagtacatgatcttacaacattatttgtgtcgcacggtcgtgaattctcttgtcacatccgttcaactaaacataaggccggtcatccattgaactgaaccgaactatctcaactcatcctactttaattatccagatatagatattgaccacacaaattaattgcagcttttgcaaaacttaaaaatgaaggcgcaaagaagatatgggttaaactcaagtattatgtgcttgtttggatcattgccaatccaaacgttaccaaattatttggcaacgacaagatctaacataccaaaactttggcaaagaatagttgttttgcacattgttataacgttttagttatgtatatatcttatttgtttttctcactaacattttaaacatgccaaattttgggtaccaaattagatgaaaacttaacacattggtattgcctctgtttttatagctaagaagaacaacaaaccaaacatgcctcgagggagtttatgtcagcgttgattatagacaaatactttcccgtcccaaagtacaactatttatattcattttatttaagagattaaagttacgataagaattgttgtgattgattgagatgagaaaataggattaagagatgagtggaaaagtagttgtatttccagataagtttgaattatgagtaactctagtttggagtgcatagccaaacaaaacaaatttcaaatcatttatccagaccatcgaatccttgcccatcgtacggtccagattccacaaaagtacaaactgcagttggacccatgggccagcgccaccgagccaccgccgccggtctcaccgctcgccggctcgccgtctcgccttccagccatcgccgccgctccggcgacagccccttcgcctccgcactcaccattcccgcttctacggcgtgccatagcgccgccgacgcggggggactcgcggcagtgcctctcctccagacgaccagaccaaacgcgtggcggcggcgccgtggaaggcacggtggagacgtgagcaacagtgccctcccgtcttcctcctcactcacctcgcgtcccttgcccccacggggtcggtgatcacagcgccaagacgagagcaaaattctcatccgggagggacgcatcggggaggggacaggtcacaggttgaggtaacctgaagaacccttcccccgcactcgatccctcgcgttgcctcgcgatttcgcgatctggaaggatgcatctcacctcacgttcgcggttggaatcacaggttgcaatcggggggcgctcgtgcgcggggcagcattttgggttcactgtcgcgtccatccccatgctgttccccccttcaggcgcagcagccgcgtggaaggtcgctcgctggtggccacgggggaatcccctgatgcgaggtcgtcgtcatggagacatccgctgctggtcagttctgttcctcaccaaggtacatcttctctggccttgctgttcttgacttctttcagattgtgtcagtgttgttgcgtcctctactgtggttgcaagcttgcaacctgcctgacgcagtctggtctcttgtaggcggagcaagctggaccaacccgattaattggctcgtgtagaattaacttgacaatttgactgacatggatgatagccatagtggtgtcccatttaagccaaattattggttaggacagggccaagtaaggttttgggtgttttatgagtgagatctgacctggctgggtttagatcatcctcttttagttcgaacgcccaacaggcaacaacaaaggcgtgatgtagcagcatataggaactactaataagcaaactaacaagttcagatgataacggcgattggctaattttggacccacggtatgtagtcattgcttgagaaatcgaacttactcggccccaaaatcctggacattagtttaagatcttatggtctaagcgtcgtggaatgacatacgatgcttgattgaaaaggaagatatgaatccactcggtcttgctagctaccaatgatttcctagatcccaatatcctgtggcagtgaaattaattggtcatatatacatacatatatatatttctactgtatcatcgtacaacttgcaggggtagttagaactcgtggtaaattattccattgtctcatcatcgtagcttgttgttttgaaagagttagcctagttagattagaacctttctggatataacttctcaccattcatggtcatatttcagaatcaaaccccatgaaggcataggagtagtgcgccaacttctgtatgattcctgcagagacaaatgaattgaattgttccaatagaatacactctgtctgtcaaagaaaaatactcatgaataatttagtaggcactagaagttacattttcctggcagttcaatattccagttgattgctgcagtctgtgcctttacgtgaacttgcgataagtcactaagtctnnnnnnnnnnnnnnnnnnnnnnnnnnnnnnnnnnnnnnnnnnnnnnnnnnnnnnnnnnnnnn

SEQ ID NO: 3246 - DNA, 666 bp, Oryza sativa
ataatggggaaataaactgtaactatccaactaaatatgaaaattgagcggtacatgaaaaacacaatagaaagatgtccacaggtagtgatcccccccaactccattaagaaagtaaccaattaatcagaaaatgctgttcattatctgaataatttgaaaggatactgatcgttgaacgttttattctgctcagggtcaagaacttctagcagcgctgatgctgggtccccacgtacatcagaaccagttttgtcaatttcatcaagaagcatcactgggttgctgaccgatactctctgcatttttttaatgggcagaatatgaatatagcacaagagatttcactattaatccaagacttaagtatattagaaacacaaaatggtttgtcaggtggaaatacgacattaataagcaaaagtaaaacaagattggtctggtcaaagaaattgtaaggtcataagttactcctgaaataagaaaaacaagtgattaaacctttagtccatcaatgagacgtcctggcatgcttccaatgtatgttcttcggtgacccctaatatcagcctcatcctttacaccaccaagagagattcttatgaacttcctatttagtgcctttgctatcgacgatgctaatgatgtctttccaacaccaggtgg

SEQ ID NO: 3247 - DNA, 13812 bp, Oryza sativa
gatcacggtcaagactctcctttgcagctctaaggtcaagctccctctcctcactgactttttgccaaggaagttcagcaagaagttccaagtaggttcgagagctgctatatccaggttgctgaggttgcatctttcttagacgcctgcaagaaaaaacaactagatataggaaccggcggtaccacatgcctgtacaattgtacattgagaatgagatgataagttaccttaactccctttgagcatgcttccaaatattagcaggcattccagcattctgcatcttcctttccaatgccgctacatcatcctcatcatcatcattatcgccaagttcctctttgatagcccgcatctgtgcattaaaagggttgatatcatattggaaacaaaacaatgtggcacaaaagaagcaatggaaacaaagcaaataaactccaacaagatgtgaatcgtaaaaaaagggttgtgctcatcatgtatactttcaaactttcaaaaaacatgtaagtatgatgaaatgtaacttatactgacataattgttgagagcaaaaacatcagcagcccgaaaatcctgaatcttcaagaacagaaaataacatgatgggcaaacaaacctgctggcgaagcaaaaactctttctgagactttgatagctgaccctcaaccttttgagttattttctcagctacaagaattgactgttcatcacaaggaaaggaaataagttaaaaactacccaatgtttaaacctttgatgatgaagttattaaaattaaggaaaactaattcactaatcataaatgtcttcacctgcaggtgcctgtcaacaagttcggttgccttggaaagtctaacttttaagtcaactgaatccagcattgacaactgctcctcaaaacctatttcaaagctagccacaaaaatatcagctagtctgtacacaggaactgtctcaagaagcaccttagtcctaccaactgtcttctgcttctgcaattagaaacaacatcattgccgtaagtcatacataaccttgaaagaaaaatgtcatggataacagaaagatgagactgcagatctgatagtcacattgggaatatctatttagggtatagcgctctgttaaatttcttcacctgttcaagaacggaaattagttccattgcagtagctttgaactgcctagaaagagcaatgagatctgggtcctgctctgcgtgctccaactctagcaaattgcacaaacattaataatgtagtgttagaatttgatattaggtgaattcaaaaggcacttaacaaagaaggtacaagaataaactaatataccaccaaactatcggcataactacaatggaaagtggaagaaaagggtggagctgtacaaaataacagctacaacagacttatgacaatgtagtgcaggaaaatagcaacaaaaataaactaatatttttaacaaacaagatcttacccgtttttgtcatatcaagacgtgagacacgagcgacatgatatgaacctcttgcactgagctcttgaacactgaacctacataaaccttcaaggacgacaatatatgtaacccttccacttggtttctccacacctctggaaaggtgcaaagccctagcagctactcccctatagatggacggaatgaaaaagtgttacacacctttttttggagaaagggagacaggtaggaaaacacaacaaaattgactaatttccaacagttctcaatcaaataattgtgtcaaagaagagttgaccactatcaaccaatcttaaccctcttgctttatctaagcccactgcaagttaatgcaatgtcacaccaacgcatagtgcgcccaacagaaagaaaattatttgcttctatcaacttatcaagtgttcatagaatgtaataagagcatgtgcccacactaacactagtttgtttacctttagtaatcgtatgctattgttttcccactattcccgacatattcaaaggaatttcttctttaaatcttgttcagagatatgaccatatggaaaaacacatattagcaaagatggcaatgttacacaccggctgtgccagtgaatggtctccttcccattcttagtatcctgcttcgttgattctcctgcagaaccaccaggcgccttgctcccaccctcacctgaatcgctgcctacacctatatgcgagcaacagcaataacagtaagaaaccaccatacaacaatgcccacaaatggctcacagaaccaaattaaaaaaaaaacagcagcagcagcagcctttatctcaccaggagacagcaatgagccagcagcttcggagtcatgcacagggagcaccccgatcagacccttctcctcccgttgccagagttcctgctccacaagcttcacactgcaggagaaacaagtacattgatgaagtcaaaatccaaaccaaaaggcagaattttcccttcccaccaagtcaacacacactagcaaagccatcgtacgcatacacagaggaaaaatctcaatactaatctgaaccacaagtaagtacaacacgcctagaaggtttgaacaccaaacagatataattaggagctgaattagtcaaccataaagcaaccaaagccgctctaaaccactttggattcagcgagttcatcaaactgcgctggaaactttttaactgttcacatcacagacgagatcatcccatcgagaaaacaacaagtgacgactacaatacaaaaaagcagaaaaagaaaaagaagaaaaagcaatttctacttgctccacacaaattcacaaaaccacagacgaaatcgaagaaaaaggcctcacgaatcatgagctaagctgactaagccaatacaatagcatcaaacaaagctaagctactgcgattttaccaaccacacgctgattaaacctaacttggactaataatccatccaccacccaaacccccgcgcgcccaatcagcccatcggccaccacccaaaattccaccctagaaaacccacacaacccgagaccgtgaaaccccccaatctcgcggtgcgcggaatccgctcgaggggcgccgacgacgacgccgcccccactacttacctgctggggttggtgcagcggatccgcacgatggcccccgggaggagcaccttgttgcggaacggcagtatcgcgagccgtccaggcagctccaccgccgcgtccgccatggccacgcacctcgcccaccccaccgcgctggaatcgtacggaagtggaggggattacggctcccgcgctggaattgaaatcggaggttggagacgatgacgaagacgacgaaggggatatttatggggtggaggtggaggagagcacacacgagccggagccaaactgaacacagagagagagagagcgggggaagtcaaggaaggttgctgcaggtggggcccgcatgtcagtgagtggtgtgtgggtgggtgtggacgtggcgctctggtgggataagggaaagggggggaaaggtgggatgggatccggtgcgggggcaaggaggaaagctgattctgattggctgcggggttcgggttgttgtgccacgctggcggtcagggggtgggcgggtttcggtgtccgctgtttcggatttcggagctcaggctgcgggatggggggatgtcgaccgtccgagatgggatggcggacggtgtggatggtgatcttccgcgagtccatgctgccatgccggccgtaagatcgggatccaacggatgggagtggtttagcgagtcatctaggccctatcttggagagtttttagtcactacagtttcttgaaaaatctttagcttccctgcacctaggttttgattttcgtgaaaccgttaaatgtcggtttgtaaaaaccggtcgtgattagctggttttcgtacagcgttaaccaaaagtcatcggttttggaaaatgaaaaggcaaaccctacctacatcgtcacatttttactcagatcctaataaattgtaatataaaaatcagaagttgaaaaacttgtttattagattctcatctatttacaagttactactacctccgtctcaaaataagtgcagccatgagtttccacgcccaactttgatcgtccgtcttatttgaaatttttttataattagtatttttgttgttataagatgataaaacatgaataatactttactcgcgacttatgtttttaatttttttcaaaaaattttcaaataagacgaatgatcaaaattagacgtggaaaactatagctgtacttattttgggacggagggagtagtacatattcctcgaaatcttgagctctaatttagcttccaaacaagacattatccaatccccataaaatcatgtgaaaggaaaaccattcctaatcagatttgcacatcggaattcataaaattttttattagggttccgaaggagttgaccccataaacttgacctgtgaggtggagaattcttgcaatctcacgcgtattaaactagtgttaatttggatacgaagtactcgtacttaagttagcagagacgcttattaatcaattaagtccgtgcagaagaagcaattcttctactacgattatattgcaatttctgttgctaccaactgctatgatatgttcaataaaaaaaaaggaatcagccttccgccattaccggtataatgggtgtgtttagttcacgtcaaaattaaaagtttggttgaaattgaaacgatataatacaaaagttgaaagtctgtgtgtagaaaaattttgatgtgatgaaaaaattaaaagtttaaagaaaaagtatcaaactaaactcggtctaaatgaaagctcggattagtggagccatgtcggcagccgtttttatttattcgtctgttggcaaacctagatttgataacctaaaattcttgctgagcttttcccaaaagctgagctaggcacgtggaaatattagcatgtgaaatccatggctcattctaccgtacatgacgaatttatgaggcttccagtcaacttcagagcttactccaatagtactatatactacagtaggtaggcttgtccaatagtactctcttcgtcataatataaggtctcgttgagttgacgaaaaaaaaattttggatattacatcggacgtttgattagatattggaagggttttcggacacgaatgaaaaaactaatttcataaatcatctgaaaaccacaagatgatttattaagtctaattaattcatcattagcacatatgagttactgtagcatttatggctaactcaaaagatttgtctcactattttcatgcaaactgtgtaattagtttttcattttatctatatttaatgctccatgtatttgtcaaaaattcgatgtgacgtttttgggaaaaaaaatttgaaactaatcaaggcctaagtagtactccctccgtcccaaaatataaaggattttggagggatatgatttctagtacgcaggtactttgtccagatttacagtactaggaagtgtcacatccctctaaaaatccttatattatgagagagaggaagtataatttagggtagttgtccatattcgtaattttaggatatattgcatctatactatttatattgggatggagagagtactattgatcagtctaggattgattgctcacgtaactgtctaagagtttgaattgaaatataaaattcaaagtaatggaattacataatgcacaagatactatttagcaatgcgattaaacaccgcgtgaagcaacttcagttattacattcaggatatgatgtagacagggcaactagcatttctttatttctctcatttagtgattatgatttatgtgtgggatactgggattcgtggaaggaaagcagcaacctcccaaatatatagtagagttgcctcgtaacaaaatgatcagagtttgatactggcaccaacaatttatatatatgctacagtaactaaagtgataactgagtcatacggaccctgacgaattaattatacttcatcggtcccaaattataggacgtccttttttaaaaaaaaatatcaaaatcgataattttttaattaataattatattaaccatatagtatatgctaagtactatacacgttatatcactatatttatatttaaagtactttgatatgatgttaattttatatttgttggaagcataacataaaataaattaacagcaaaagtatattatagaagatcatataaaaaatatagtgcttataatttgagatagcacaaagcaaagtcgttagatcatactgtgttcccacgtgcaaggccggataactagacttggtcacgttcttttaagtttttccctagatttttaccgtggattacttgctccacattttcaaaaaaaaaagaagatttgttaaaaaaaaatcgtcttctgctctagagtttaagtcacttgttataagctacttcctccattttatattataagacttttttagcattgtccacattcatatatatgttaatcaatctaaatatatatgtgtgaatagattcattaccatctatatgaatgtgagcaatgctagaaagttttataacctgaaactgaaacagaggtagtatttcaaagttttttcttaaaatattacaattaatcgtgttaatcaggtaaacaatcagccacgataaaaagaagcaactagcaggagacttgggagtctacgagatactcacaggtcaccgccggcatgtgtcaaacaaacagtgcaccagattgcacgccgaggtaagcaaacggcaaggaaatttggcgacggttcagacctggattgcattaagatactcgatgtttagatggcaacacatgggtaactacctgtacgtcgaaggctttacctgacaggcagctctaaaatatacagcacgagctccatggctccacggcagcatctccaagacctgagcccaagtccacggctgatggagatgcatcccattgcttatccagaaaccctgaaagaattcacatatagttaaagatcagaatgcaaacaaatgcagatccaaaaatgatagatagatgtgaagtcatcgttctggatgtcgccgtcgtcatcacgacgacggtgtgggaaatttcacccaaatttcaggaatgggattaaaaaaaatagacaagtttgtttgaaatgctgaatatgatgcacgcacgccgtggctgtttattcacgtttctgaaacgctggatccaaatgggcaagtgaaggcgatggctggcttcaaccacttgccaaatcggaaagcgaggttcatcaaccagtacagcgaagtgactagtagagcaacaattattttgataaagacgctgaacaaaaaaaaatcatttttggaggcatggcactagtgttcatactatctttgtctctaataggggtaggccctttgatggttgattggcagcattgatcatctcatcatggtctcttgtcctgattcctgatcagtttcttgccttcacgggcttagggtgtgtttagttgacgtcaaaattgaaagtttggtcaaaattgaaaagttgtaagtttatgtgtgtaggaaagttttgatgtgatggaaaagttgaaagtttgaagaaaaaatttggaactaaacacgacaggtagttttgaaacttttcctgcaaacaatagtccctttatgagaagaatcgttatgagaaggtgaaaaatacagaactgtaactgattttctgaagcaagaaaataccaaaagatttttactatgcatcaaaatgagaaggaacttgtatatgagtatctgagattgttaggctttctaatctacaatttgtgaattaagtctagctaaatggtccttgcattcataaatgataaaggatgcatttatatgttgtaacaggaatgaggccttttgagtaccttcagcatcaagttggagtaagttaccagcctatgtgcactaggccataagggtagtggccctaagcctaggcccaaatttccatcgcagatttcacatttgcatctgctactcgaaatagaatttttttttccctgaagttgtggactgaaatttcaaggggtgcgaatcacatagcaagatcatcaaagcaaaaaactacatcgcccacgaaattcgaatcaggtcgtctttgccaaatcgtcagtgaaccgtaacacttggaagcacgctagtaagatcaccagtccataacgaattcaccggaagaaacatcatcacctcggattagagaattagaatagaacgaggcgacacgatgtatcgggtatattgtgaaatgaggaagatcatgtaaggttagagcaaggcgacggagatgggaggccacaccttaccgccggagaggacggaggccggagatcccggcggcggcgccccagatgaccgccgtcgtcgtcgacgacagcagcgaccagccgcggtagattggtaggcctcatagtctttcggcccactgatcaaccctatgagaagagacacaagttggccctctggtgcatgtgggcccaaatcacagcggttacgctccgtatcgcgttccggcccaagtcagctcagcaggattcttcctcggtttaatgtcctcgatttggaataagttcactttgactctcttaactactgacagaatcttattcgtcgtgcccttcaaccgcaatatcggatatctcgacccctaattattaaaaccggtacaatttgactcccttgctgcatgtttggttggagggagtttttaggagggattgggagtttagagggatgaggctatagacggccatatggcccgaggcccacggcccggcacgaagcccgcaattttggcccggcccaaccacagcccggcccgactagggtcgtgcccgtgtcggcccggcccgacagccgggccgtgcctgggctgcaccctcggcacggtgggccggcccggcacggcccgatcaaataaaaaaatacagggatgaaaaatagacttatataatcgtataaggcatggcccaagacaataggtatacaaaatagacttattatccagccatttaaacacagcccacagagttgagggaccaaaaatagacttatttccagccatttaaacacagccacagagttgagggaccaaatatagactttttctgtgaggcagcacaatagcccatcataccttcgggccagcccggcacggcccgagtagtattgggccgtgcctgggccgtgtatgccgcccgtgggctggcacggcacagcccggtgcgtcggtcgagccatgccggcccgacaagcctcggcccaggcacggccgggcttgggccgtgccgtgccaggcggcccagatggccatctatagatgaggctattaagtgttttgtttggttgggagacatgggaattttggtgggatggggatggggaattgagcaaggaactccctccttttcaatacctgggtaggggtaggtaattgggagggaattcctcctttactttttctaagcaaatctcagccatccgtttttattaatgacctaatctccaactaaactccctgtcaatttccatcacctctaccaaacaagatattgggattaaaaattaaattcccatcctaatctcatcatcaattccctcgtgtaaactcccaatccccttccctcgagttaccaaacaagccgatgattttggtcttttcgagagcagtttcgctaatgtgacatctacgtgatagtgttgacctgatctgtggcgttgacgtggcgcttagatagcattagaattaaaaacatatatgtgggcgccattcgtcattcacaaaaaaaattatgggaccgttcatgtgtctccccctctctgtccttccttctctctttctcttcctctctggtctctactttgacacgggatctggagcggtagggcgagggcggagcggcggcggcgccgaccaccttggtccccaatcccgactactacggcgcgctactctagcaccgcctgatgggccctgtggtcctcaaggtggcgaccaccgccggtagcggcatcggcgtcggctgcggaagccaccgatttgatcaaatcatcctcacccaccccacacaaagaagtgaggggagatggcgctcgcggtgttaacccgcattgctgcgttgtggaagccgtggttctcgccggcggctcccgttccacgactctcacggcggatggtggtgccgtccccggctcccgcggcgtggatgttgtcggctccgtcctctgctcctgcagttgcggcaccttctccacgtacgatttcctcgccgcgcgctgccgggtccagctaaggccccctcgtcgttgctgtctccctcgctacgctgtcgattttgaaatgtgagggtgatcatggaggatagcggttcgtgatcgatgatagaagagcgatgggtgaaggtgattagtgattcggaggagagtgttcgtgatcgacgcataaactagaagagcgcgctgcgtgggatgggtgagggtgatcacggaggatagcagggttcgtgatcaacgcatagattagtggtgggtgaaggtgattagcgattacggaggagagctttcgtgatcgacgcatagaacatataactagaagagcacgctgtgtggtggatgagggttatcacggaggagagcgggatgcgaaaagcggtgggtgatcaaggagaagagcagcggttagtgcgagcagaagctagacgcggtgaaggaccattatcttccttctgctcctcctcctcctcaatagaagtagaatcggcagtagctgcggccgccatggatgcttcgctgacctccgatattagttactccatccatttcaaattgatctacatatttcataggtacaccaagaccaaaaaaagctaataactctctcatactatatttactctagcaacaaactcgatgcatgcaccatccctactatttcctagccaatagcaaatcaatatattgcatgtgggttataaatacttgtgtgcatggatgcatgtatcaatgctaatttactccaatgcacaaataacgaatagacttaatgaatgaacagaaatatgtagatcatttaggaataatcttaaaaaaactatatgtagatcaatttggaatggagggagtagttcgttagagagagaggatcggagaaagaaggtagtgggtagtcatggactcggcccaatgacagtacacttttgtttttggcccattcaggccgtaggtgttctgtctcgttgataacagctatgtggcgtgtctagaaattggatttgtgtctcttttttttcttttcttttaactattttttcttatgtaaaattttctcaagacgacccagttttagaaaaatatacattagtctctagatttatctttctagacacgaagttaattaacctttgcggcgccatcatcccgtgcaacaccatctccttcctccacctccacttgtaacgccatcgcctcctccccttcctctacctccacgttgatgcgatgagagcgtggctggcaagtagggaatttgcaagcgtcaatgactacgtgtgggcagggaagagatgggaaagaggatgtgtgcatgggagcttgccgagggtgtggcggaagcagcaagacaaacgtcgacgacgccgttgttgtcgggacggagactaccagcggcgtggtgggtgaagtcacagggagtcgaggccgacaggacagggagatcgacgggctaagggccaacctctaggtggccgtgcagacaaaggagaagagcaggaaggcgtcggacgacctcaccgccgcactctccggctacgatactttaggggagaaggtaatgctcatgcgcgtccaggcagtcgaggacgaggccacgcggcagggcaagagaaatgtcaaaatagagagagaagaagaagtttgtgtcgctgacacgtggggtccaccaatttttaatcttattttaaagctgaaatgccgtgacatgtggctcccacgttaacttagccgccacgtcagctaaaaccgggaacaatattaccttgcgaccaaatgtgatccggttttataagttgagggtcggatcatacctgctatgcaggggcgaattttaaactcgacgacaaattgaccgagtcccatcattctaagcccactaactctcctgaatctcccttgcggacttgcggttcgaacagaccaaagcttgggccctcgacttctagctttcgcagcctgcagtattggtaagccctatgggcttacagcccacgtgtcggcccaactcatggctgctggtgcccgtgggcttcatgctgcatcgagttcaaaagaaagggggaaaaaaaggaaaggaaatcgtaacactgccctaagcacgcctactttcaatgaaatctaatccctccgtcctataatataaggaattttgagtttttgtttgtatcgtttgatcactcgtcttatttaatttttttataaatataaaaaataaaaagttatgcttaaagtactgtatataataaaaaataaataataattttaaaaaaatttaaataagacgagtggtcaaatgttgcaagtaaaaactcaaaatcccttatattatgggacggagggagtagttatctaccaatcaaatcaaatgtattctcatactactatcctcatcctaaataagcctaaaaaatagaaaggaaaacaaaaaacaaaaacgccaagaatccaccaactcgtctctgtgtctctctttctgtacttttctttcttcattcatgccgtgatcgatgatagcagcagagtgcaacctcacctcctcctcgccggctgcggcgcgacgtcgaccctcttccccttgccggaggcggcggcggcggcggcggggggaggaggagggtcgggctgcgactggacggcgcggcggaggacgtcgacgacctcggacatggtggggcgctccttggcgttcttgaggaggcaggactcggcgagcttggcgatgtcgcgggcggccttgacggagtactcgccgcggagcctgggatccatgatcatgcggaagttgcggctgtcgggggcgaactgggcgacccactccagcagcttctgctccccctgcggccggtggcggtccagcgtccgccgccccgtcaggatctcgtacagcaccaccccgaagctccacacgtcgctcttcaccgtcaggtgccccgtctctatgtagtccggcgccgcgtacccgtgcgtcccaaccacctgccacacatcatcatcatcatcatcatacaccatcttgagctcagctatgtatgtatcatatagtaagaacatgaaaaagaaaaattcaaacctctgatcgattggactacgacaagaaaaataaacgaagcaactaagaccgatttatggataagacatgtttttagcgaaccgttcaaaagccaaaatgacatcaaatagggtacatgaaggtaaaaacaaaaaaaaaacaatttaaaactaagcaacacaaatagtttatagataaaacctttatatatgtgtgtgttattagtggtttaaagctaaggctattaagggggtgtttggatactgataaactttagtccctggtacatcggaatgtttggacactaatttagagtattaaatataaactaattataaaactaatacacggtggaggttaatttgcgagacga

SEQ ID NO: 3248 - DNA, 12033 bp, Oryza sativa
ttgtgtaattagttttataagtagtctatgtttaatactccaaattagtgtccaaatatccgatgtaacagggactaaagtttagtcagtgtatccaaacaacccctaaatagactatgatgaaaagacccaaaatcaactttagaattatgttttagaattcaaattttttgttgtggctaataagccaataagcagacaattatagcattgatccatttcctaaggataataacatagctcaaagctccttcgcaatgcaggaatttcatggaaatcttctaaaattcctatgttccaaaggtctggtatggtatgccatagagcagttctgcgtcaatgctgacacaaggtgcaaaattcagggggagaagagtgatgcatgcgtggcatgtgtgcatatgtaaggaagtggtggcaacttggtccatggcattgacttgctggattgcggtcaagattgtcaggtacacatcaaacaggtgcactggactgcttgcctacttcagtcaacgatgctttaaaggctgtagtatataagttgctttcagtgcctgatggatcagacaatgcagttgcgagaaggctatggttttgtttgtaattctaatagcaggttcagatggagacataccgctgttgagacgtgagtgtttgctcctgttggtccctcccttgctagcccgaagtccgacagctttgctctgaagtctttgtccaacaaaatgttagatgctttgaagtcccggtagattacctatcaaaattgagcaaatcagatgaggatcttcccttttgtacaaaatggaaatgtcgtaaccaaagaagaagaaaagctgaagtaactttgtatactaagcagcagtacgcaattagcactgtaaattatgacgatgacctgaaaaaatgtgataggtttagccttccctaacagcctgtatatcttgatgctcaccagctatagagccttcttgcctaagtccttaattgttttctagattggaatacttggttctacagctaaactagaacatagagaggacaaatcgtatacgttggttgcaactaggagtagttagtactgattatgctttcagaaagtgtcaatgaaatttggtgcctggaatcttacaggaaagtaatggagatggagatggaattgaacaaaccacttttgcctctttttcatctagctcatcaattcgtggtccttattttctcattgactttacactggaatactggattcactgcacctctattgcactacctctagttactatggatgcacggtcaaaagaacctattaaaacgttggtgctgtctctcatcatatatttttattgccaaactttctcccacaaaaaacgaaatcacctatttgataaagatatatcttttcagagaagttgaaagcatgtgggcaatgtatgtctgaagtatacctgaacttgcccttcatgcaggtaagctaatccttctgcagcacccaagattatttgaagccttctattccatgagagaggaggataagctcggacgaataagtgatcttccaggctcttattaggcatatactcatacaccaataatctttgtggccccctttcaccatcaacggcacaatatccaagaagctttacaaggtttgggtgctcaagaaccccaaggaactgtacttccgccaaccactgcttatgtccctgggagcaaaattaaaagaaactgcaaaatattaggaacagaagacaggattactcattagagggatagcataggagatcaaccgcatttgttttagtagcattatagcacaaagcaaatataggaaaccaacagacctaatgctgccttacaagtagtttattcataacatcactataattagcgtgcatcctaaattcctaatatacatcaactggtcaagaaaagacatcataactgagtcagtaaaatatcatctaattcgagtagagaaacttggaaaaatccttatatttttagcagacaccacttagagaaaatgaagcttatgcttgggtattctattaagttcaggacttgaaattaattatttcctgtactccactaaacgatatattcactaccggtttgtcagtctttagacatcacttgcataaattcagaatggatatagagtcgcaaagcacatggaaattgaagtttctagctgacttttgttctatatgttcacgcaccaaaatttttcctcctagtgagtgaataatagtcaaataagactagcaacatggttgtgcaggttgcccagaaacgtaatctattctatccattagtcttctttgattgagcaaattagctaacggaatattgatttagagtgaaaggttggttcgcatcattttctaggagacatatttctactgtaagcattcagagaagacatggtctactattaatattgattgccatttgttttatgatgaccatgaatgaatattcaacttccaagtttgaggaagtaaggttcctagatacttgaaaagttcattgccgttcaaattctatcctgtatttcccctccattttgctttattatgaataaacagttgccacgtgtgcccattggtcctatatttaaccacatctccacgcccagcacctcaactagtaatagtttatgcagaccagtaacttctatagtcaactgacaatggactgaagtaatccaatgcaatagattgaccccataaaatatactatcaaaattgtaaaataacagtaacaggcaatatctcatccttgaaagttctgcattttgatcctgtcttcctgtcaagattgtctacacagagagagatttttaacatactgataatagataaccaaaccaatttcaacatttagcaagccaggaatatttccaatattccggcaaactagaaaatgacttgtgtccatggacttcctatggatcagaacaacatacttgtcagtttatccagagaccaattcaagatcagctaacaccaagcacagaatccattaactttactccccataatgaatcttcccataacagtcgttaatctaatctagtggtcactactgatgattttcatcaaatttggcagaactacacattaaaaacaaaaactcgctaagttgcctgaaagcattcttctgcattctatgccaggatcttggcgaagagaagtatcaagaacaacaaaaatggcatcatttgggatctcccttaaaaaaacacttcccttatctaccagcactaatttctgacaatactgaacataagagagcaaaccttaaactaacaaaactcattccccaattctcctattcccaaattcctattcacccctagttatcaaaccggaaatcaatcgcgcagaatcacaaaggggggaatactactcctggatcggaatggaggattcgttcccgggtgacaactgacaagacatgattgatggtgtccaagaaaagtcaagaggagggggtgcagactgcaaagagagacagagacaggggaacgagaaggaggaggagagcacgcaaacaagcgagtacctggagaccccgctggttcaggcacttgacggcgacggcgaggcgatcggcggccttgccgtcggcgggggaggagcggacgaagcccttgtagacgctgccgaagccgccctcgccgagcttctgggcgcggctgaagccgttggtggcggcctggagctcgtcgtagtcgaagtcccggagctggccgtggccgcgctcctcgtacagcgacgagatgctccggtgcgacgacgtcgaccccgtcgacttgctcgccggcctcaccgccccggagtcgtccgacctgctcgtgctcaccgccgacaccgtcgtcgtcgtcgagccccgcctccccgacgattccttgctcttggacgacctccgcttcttgaaccaacccaagcagctcatttcttgcagcaagcaagcacgcacgcacgcacgcgaaccgtgtgcggtccaaaatccttttgtaggcgaagaagaggaggcagaggcagtgtgaactgtgaaccgcggaaggtagcaatagcaaagggagaatcagaaagctcgccaagatttatttcggcaggcgagagagaggagaggggaagagggcgcgtacgtgcgggggtagtactacgtttgatgaagcggccgcgtcggcccggttggctctgccaactcacccctctcgtttctaaaaaagttttatataaaaattgttttaaaagattatattaatttataaataaataacaaatatatatttttttagaattacacaatacaacgcagacattcacaacgcacgcgcactcacccctatgaacacacgcacgcaaaccctacccctatgagcatcttcgaagactgtgccggcaaattctggaagagactgatgaagtcaccacaggcgcctcgctgtcgacgggtacgtcacttaccactgaatacataattaactatatgttaataaatcactacggtttatataaggccagacccagcccaatacattaaatatagtttccataaactccacgttatcaagaaagtaagtattagacactactttttcatacttcaatttaatgaagtactacttatttcatatgatgtcttggatattgtgaaaaaactatgtcttggatatttcttttttcctctctatttccttgtcatattattttttttattttagatgatagtttatttaatgcttcgtaggagtacattattctggttattgcattgaggctggcctaagtgctgccggtggtggccgttgcacgcgcggtgcgtggtagactggtagttgattgatcagctgatcggttgctgctgctggggcgcaccgggcgcacgcggacgcggtgtggtgtgagctcggcgggcgggatggggacggctctgtttggtgttgggtttttgttgtgtggattgcccgcgtcgtcgtacgggtctcaactacgaatctgaacgcctcgtcggcttcgccaaattcgcatgcctgcgcgtctctctctggctctgcaggtggccgtgttcggttgcatcactgtatagcagtcgcagcccccttttctaatcatggaatttaaatttactttgcatgagttgcgtgcgtgatgaaaacaacagctgtgggatggtgatgcgagtgtgtaatcgagaatattttttagggaaacgaatatgttgttctagcctgtgtttagttccacgttaaaattaaaagtttaaagaaattggaacgatgtaacgaaaaaattagaagttcgtgagtataaaaaagtttaatgtgacgaaaagtttgaagtttgaagaaaaaagttagaatctaaacatggccctacttttttatgaaaaaacataggataaacgtagatgtttataacatgcacacgtaaaatctatttgtatgaataccttcagaagactaggatcaacatattttaaaattcaagaagtcaccacatacatctcactagataagtacgtcaactaccactgaaagactaattagccgtaaaggcgtcgtgttacgtttaagatttgaacttgagtgagttgacttcaccaattcaatcagttgagctacgtttattttgcatgtgtttatagtatttgggtgtacactttttctctctaatatcttcacccgcgtggattgaatcttctcgtcagatatatactgatatggaccacaacaaactttattatcactatgttttacagagtttcataatctatttagctccatccttgtatacatcgaagttgtcggccagcccaaataattttgatgatcaatagccacaagcgcgagaataattgtgacgaaagtcaagagggaacatagattatagtgatatatattattcataggctcgtagcttaattcatgttttgttcgacgatttttgatattgtttacttgcatatatgccatgtgtttgttacgttgggcccaaacaatacgacacatatatagacctagtcgcgacagtgtacatgattcttcaattgtttcttgggtaatgggttccatgcatgttccaatagtccaagttgggtgtttaaaacttggaagaaaatgtgaaagaggtgttaggtgaattcacacttcagtgcccaagacaccttcaatgtcaaatactctaatcaatgctggtcaagtgactcataaaaaaaattgttggtcaagtgaaaataataaaatacagacagtcttagaatagtgtgtttgagaggaagaaaacatataatatcccactatatacataggatttcaataaaatatcactcaatggaatgcatcgtataaaataccactcaatacgttgcctaccagatgaaatattactttgaggagttttaaccatttttatactcgaaatgcccttggctgtggctatgaagagagagagagagggagagggtgagtcaggggaggaccgggtgcatggcgccggagacctcgctgagaggcggtggcagcggaaggaggacaagacggcggtggggataaggaggcgacaacaaggatgagacaccactatggaggtggagatagacccgtcgtcccggtcacttctactcgctgcccccctcccaaaaaaaaaagcaaaaatgcaaatggtgtgtttttcataaaaaaaaatacatatgattttttaaaaaaagaatttaaatattgatcacaaaatcattcacctaggccgagtttagttccaaaatttttctttaaacttctaacttttccatcacatcaaaactttcctacacggctacacacataaacttccaactcttccgtcacatcgttccaatttcaaccaaactttcaatttttacgtgaactaaacacacccctattcagctataaaaacaaatagaacaatccatttgtgtactataatagtacaccactggaacaagaaagagggctattattgacccagttgtagagggatcacattgctcagctctaaaccatactattccaaagaacttctgcaagacacccactttgaaaaaaaaaaacacctaaacaaacaaattgccccttggaaggacaggactagttagtgctgtgtgttgacctgtgtaaacaaaatcagattttgtgtaccggctttctagtgaactgcgtacaaacggtgcagatgagaggagacaacagcagcatcatgaagagcactggaggagaagaggacggcgacgcctctgatgaagagaacccgtcgtcgtttctcctccccggtcaaacacacgggctgcaagtctggaatgatggagaaccaaacaacccgctcaatccaacgctcacgtgtgcgtctgttaggctgtgggccccggctgtcaggctgtggggccccggtcaacgtcttgaccgggacgcgactgtcgcgcagtgacgtgctgcttgatgaacaacaacacctggtctcttcacggttagcccaagtgtgaacttaaaagtacagccaatcagccatggttagactttggaacacgcaaaattaacttggtttctgcgaaaattgaattgtcatatggtctctccgtaatttttttatatatagatctttttagatggaggaaatactcacatggtttattccctccgtattagaaagttgtttttttctctagaacggaacgaaatgagtattcgggaatcatgtaaaattttgtgttctgaataatggattaggtcgtgtttagttccaaagtttttttttcaaacttccaactttttcattacatcaaaatttttctacacacacaaactttcaacttttccgtcacatcgttctaattttaaccaaacttctaattttggtgtaaactaaacacagccttaacctcgctgttcagagttgggacatttgaaagacaatactgtataattcatatgtcagggagctaactaaaagttcagaagaaagagcgagtctcaaacattcctctaccagtgtcaaagcgtacggagctatgccagcttgtcagctgcgagctcaccatctcgccatagtcgcgtgccaaaaaaaaaaaaaacaaaagtgattgatcacaagaatcgcattgctgccgggtacaccacgctgagatcataaatttacaatctaattaagaataattaatggtatactacacattgtcaggtcagcccggtgagcttcagaattcgacgatccatcattcatcgcatcgtcatcagggcttaggttgacgacgccccggtcaattcatccactccagccgttgtcatcatcatcatcatctcctcgtcttgctaaccgtcgcgtcctcatcttcttcttcctcctccggattaatcttctgtcgcttctgcaattggtcagcctgtcagcaatgcagatcaagaagttaattagcgaatgtaactattactaagcagtgaactgtgaagcaattcaatccatgagatgcaagtcgtatgaacacatctgaatgcatagaatgtgtccggacagccgtgtcaatcgattgatctagacgaacttggctggaaacagttttgctgttgcagctgacgcgaaggacgttgactccccttactggaatcgcatgctcatctgtgtactactagtactgaggaggattcaggaaaaggtagtagaaagaaagaaaaaagagtcaggactcgagactagttcagttcaatttttccgtaccctttttctgaaacaaatctgccttttgattttgaatgactaataacatgtaggtacgtacttcatatctaacggatttaatatataacagtgatccaggttagaaaacagtactgcagagagaactcatcacctaaaacactgcacggctgcacctaccttcggtcttttcttgtaccaatggttttgaatattttgatcttttcaaccactcaatgtcatgcaggttaattggcgatttaatcgccttttctgcaattcttaaatgcgacaaaagaaaccatcgtcttggccagagaattcagagtttactagttcaaacatggtatttctctttcactgtctagtgcatagtagtatttacaagtagtatccagctagctttttactttcttcatttctttacgtgatcggttaactgtcagctagagaattttggatggtccgaagatttctaccggtatctgtcagtgtccatttttgcagagctgtactactgagccttcattcaggtattgatcgttttcgttgacggatcggatcaacttccaggacaagcacggccattgccattgcatcgatcactatcgaacaaggaccatctatcaaatccggtttccgcgttgcacagatccagagctgttcctctcgtcggtttaagaatcaactccgacgcgcatttactattcctatacttaattaaggttgttgcagtcatgtctcagctacgtgaagaccgggcgtgtcgatcatggcgtcaatggtgaccaactgatgatcaacagtgacagaaaatgcaaatctattttctccattttgaaatataagtatttttatatattcaaaatttatactacaatataagtgtttctggaatactggttctaaggcactgaatacatattatgatagggaatataaacaatttaaaatttaaccaccatagtgagtttttttttacaaaaaaagcctactgtggtgactaaaaaaatctttttactctaacctttagtatttacttaaataactttaaaatacttatgttttgaattaaccaatgtcatatactaatctaactataatatttattaaagtaaaatttactctattttaaactaaccaatgtcatatatcacagatggtaagcatatatggtgtgaagtgaaaatatatgcttatttctagtctattataaaactttggctaataaagatgatcaaagtaaaatttaccctattttaaactaaccaacgtcatatatcaaaggcggaggtagtactattgtactactgcaaggtgttcttttcttctgaagatgaagatgaagattaagttttttacgcaaaacgaggtagtattaacgtatgattgattgagttttaattattataaacttgaaaaatatattaatatggtattttagagcaactttcatatagaaaattttcgcacgaaacgcaccatttagcagtttgaaacgcatcatattgttgttggagaaaagaacgggaccaagtcaagttcagctagcgagcgatgtggaaatcggtagctgcaagcgaacgcgaaagttcagagaatgtgtcgcgcgcggcgtcagtgtcactgtacctggccggcgcggccgccgccgccgctgcttctcgccgcctgcagctgcgacgagacgcggccggcgacttcggcgaagcaggcccgccccaaggacacggcggcctggaggtgcgacgccgtcgcgtccttggcgctggcgcgtagctgcagcaggccgcggtcgatgtcggcctcgtgcctcgccagcaccggctgcaggtagctctcgtagacgtgcttcgcgccctgaaaacgaacagacatggaatgggtctctgaatgttgagaacgatgtctccttgagcgtttctgaatgttcggacttcagcttcagtttgaattcagatttaattttctttttgcagtacttttatggtaggtctctactgttagtattcgatcttggggtgtgtttagttcacgccaaaattagaagtttggttaaaattgaaacgatgtgacggaaaagttggaagtttatatgtgtaggaaagttttaatgtgatagatcgaaaagttggaagtttgaagaaaaattttggaactaaactcggccctactgtgaaaataatctcaaccattaattcctgggttctactattagtagaaaaaagagcactgctacagtgtactgaaaaaaaaccatacaaacataattctcaaccgtttgaatttttttactagatgagcacacgttaattctagagttctatatgatcagatttgtaaaactgtgagtgtttataagaaaaaaaagtgattgtatagcctttttcccagaaaaaattatgcaactacaagtagttgaagtgctagtgaaataccttaatttttgcggttgtcgagtgagtgtactacaagaaactaaatctgataattgattatcggagcagacaattattcacgaatggattagtaacattacaaaacctagaccattgcatcaaagcaaatatagcacatttgagttaatcaggtgagtgcttactcgtgtctttgggtaccagaggtagagcacgagcgcaagctttgcctcgccgtacatgggcagccatgagaccgtgaaataggtgatcgtctccaacgtcgtcagaaacgcgaggagaatcctgaacagcacaagcaattgttcagattcttcagaattcaggcaggatgcagcatgattttgcaggtttgtttgtgtagggtaatgcttcatcaccagtactgacaccagaaacgcaactgatcgatctgcggtttgttcagttccagcgtcttgtagcagtcatacgccgggtaggcgtatcctaaaaccagcctgcgttgcagaaagatgcaaagaggacatgaattgggcttttctgatctcttccacgaactgttcaaacggactgaatattttttcgagattactcacgtcagaagtctagtgataagtaacaccgccatcttcagtcgtcagaacaaaagaagaacacaacaatctgcaaagggacttttcagagatttatcaagcccgtgattaaagaagcaaaattaaacaatgcaatgcaggattcagatttgcaattgcaaaaacaaacgaacttctgaagatactgggaacgtcgtcagaatttaatagggccaaacaatcataaagatcgacgagaaggaaaccaaccaacaatgaagttaatacggatcgcattgcgcaatggaaaattacctccgagaa

SEQ ID NO: 3249 - DNA, 2146 bp, Oryza sativa
tggctgaagccacgtttactgaagattgttaactgaccatggttagtggtgatgccctgccatttcacttctggactcctacccaaaataagctgcaaattgtttgtcagatcccaaaataagctgtatattgtttttttaactactcccaaaaatataagacttactttgacggtccaaaaatgagctttgactgtaaatttctgtaacactacttttacttgcagtaacaaaatcatagccataagaaagtagtctcggtctctcggacatgaatccaatattaccattttgtatgccaaaataaatatctttggattattcgcttgtcaaagcttaaaattggacagtcaaaatatatcttatatttctgaatagaggagtagcatttttagtttccagcaaaaacaatttccaggtagtacagagggaaaggcagagtagggcatagtttctggggatccaagaatgtaaatttccaagaggtcctagggtcccaaatgccaattagttatgacatttcgaccaaccatgtggtcactaacgatggccattattataccagcctccctgatccagtgtgtataattgttttgactttattattttctttaaaatttcttggttctttgggacacattcacagaagccaaaggcaaagcatgtcttctcgttacgcttcgttgtgggccatgttgctttatcacctgtaaccctataaaaccacacgccaacaatcatggattaataggccatgatgaaccatactgaaaagatgtccaatttatgtatgaacatactgaacaaactggattaatacttccctctccccatgtgatctcacatgttcagtgcaatgttcatcttgggagggattttacagatcatcaatacaagctaccagagatcattttagaatcaacaaatggaatccgtcctacaaatacaacactcgtagtatcagatagtacaccagcaaaccggatgcaactacgcagcagtatttgtataaacaatagcactatggcacaagaactactactgctaaccacccatcacccaaaagatgaacaacgaagaacaccgtgaaggcgtttcgctgatggcacattgcctttggtcacgccaaaaatctctcattgtacatggctacatgtatatcctcccggttggtcaaagccattgcccaaactctgagagagctctaggtgaacgactgcgccacagaggaagttgtgaccagaccagaaagaagaccaacgagggtgccgctgttgtaagtgcttgactctgtctgaacagcattgtcccgagagtcgacgaaagtgtcattctggaacggcccgcccacgagggctcccatggcgacgtttgggtttgggctcgtagaatgaagatactggaatcctttgcagcctgtctttgcatcagcggggatcgacgcccctctgtggtgtacctgctgtgggtagctgctcccatatccaaccaggtagctaagcttcattgggttgtctcccaagatgtaattagcctgacatgcaacagaatatatgttagaaacttactgcacaacaccttcctggtcagatgctaccaacacagcagagcagaaatagtgtgtaggtcatgagtcatgacaaccaaagttatcatagaatgtagttaagccacaaaggcaagcagtgtgtcacaatgtgccgatggctcgtgacaaaaaaaggtaggcatgtaaatacaaggaatgttttatggtgtttcttgttgaacttcaacatggcaaactggaatttcagtatcttgcaaggttttctgtagttcacctgtgatatagcaaaattgcgtatatctgtaggactgtagtactttccactgcattgcactgctgctgtttgcgatgtgagcatgtagtcactgtaaacaacagcaaggaatgctgcatttgtggcatgctggagagaattccatccacttatccacaccaatccccctgcacaaaatcaccatcatataattaaatcacaggcaaacaaaatacagtttgcacatattctgtctaaccccagaaaatactatttaatgtaaaaaaaaagtgaacaacaaaagcctatgcataaattctccatgtattgacccataatataag

SEQ ID NO: 3250 - DNA, 5616 bp, Oryza sativa
gggcgaattcgagctcggtacccctgaagagtgaactaacgttattaaaggaagataaaaggcgtagcttcattcctagttcccgaataacaaagttgcttcttaaatgttcatgcaaaattgcaaacctgtgtccctgcaagtttgtcatcccaactgaaccatgttggccttccccaatcagcaaaagcttttccattctctacagtcacataactgaggtatgtttggtctcctgtagcatgatagagccaactcgctgcccacaggagttcgtcttgataaccagtagaattatagtagttttggagctttggataggtgtcactggcgaggcctttataagtatcagcaaaagtaaacaacttctgagcatgttgaagaagtgaatcagaatatgtagtgtctctggatttgaaaacaattgatgctgatgccatagctgctgctgcctcagcagcaacatctgatccaggagactttgtgttaatctgtgtgagtggtcttttctcagacatagtctccggcctttcccagcagttgtgatctagatcaggatcaccaacctacaaggtaacagttatacacgttagttgattaatatcaagacgttcaacaaggtgaggttgctgcatctattgtactgatctgttcaaagaaatatataatgtgttctttgttagatggacttaaggcaattaacatgaacaataaactagcttataagttatatctgatttcatcatcttatgtacattgtattctattcatcaggtattgaatgtgctgtacaacctacccaagtaagcatgactaaacatgtcaacgcaagcattgagtgataaaacttccacacatacagaaattcaactcataaaaacatctggcatcccctaatcttcaactttcaaaaacacccatccccctaccatcaagggctaactctacatattaagagatgtgttgaactttactcaattaagtatgggactaccatccaaatttcaaagggaaaaaaaaggactaccttggaacattgtgggtatatcatacggagaagtctatactgatagtgtgaaaagaatgcaactataaagacaaactggaaagggcatggacattgaacttgcaacaaatgtgttgatttaaaccgatttaaacgtatcaagccgaaaacgaagtacctcctaactattaggtgtccagatcacgacatctgacctggcttgcttcttaccaaccaaactttccctctactgaaagtctgaaatgccgccaggccgcaataaaccacaactaaagcaagcatagatcactcaaaatttttacatagtataaagaattatgctacagctctaacctgaatgtagaacacattgtcagatggatgcgcattgacgaggaaatcagtgatccatcggagagcatcaagcgcagggtccagctgcttcgtggcgctcatctgatctccatactcaagtatggaccacgagagcaccgttgccgtgaaggccatcgggaaactaaacttgatatgatcaccagcatcatacattcccttggaaagatccagccccgctggtttcccatcatccagcgccgagtcccccctccacgggatctggttgttctccagcttccccgctgcacaataccaacagaaattaccaacaatttagcaaataagtacttctttagagctactgaagctgaaaagggttagagattgtgctcattcagcctccaaaacactgcatcggtggctggaacaaccaaaactccaatatccatagctaaataagctaaattcacagtttggttaacagatttaagtgaaatctgcgagcacacatttgccaacgacatagtaatcaccacagaaaggaactgctcttgcagaagagcgtaaaattcacactaaaaaaaagtcaaaactataaggtcacggccactgaaatcggtgagaaatctaccgactcgtcaactttcctactgagtaacgattggtgaaattcttcaccacccagaagcagaaaccatcagatcacccgaaacaaccgtatcaacctctccaactaccaccccaaatgcggagatactaaacgaacacacacacacacacacacaagagcttccaagctgggcgccaagaaagaaaagggcattcgccgcgaaatccgccgaattgcggaagaagcattgcggtggcgaggtggtgagcagcagcgaaccagtgcgtgcggcgggggcaagaagaagaagtggagcgagtggtggtggtggtggcggtggcaactcacccttctggacctggaagaactggagcgccaccccgagcgcgtcgccgtacttggagtcgatggccccgggcgggccgggcaccggcagcggcttgagcttgcgcccgctccccccgccgaccttcttcttcatgatggccaccaccgccgccgtcgccaccagcgacgccaccagcgccacgatcagccacccgcagcaccccttcgtcttggaccccatcgcattcgcctcctgcaacccaccggagacgacgacgcctccgcggcgctgctcggctcggcgtctcgctcgctcgccgcctcctcttctactgcaggggatgggctcgcgtgggctttcggctgggttggtggtggtggcgctcgtcgcgtactcgcgtgtggtgcggccgcgggggggttggtgcacggtcggggtaggggtgaggtggaagtctgggagtcgctgtcgggtggggccgaggcgtggtgggccacggatggcagtgagaggggaggactcagcgcgtgggggtgtgtgggtgaggtgaggagtcgagagcaccgacaggacaggagatggacgggccgacgcgcgctggatggatggacggatcgtttgtgagggtgtgtgtccgacctgtatttaggtgtgctgcaccttaacgtacgtacacgagtggttgtgcaccttactgggatagggtatatttccgtatattttgttttgctagtgtctactggcaagagatcatctaaacatttcacgtcaaattggcaattctgtggaaggtgagattatatttttcggtacgacaactagctggcatttcatgacagaatgttcgtgcaattctatggttgtgtttagttcagcgcaaagtttagattttgattgaaattagagatgatgtgactgaaaagttttgtgtgtatgacaggttaatgtgatggaaaagaactgaggtttgaattcaaacttttgatctaaacacagcctatgttcattttgtggcaatggattggcaatgaattatgggcatgatcccgatccctaaactcttaaacggtacaatattataataaaagcttctatatgtgaatttcttatataagtattttatttttttcctattttacaaatacttaattcgtcatttgtatactcgtataattatcatttcatgccctagtcgccaagagtatgaggagtcgaagaatttaactctttatttgacaaattttgtttaatgtaatatctagagtacacacgtctgatagttgtgacgacgttgcttaatggcgtgaccactgagtacgataaattggtacacctggtggtgtaatcatacacgcatgggccgtccaacccaaatattgcatgctaagcaatgaactggcgataatgattgattaaaacgcagctggtgactacccaaaggaatttctggagttagaattatttgcgcaattggtgtggataacgatgtgcatgcgatttttgggtaagaccagagacgatcccaaagaatttggggatctccaggtgtcccgcagtcggaatcttttgatgacggagagctcggcccctttttaaagcgttgatataaagcatcatataacgttttactcaagcggatgccaaagataatactactaatattaagcaaaggctagtggtaactaaagtattaacaatgtcataagcactggagaaagcattattcaccatttggcgttcatgctgcatagagaagaaaaacaaattgctaaaaaacaccaaggcaagaagggcaggaatctcaatccaagcacacttagcgtaagcatcatattgacggtcatctcgaccagaatactggtgatgagttagttagtgagtagtgacagcagttgagcacagctcacaccaggagctttgcaaaccatgattagtccatggcccatttgcctttgtaacaaatctggggactttgctcattatcttggcacggttctgaaactgataatagataatctggatccatacacaattatagtacatgcaaccaccgtatctgcttcttgttggcactgacgctggcgacaagaccatgagcaccgtcttatgatgcaatattgccgtgcccatttcccctgcacagtgcaaaacaatcattgcaatagcaatacaacttgaacagaaacagactgggatgtagtattcgttgttcttgatgacgcagataaaagggatcaataggacagtgataactgaccttgtggctgttgcacgcagagtgatgctagataaagaagaccaaaccaacaatgttgataaatgcattccgtattaacaagaaggatagcatgtcaagcttggatccagggcattatgattaatccgtacacatttatgcatcagttgctcaaatgctcagccacaatctgcaaccagaaaaccataacccagctaagaactactagtacatgaataacaatgtgagaaaataatccaaatattaacagtcggcattcaattgagaagtaggaaaataggaatattagcatgtgacatcgtatggttgatctgtagtaaaacagttcatccgatggtcaggtcgaaaggaagggtgttttagcatattactatacaaagtgtaattaaactaaaatgcatgatgtaaaatagaagctgaaagggtcagaactgcataagcacccccgataaaagcatcacctagaaatgatatcctattactggaccaattgatctgcaaaaaaataacttttacatatccacagttgtttgatctccaaaatcctgcaataaaaaacatttcagtttagatacagtacaacagagagatagatgagcacaaatatagggatatccaatcgaatggcttattttcattgagtgtgtatattataaccttctggagtcatcaacatcagagtaatagtgtgcaatgcagtaaaataacagctgcaatgtaaataaaagaaaatgttgcgccaacacattttttagggctctgcacaatgcgttaaaatgtctgtaaggtaaacaaaaaacaatgctgcattggtgccacagaaatttattaacggatgcaatgggatccacccccttctttttctcccatcctagagtcaggatatcacaacaaccaggatgtgcagaagtacatcttatctccctcgatacacggatattaagaaagtaggtctttatgtactcttcgttttcaacagaaagaaacatataaggtcttgtgtgaaaatttagtctaaccatacaatgatctcagcatgaatgaatggacacatttgattagttaacagcgtacctgat

SEQ ID NO: 3251 - DNA, 677 bp, Oryza sativa
taaggagagagtagtagtcaattaaagagtaaagagaatagtctagctctctgctaaataaggcttacaaaaatccaaaggtaggtcattgactggtactttacttgccactgtggtctaagatatcgcaaaacttaatttaaagggtaattcttggctagtaagtattcttccaagacctgaaaagtgaaaccgcttgttagagcgcaatatgcttgaataagtatatatgcagataataatttagtaagaactttacttaaacagacaaaatgaggcatctactcaactgtggcatcctacccatcgtcatgcatgcccaccatctccatcctcattgtcctcaagaagctgcagctaataattaaaatgaaaaaactttaacagtatgagatagaaagcatgtgcatattgttagtcatagataatacttacgttttccaatgcattggtaagaaactctctgacatcctccaaacaaattgcatacccacatttagcatccaccatcactgcgtgaaataccgccatacattgaccatcaccatttataaccggccctccagaaaacccgttggcacagtcaaattcatgaaactccgtaagtttcatagtgtaacctttggtattgcaacttgtgagaacatcgtaaggtctctctagatagcttacggaac

SEQ ID NO: 3252 - DNA, 636 bp, Oryza sativa
catcaatagcaatataaacaccagccgtgaaggcagctgaggcaactagcggtgaagatgaaaacgcgcatcgacggtggtgtgaccatccaaccataaagacgaaggatccaatcgacggcaatgaaggcagtcgtcagggaaagtgaagacgcccatcaacggcggtggaatccgccaaccgtataggtggaaacaccagtcgtcggtgatgacgacagccgacagtgagacgttgatgcccaacaatggtgatgtgaccatcaaaccgtatagacgaggacaccagtcggctgcgatgaaagcaggccggcggtgaagatgtagatgcccaacaacggtggtgtgaccatccaaccgtataggcaaagataccagtcagcagcggacaaggcggccggtcggtgaagatgatgacgcacatcaacggtgatgtgaccatccaaccgtgtaggcgagggcaccagtcggcatcagcgaaggcgagccggtggtgaaaacgtagaccaaccagccatgtaggcgaggtcactagtcggcagtggtgaaggcaagccggcggtgaagacatcgacgcccaacaacgatggtgtgaccaaccaaccgtgtagtcagagacaccagtcggtggcggac

SEQ ID NO: 3253 - DNA, 2346 bp, Oryza sativa
  unsure (1)..(2346): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagatatttcatatttcaaagggccggggcgtaagaatacatggctgaggaatgtacgtctagggatctataataaattatcggtaaaatcgagggtttttttgaaaaataaccagatcccacagctcggcgctcgctcgcgaaatctggctacctgggcttcggggcgcgacgtggatagcgcggcgatcgaacacgtgactccaaatcgctgtgggagcttcagttgggggcaggttttaatttatctgatgtagaaggagagcaggaaggagaagaaaggctacagagtgttttagagtttagtataccactcgatgtttagtataccatagcctatcaaattcgtgcctactcgatgttttattgggaattttactactgttctggtttgtcaaattccaatgtggcatcttgtaataatgaggctagtctcaggacctaagggtttagggtatccattaggtaaaacccacgttttatcatttgttccaagaaaactatgtgttgagggtaaagtgtcatatgctccctccgtcccattttaaatgcaaccataagtttccgcacctaactttgatcatccgtcttatttgaaaaaattttataattagtatttttgttgttatgagataataaaacataaatagtactttattcgtgacttatgtttttaatttttttaaataagacggacagtcaaagttggtcgcggaaaaccatagctgcactgaaaatgggagggagggagtataagtttgtattatcgattttgttagtatatctttgtataataatcatgaaaaatatgagatattatatatatacacacatatattagccacaatttaactagtgtcggttatcgtagtacgacgatgtgtatgtatctacaaccagttagcatgttattattattgactattgtgttgtattttcatacccatatagtgcgagagctaggaagataaagtacaggatatgtgcaactttgaccactatttttctattataatacaacaataatatctaataaactattatagtttaaaattacttaactaaaatctacccatatgatttttatgtttttaaattaaatatttttgagagatatttataattagagttttaaaagttaatttattataaattaaatcaatgtacccatatgatttttatgtttttaaactaaatattttgagagatgtttattattaaagttttaaaagtctaatcatagttaaatctatgtacgcatgtgatttttgtattttcaaactaaatattttg

SEQ ID NO: 3254 - DNA, 10131 bp, Oryza sativa
ttctatatgtgaattcgcatgttagatcttacttgttgatgaccaagtatgggattctggagatcgataagtcttcaacgagcaggaaaattcacggagtttactttcttgaaggagagtaacgttgacgtttacccacaactacagaaaagatgatcgatgctggttgggaaatgggaactgaccatacgtatcgaatttctcaactggcacctagtagatagcgggttttagaaggactcaatgataccagtttaggaaccagcacatttaaagttcaaggaatgaaaaaaaaaaggcatcatccgtaagatcatcatcatccaatcacagattaatcattaaaaacaaaatcaatatgagtacagagagcttccatcgctattgttgccgtcatcgagatagccacccccgtggttgcggcggcggattcggtcacccccgagcatgcaacggcgcatttagccaccagcaagcacacggcgccagatccactcactgtcggtcttgccaatggcaattgaggcggcgtcgatcgatcagatggagaagaggaggaaggaggggcggtggagaaagaatatatgaggaagacgcggggcggatgtggcgagttcacaagtagataaggacactggctcggtcgatcaacttaaccgattttttttaattatatgtgttagcttttaaagaaccaacccctataataatataggtatcctttttttaaaaaaaaacaaaatactaacctagaacagacacttatatgttctttaaagtaccgggtttttaatccctttcaccctgtggagtgggaaacggttaatagcactccattcgattatattacaaataattaaggttttataatgcatgcaatcgatgcatttatacttaaccattaactttgaattttacctcgcattaactttcaaagatagttatagttttcttaaaaatagtttaatgatatataatcaatgaccaatcatcaaactaatgtcttcgtgaccgcatcactacccaaaacatcttctcttttaaaataatgaatatcaaacttgatctttatttcactcgaagctacaacacacaaaatccaggtaaaaaaacaaaaataactagagtcgttgggaagcatgctaatgttaatgttaatttagaaggtcgttgataaaagagtgaggtgcacatgcggtccttaaacttgtacggatgtgtcatctatatctctgaactctcaagatgtatttctgggttcccgaacttgtcatgagtatcatataggtccaaacgaacttcaacccgctccgtaaaataacgtagcatgccacggtgacgcttacgtgtgaatgggatttacatgtcagtcacatagaaaaatataaaatttaaaaagagaagagagaggagaaaatgatgtttttaattttgaaaaaataaatgaaaaggagtggagaaaaaatatgttcttaatttttttctatatgtgaatgacatatgggttctaatgacacgtagtcgccactgtgacatgccacatcagcacaagaagcgggttagagcccgtttggatctatatgtgatccgagaaaagttgagggacctagaaatgcattttgagagttcagaaacctaggtgacatatccacacaagtttaaggaccgtccgtgcactttactcttgataaaatgagcgtctaacatggaatcctccggatattgaacctaagcacttttgcttcaatcgaagctacatccacttattacatattttttgacacaaataagtctaaatacaaaaaaaacaaaagaaaggttaggtcgttaagtcgtcggcaaacatgctttttcgtcgataaaatatagccacacattaccacaagtacacgacgacacaatcaacatatccacctcacctatgattagcttaattagctccaacgacaactaacgaaggcatatccatatgcatcgctcttcttctatctagactacaggtcaacaaaccccttgccctatttctactttttttgtcgatcacgccattgatcacctccaagcttagcttcgagctccagattgttagatgcgtgcatggcgatggaggcggaggaggaacgtgacacgcttctgcgccgggtgctgatcagggcggcgcgagcggcgagagccgcggttcgcatcgctgctactactaccgcatcgtctccttcttccccggcactggcggcggcgctgtcacggacgccgagcctgctcgactgcatggacggcgacgacgacagcatcttctacacgccggcctcctcaccggtggtcgtccactacccgaggcgcgtgcaggtgcagcagcagcagcagccgtcgttgagcccgtcgccggtggccgcggcggcggcggcggcggacgacatcgataggcgcgcggcggagttcatcgagaggttccggcggaacgagtcgctggagctgcggtactgcgcggtgtactcgccgctgacgcccgccaagccgcccatttcgccggacacgtacttcaagctctccggggctcatcaccatggcgcggtggcggccggtggctcgccggcgccggcgccgagctcgctgaggcccagaaggcccagtggcatgtccatcaagtggcccacggccggaaggcccactgtccgagtctagcgcacgtacggcatatctttgggacgctcctatgatagtttcgtgattaaattggtattaaacttgtagttttgtgataatttttgtttttaaatctgtagttttataatacttcttcctaaatcggtagttttacgataaatttgttgctaaatctgtagttttatgatacattagtttaaatatgtagttttgcgatagtttggtcgatgtatttgtagttttatgaaatttactctaaaaattagtttgcacttcaaataaattgtatattaataaaaaattagaatgccaccaatttttttaaccgattcattcatagcatttgctgattgatcctaagtactgataagtggtaaatcatactcccttggttcatacctccgttctaaaaaaactatgttttttatccaaaaatttgtctcagcaaactataattttatactgagatctaatatacctctttaatactatattattgttttcttttcattttatacctctttaatactattttattgttttcttttcattttatacctctttatactattttattgttttcttttcattttagctactgaaccagtactatactccctcctcttcctcctacctaatctaaatttgactagctaaaactataggctttaaaatattggcggttgttaaaccccattttgaccaccaaccttaaattgggtaaaaagacgttcaaatgtaatagtttggtttagtttaatctattcgtatagttttgtcgtgtgttagctattttaccgaagtcatccaaataaagctgaaaatgcatgcatttggaaaaaatggtgccgaacaggctaagaggcccgacaaactggatcgaccatgctgatcaggcgatccatgctgatcagccaccctaacacgacaagtgtagaaaaagtacatgtgaggtccctcgtcttgtcatcggattatgaaatcatcctcaaaccataaaaccagatatatgtcatcccttaacttataaaaccagatcattttgggtcctcaagcggttttgatcccggttttatccggcgtggcaactgagtcaagcgtgggacccacgtgggccccacatgtcagtgtccacgtcatcctttactctctttcccaccttctctcccttcttcctctcttctctcccttactcctctctctcactcttccggtcttccctgggcaagctggccagctgggcgtggcaaggtgggacgggaggagggcggtagcggccggtgacggccgacgtggtggcggtggcagccgacgacgagcggcgtgggagaaggagaggcagcggctcggtggtggccggtgacgggcagcgtgggagaaggagaggcggtggctcttcctaccaccacaacggcgctatccactactccctcatcgccgcgggctccagctccgattccctcccctccctcctccgctgcatccttccatcctccccatccgccgaatccctcctcaccgcatcctctccgacggtttgcttcccgaagtggataaggaagagccacacgaggctagcggcgcaaggcgggagaggagacgacgcgacaactggcgagaccgacactggcgccgcccgagctcctctagtgccgcccaacgacagcaacgctttcccggtcgccgccttcccagacgccgccgccgtcgcgttcctaggcgtctccggcgaccacgcactcaccgtgtcggcgaacgccgattccggcgggatgcaaagcttgggaccccatcggcggttggcgagacggaggtggtggtcgatgaaggtgtcgaaggagagcgcggcggcccaggcggaggagaggctgtgacactggagcactgacctgggtgggatgcgcgtgcctcgctcgcctccgacgaggccgatgccgtggcagactgtttagaggagtctgtggcgcgccggccccgcgcggagaaagaacatctcctcccctgtgtgtgtttgttggttccccccgcccccttttgtcccccaagtgtcctcctcttttcccgcgtggttcggggggactcctccccatccgtcggccggcttgcctgagaacaggagaagagaagagtgagagagaggagaaagggatagacagatgatgtggcagcctgacatggggggcccacgtaggtcccacgctgacttaggcgccacgtaggatacaaccaggatcaaaaccaccgaaggacctattgtgactggttttgattagttaagggacgccggatatcttgttctgcggttggcagacgattttgtaactcgatgacaagttgagggaccttcggtgtactttttccaccagtgtatacttttccctaccccctctatctctctcctcttttcctatttctcccgacgaggaatcaacggtagtggtggtcagcgagcgtgaacttgccaacccatccgcgggaaggcggcagctatgttacctcgatacggcgatacggatacggatacgcgatacgtcgatacagggatacggtatttttcaaaaaacaaggatatggggatacgcttatatatttttatatatattagaaatacaaaatattaaggatttttttaagaaaatagcaatataatactagtattagtgcagttgcagtccattccatgaccatcctctccaactctgctatagttgacgaagcgatttaaggctccccccccaaaaaaaaattgtgtgtaataaagcgcaagactacaaatagcatacaaagcgcaaattaatagttcaatcaacacagttgctcttgatggatgtgcatcaacattagcagccgcactacccttagaattgctagatgcactagcacagactgcacagtagcatttggaagttggatctaacaaaaacgatagtccttgactacttatcctaaaataaaataatagaggcattgcagatcaagcatggaacactagaggagtggatttatctcaagtagtgagggaaacaaataaaaagctgcatgggtgcttcgatgcagctggtgctgtcttgccttgggcggtgacggccctggtcggctgccacccggcctctaaactcgtggcggaggtgctgtgcggctgtgcatgtgttgcagagcaggtgctgtgctgccgggtgcggcgacgacgcagttgctacccaacgtgtggtggcgacatcgaatcactgcatcgggatgggagacgacgagacggcggctctgcatcgaatcactaatacgtacgggatacgtatcggatacgtccggatacgtatcccgtatccgtcacgtatctgatacggatacgcggcctagaagccgtatccaggtaacgtagggcggtagtagtggtcgagggccggcaaggaggggccgcggtagtccatggtggcataggagaggagaggagaggatggaggggagggagctggcgggtaagccatcccatccatggtaaggttacaacggaggtgggccaccatgaccaacgtgtcgccgtattcctcccgtgatgcgcctccctttcttggccaccatcgtcatgggccacgtcgcgtcggtagcaggctaatcgcctggtaatgaactcgacctgcaagatgaattagcagccagccaagaacatgtggtcaataactcaatatcaatgctaaaatgttgatcctattcttggcaattctttgaattaatcctcaaaagaagacaacaactcagaactgtatgcatgcattccgacagatcgatcaaaatatacaaagctatgcttatgagaagagaaatgttgggtttactcccacatcggtaattgatgatgggggagcacgacttaaaaggtggaagcggtcctaacccatcaaactagcctttgggggtgtgttgaacccaaaccttaaatttggggttttcgttgggcctggggggaagcaggtccaatgtgacctgggtggcccacgattggtgggccgggctgcgcactgtaacaagtaggctttggtggtttgacggattctgcggacggcgatggcgctagagaggacaggcaaggatccgttatggactaaaccaccaccaaaaccgttttgtgacacaaaatgaaccgatattagtaattgagagatgttgtatattccttttttgcgattgagggacaataatcgaactagacccatacttgagaggtgcaagtgatttagatttggttgcaacttttgtggcccaaaacgggttcgatatatccatggatttgcactggatggtagaacgggtttgcttagcccaaaatggtttccactcccattgttcatcaatccccaaacccttatgtcttcgtcgacagtcaatttcacgagtgtggcgcctcacatctcgctcgacgcgccgccgccatcaagtggctcgccacctccctcctccccacatcggtactgccttgctcaccatcttcctctccgtgcaagctgctgtcgccggcggccacaatgtcgccatggagtagtccatcttcgaggtgatcgagtctggccttggcgttctcgtcttctcgatgatgatgtgtgctgatcgccaccgacggccaacggacaaggacgaggactaagcgatctatgccggtggcacctagccacctggggcctgagcaaccaccggtggagaaaacatctttagccggttgaccagatttcacaatagtcccgattatattaaaaaccaggacaaaaacatatttaatcccggtttaaaagcttagaggtacttttttaaaaaccgggactaaagatctatttttagtcccggttggtaacaccaacagggaaaaaagatcgacatacacagagtggctgcgcgtggatcggatacatatctcctctccttttaactcctcctcacacagtcacacccttatctcttcctccccacctgatctacagcagaggggcgtggagggctggccggccggcacgcggcggctggcggcctcgcggcgcacggagggctagccggcgcggcggcggctggcggcctcgctgcggcgcggtgcgtggagagccgggcggccgccgcggaagcgggcgtagcagccggtgcggcagcgggcgtagcgccggcagccgttcatttttttctgagaatccgtgattcggatctgagatttgtgtgtgatgtgaatatatgatgtatttgatttgtgtgtgatgtgaatatgtgatgtatttgtgatgaattttgtagaagttgtgatgtaatttttttaagatgttgtgatgtatttggagatatcaattggagtatttgaaggcgattcggggaggattgatttgggattttgagatgggatagagtgaatcaatatattaaaaacaatgaagaaaagagtaaagtagcaactggatcaagcctctttagtaccaaccgggatttaaaaaggctctatttttagtcccggttgatgttaccaactggatttttactcccggtattaaagatagcgatctttagtcgtagtcccggttggaaaaccagaactataaggggattacgaaccgggagtaaaaaccccttctccaccagtgaacggggggttacgaactggaagtaaaaaccccttctctaccagtgaacggagatcgtgccggccggtggatgctggatctttcgcagtgcccgcatcgcaccaatgcaccatcgtcctcgtagaagtcgacctccgctcaactacgaacaatgtaggtttaaaatccgagaaaaatgaacgaaataaccaggaatgattttagagcggacttatactcctacttttatcggtttacaagccaatgcctgaaagcaggaagcgatgaataaagaaaaacatctggactaattcgaaattttgtttgaaaacttaaatttgggttgtagtttataagatgacaagctgcgcctaccgggttttcggtgcattgctgcagtgtggcgtacatgtatttctagcattctctgaaatgtgcaacagcggggtttcattcaacaggagtgaacggtacatttattcgtctcttcaatcccaactaattattaatggtaccattattttttctttgcagaaaaatatgaagtggttctttaatccatcctcactgccaagctgttgctggtaagtttgcagtcgattgatcttcaattgcagtttgttctgtcgtccaagcattgtttggtgggagcacgcagtttcctatttctgtaaattattgaacaagcactaataagataaccatttacttcttttactacttgaaacagaagtgtgcaatttttcctaaggaattaatatgtacattagtagcagtagggcatatatatcatgcacagtaaaatgagagaaaactcacttggttgctggttgacaatagaagcagcacccgcaaagtcacacgatccgctagcccgaccggtggtctggtaaaaattgttgaatgcataggtcgcgtgtgccaccttagtgtcaggatcaaagcactgtgcacctggttgaatggcgctgcagtccgcacagctaccacatgcatagtctagtgcattttgcagccgtgcgtccccgaccctccgatttcgcaacacaccaacttgggttcggatcacatatgcctatatttcgggaaacaattcacaaaacaaataaacaatgagatggaatcaagatatgaatgcacatttgcgaaaacctcattgatcttaaagattgagagcaaaacattacttggtgatggcttgaatacgatggaagcggcgccagagaagtcgcaagtgccgctagcctggcccttgcgttggtagtagtcattgaatgcgtacgatgcatgtgcgaccaaggtgtttggctcaaaacacacactgccctgttggatagcgctgcagtccgcgccgttaccgcacgcaaagtccaacgctgactgcaatgctgcactcccaacatctgctctcgccacacaccaactcgtctttgtaggacaagctccgccaccgccaccgccccgaaagtcaacctcatacaccttctgaccatttgggtagaacaagccaaagtttctctctatggttggtccaggcttctcgttttcattgaaaagagagaaaatgtaggcggagacgtcacgcataccggaggctccggatacaacacgtctgataagcccattgttgtacgcttgggcgttggctatcgtggccaccgagtccgtatcggctgcagctagcatggaagataggggaaatctacctccagaggggtgccctgattccgaagcttgcacactaaggattccatctcgtcgagccattgagaccgttaagctaccaccagaaaccctgtttatcgcggcgtaaacagcgtcgagctgagcatcaaagaggctgaagtacctgatgtcggtattgccatcgagcaca

SEQ ID NO: 3255 - DNA, 9463 bp, Oryza sativa
caccttgatgccggtgttcgccatcgcggccagcaccgtcgggtccgcgtcgaagatcctcaccgcggagatgccgttcgccttcagaaggctcaccgccgccggtggtcgatcaggtcctttgcgtccctcccgtagcacaccccgatctcgcccgcatctgcattgacgagcaaaaggaattttagcatcgtttggcgttgccgatcgatcagctactactagtccaaaatcgaaagcgtttctacgtttgccatggttacctgtacgggagatggagagcagcagcaatgcggtggcaaggaggagggagcagaggaggtgagtgagtaccatatgtgctctgatagtttgatcaagacgaatttgatggttgggacaggactgaggtgcaggaatttatagcaagctagaaattaaagcaacaaaagtcatgccacgacagagtagagaatgaagaacttgatacctaactgagttatgaaggaaagcacatatatgccattagcggggtagggggcataattatgtactgcttcagcttatcattgcgcttgtttatcatcattaggtgaaagccacatatacaagcataacgcatcataagcacgtccgtgcgggagtgtgtcactaacacatgctcgaagaaacccaaggtagcaacaaatgaaatccatccatttagcatagatcatttttttggaagaatctatatttcaccattgacagatcatcagttctacaacctacctttaatgacgaagtgaacgtagctgaactgatcattagcttccttgtggtggaacttgcttacctgggttcaagtcgtagatttgacacgggtgctcgcatttcactggtggagaaaccctttgtagtcccggtttgtaacccccctttagtcccggtttccaaaccgggactaccaatccgggactaaagatcgctatctttagtcccgagtgaaataaccgggactaaagatcgatctttagtcccggttggtaacaccaaccgggactaaagatggctcagccacgtggccggctgagccttaccaaccgggactgaagatcgagctgacccatttttttttacatggccctgttgctgaaccatgcatatatatgtttcaatacatatatatgcatacatatatatatatatatatatatatatatatatatatatatatatatattatattatattatatgtatatatggttcagtacatatgtacatgcataatatatatgtatttatacaaatatatgttatgcaaaggcatatgtgtgtgtgtgtatatatatatatatgaccaagatatatttacattatagaaaatgtgtacacatgcatatagaaacatatgtagtcatgtattaattacaatccattatatgtcctagctaggtacgatttcgacgtagtagtagtcgctagctcagaagctaaggaccggtgaattgtgtttccgtcatagtagaattcacccttgggatcaaggatttctttgttgatggatcccatgagttgtgcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcgcacacgtagtagccgcacaagttagttccctgcttttgctttgcgcactacaaataaatgacaaattaacggcgtgagatctaattgaatcggagaaatataaatgtagagcatgtgtactcacaggaaatttgaacctccgcctaagtctttctctccagttgccgcggaccaaatgacggaaccgataccaagccctacatggagtttaaagatatgattcgtagtagaaataattaacataacaagaatttcttaattaacagaggaacttatgacagtatatgtctataagttcgaaaaccttgtcaaacgtagactcttttttatccatttagtcatatacattgacggtgcaggccgacaggtcgaagagtaaaagcacccagtggatctgcaatgtgcgtgggatgcattacatatgaaacacttgcaagtttgtacgggaatgaaatttggtatgtaggaagacagtaaaattaaactaactctatgttgtacggcaacagtatgaacgtcttgtaatgctgcgtcttcaagagatggacgagtttgtcctctgtttcttgcggatattggtcgagcattgcgacgtttactctccgagggtcgatgaatccagtatcgaaaaccctccgccgtcgggccctttgaatctccattctacaacgataaaagggagtattttattttatatagtctacttatatacaaggacctaattaattaaaggagacgtagtaattaagaaatataactgaacgaaatacttacaaatccagcaactcataatagacacgtcgagggcgtccagctggtatagttcgtagattcccttgaaattgatccagagaatgtcatctccttgcaagaagtccgggtccctgatcctcgctccgatcatctctctaccggtggcgctcatctccatgtacagctgatggaacttgtacatttgtgtgggtagggactgcaccagctcgggcttaacaagcggtttaccgagttcgtacatgtatttcagttccgccttttctattggttcaactcctagcaattgatcgtagttagaccggtgtcagtaataaattcttctatcgtcatgtcttccccggtcaccaacggctcgatctcctggtttggttgctctccaagctgagggactggtttggactttgcagaagatgctttcttcagcgttcactcatagtccgatagcttgatggcctccttgacaggtgcagacatacccctgaagaagttcctgacactcgggtctataggaatcttcttttctagacttcgaggcttgaattgtctcttgacttctgatgccacgtaagcgtcaagctcctcttgtgtagacccccatttttataacaggaatcaatcgtataaaccgtaccatttccctggatcaagtagtctggtacacacgaactcatagctgaaatatcaagtgcacatacacgagagtctagtacgaattattacatcataagcccgcaggcacagtcttaaatcatcggaccgagcgatccagaatacattccaaaaacagaagtaggtaaggcagcggagttaaggcagcggcacgccattgccacaggcaacgaccgtaactaagacctactgagcgccatcatcctcatcactctcctggtaataggcatagggatcctccgaagcttcatctccggcctctgattaagtttgaatattgcaagggtgagtaccaaccgtactcagcaagccaccacagcaataatgcacatgacagaggaattcaaaggatggctatggttcttttgcgcaaagcaagttttgtaattcttttcacaagcctaagacctagcatagactgatcaagttttaataccagtgttcacattaaacaacgatggttctgtccaccatccattgtgatcccaaggatagcttcccgccattgagtcgtcatggttttctgaggacgtccacattcccgcctctcaggaagtggctccgtcagcataaaaaaagtcatcatgtaatatcccatcccacacaagttaaagaatttagagtctagccaagtgtaatacatgtcccggtgctcaataaccgcgagcacggctattcgaatagatttggtttactcacactgcagtggatgcacactttacccgcactccgcgactgcccaacacatgagcctcgtcccaacatatgagacgcgtcatggcaaagcttttcgataacctcgcattggcagtacccgctccatgaacttaaatcctcatgcactctaggcgttcatgtttctagcagtgagaggagttctggcgctcctgggaaagagaagtctcacacacatattaaattatggttcaagttaagttctctctctcacacactcatggcagtcctaccaatggcgacaccgatgtagggctcgcctctcggccctacctcaacggctgtcctaccgtagcgcacctgcctcactcaggggtgaaccatctatgcagggatactgcctccgctcggctatctagtccgctaggtctatacccatacgagaagtgcggttgtacgaggggtcgtttcatgcttagcttcatggctcggtccttaattgaccggggacggtactagccttttccagataccacccaaatcctccgtccgccccagtcgaaaataattgtttaattttatttctcctttcacaaatcatgtcattaacatcatggcaatgtggcgctcatgtctccacatgccgcatctcaattaccatcccaaaggtaattgcccaagcatatagcatttgataaatatgagtatgcatgattctagaatagcatttctaagcaattgtcataattgactagggactcatacgtaaacatggttacgaaggaataaggggcaaacaataatcaaggcatggcataatcacaagtaggatgttcatcattgcatgcaattttatttgtaaacaaaacaatttcgcaattgggatcaacatgttcaatggaatagtgatgacttgccttgctcaatgttcttgcaggtcttgaccttcgcttggatccgcaactccctcggtctctatagttacgtgcgaaaattgatttgaattcggttagaattcaaataaaaatccaaataaattccaaatgaaagtcgaatgcgaaagtcgatttctttatattaactttattattcgcgaactaaggcaaacccaatttcgattcaaactattttgcgagtataaatattttgttgtcataagtttttaatttaatctacccgagcattatatccatataataggttagaaatttctatcgcgagctaaatatcggacggaatcctagaaatattatatgatttaatttagcctatgactaaccgattaaatataatatacgtctaaaattcctagtgattaaatcctaacttctaccgtgaatcgattacttatagagattatccaaaactaatctataatagtctacaaaaattcatctaattgtttagtcgttaattcttttagaaattaccaagaataatctataatttatattaaattttgcaattctatgcccataattaatctataattaaattctaagtattctagattgtcttaaactattaacctccttaatttcgtcttaatcctcgaagtaagtctcccctccgtattccccagtcgctctgctcggattcgttcgttatcgttcgtttctctctttctctttttctttcttttctctctttctctctttttctctctgccggcctctcttttcctctccctctctctctcggctctctcccacccgagcggcggcggcggtggacgcgagggggaaggagagcggcgatgacggtggcggcgacggtggcgcacggtggcgcgggagcggcggcacggcggcagggaacggcagcgcggcggcacgggaacggcggcgcggtgcacgagagcggcggcgcagtggagagggaagaggggaggaagggtgagatggggtgggggaaaatggagagagggggggtatttgtagagaggggagaaggagagggggaggggcggcggcgtaatggcgacgcgacggcggcgctcggggcgggacaacggcgacgcgcgggcggcgacgcgatggcggcgcggggctcggagcggcgatgcgacgggcggcggtgcggggctcgagacgggcgacgcgacgggtggcgtggggctcgacgcggcaatggtgacggcgcgcggcgatgggacggcgacgcggcgggtggcgagcgagcggcgtgacaggcggggcgacaagacgcgcgcggcggcacggggctcggtgcgatggaacgggcgtcgcggcagcggcgcagggcgacggcgaggggacggccgcgcggcggggcgcaggcgcgaggggacgggcgcgcggcggctctaggcccgagtcctacggcgacacgacggtgacagcgcggcagcggcggcggcgcgcgcaacgggcgggcgactcggcgcacgcggcaggggagggggcggggctagggggaccacgatcgaacacctatgccgcaatgaacagtaactttccctatttatcccgattttagcccattttctatttaaatatagccctataaattctaatttttgcataaatgaagtttactccatatttgtgttatcctaactaaaaattcaccctaatttaatatcactcatattttgtttatataatttatttgaatttttaattagggttaattctcattccatcgtactaaaatttaattattgctaatatggtcgcgataatattttatttatttccaatcccacctaatctttattttaatttatattttaattatttatttagccaacttgatttttagggtttattcctagttagttattcattattcgcgattaataaattccgagatcaaaatccaatgaaataggcgaataaaatcggcatgatgcaatttattacttaaaaagtttttgaaaatccatatttttggtgttttgatttcgttggtcgaattttcagggtgttacatcttgcgtgcaatcgtaccccgggtccttgttcttggcggcgtcaactttcgccttcttcgttgcccttgcgtgggcaggcggtggagctgggggggcccttgactttgaaggtgtcggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcatgagacgccgcttgtcacccagggaggatgatgtaccgcctgcgccatagaataatggcatggcttgtgtctcgtagatgcgtctcaccatctcctccagggtaatccagctcgaggtcctcgtacgcgccttcgaccaactcaacttcgaccttcgagtatcctgctggactcggcctgcagtggtaagtacctgaagggttcgttgggatggccatgcccgacgccaccttcaagttgtgagagattatttattagtaatcacatatataagcagcaactaccggaatggctaaatctaaaatataaactacgagcttacctttattgataagttcttgaaaggaatatgcagctcacatggtgtccgctgagtgatgtcatcaacgggacaggtcgattcgtcctgtgtttgcatggcgtccatgctctgtgatcctacctgtcccgttgaggcgcagctgctacggtttcctgacgggctcaccattgcaggaggaatggtcggctggggatcatgggactgatgtgcggccatgcattcatcaaccttccctgccacctcctcttgcatgctgagctcgtagctcgatacccggaactctagatctgcaatcttcgcctcggtatctctcttgctcctcatctgactcctgtacgtgtggatgtcctccttaaaaccaatcttccaaggaatcacccatttccctcgtgttcgtcctggatgctctggagtctgcagggcgagtgtcagctcgtccctatctctgtccggtcggaacgtgccctgagaggaggcttccactgcatctgttagtcgtcgcgcagcctctcgtatctgatcgccgaagactagtgagccatcagctaggttgagcgttccaccgtaagcatagtaccagaacttcgatcgttccggccaattggcggttgccggttcgatacccctctcaagcaagctagcctccatctcctcccacttcggcatcgcgacgctatagcctcctgaccccaagtggtgatgatacttcttcttgggggcattttctttgtttctttccatcatcgcctgcccttgttcacctgtcttatatgcaacgaactcgtcccagtgatcccttagctttgggaatgtgtcgaagttcggtgtctgccccttcaggatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgacttccactagcctcctcctcctggttcccctccacatccctttccacgtgcccctggtggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcatgagacatttatgttttaacaatctaagtcatgtatgctaagtgtaactatcgtacattagaaccctacacaaccttacgtgctaagtctaattacaaatcgtgatataagctaagtctaggtgacgtatattatacaaccctagctagtcaataattatatactaagtctaattacaaataaaataatcttataataaaactcaaataatattacatgctaagacttaaatagtcatgtatgctaagtgtttcgtgcgtatatgctaagtctaattaagactacaatagtcaattgctaggagtcgcaccaattctgtagtcaataattacatactaagtctaattacaaataaagtaatcttatattaaaactcaaataatattacatgctaagactgaaagagctagtcatgtatgctaagtgtaactgtcgtatatgctaagtctaattaagactaaaattgtcaattgctaggagtcgcaccaattccgtagtcaataattatatactaagtctaattacaaataaaataatcttatattaaaactcaaataatattgcatgctaagaatgaaagagctagtcatgtatgctaag

SEQ ID NO: 3256 - DNA, 1296 bp, Oryza sativa
aatcatatatacttagcatatgaatgatattattaaattggtaaaagctctaattaagatacgtatgtacatactgtatgatttaaaattaataaaaattgtaatcatcatatatacttagcataggaattgtattaaattaaatgttaaaaactctaattaacatatgtaaatgccacaggcatgatttaaaccttttaaaaattcgaatagtcatatataagtagcatatgaaagatagtaaattaaattgtgaaaaactctaattaacatctgtaaatgccacatgaatgatttaatacttttaaaaattctctagtcaattataattagcatatgaatgatagtaaattaaatgttaaaaactctaattaacatatgaaattgccacttgcgtgatttaaaacttttaaaaattctctagtcaattataattagcatatgaatgatagtaaattaaatgttaaaacctctaattaacatatatatgaaattgccacctgcgtgatttaaaacttttaaaaattgtaagtatcacatataactagcatatacatgatttaaacttgttgaaacctctaataatcatgcgtaattaacatatgccatacatcaattgatttatatggataatcaatacatccaaaatagtttacatcgtgtacacaataattacggcattacatcagcggtgacggttgaccgcacgtactttctcctcactattgttccctccttgtgatcgctgcgtgagtaaggggtgtcttcatttgataggaggatgctagggtcaatcgtcaccatgaaagggggttgctcatccaactgatcgtaatgctcgtcagtcttgtcgtcaactccgacgatttttcttttgcctgggagaaccacttgacgcttaggctcgtcaggccctctgcccttctttcctttgctagacatgtccttcatgaaaaagacttacgttacatcattggcaaggacaaaaggttcgtccgagtatccaaccttgttaaggtcaacagttgtcatcccactgtcatcaatcattacgcctccactagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccatcgatctcatatccctggaatgtcgcgatcgacccagacggtcccct

SEQ ID NO: 3257 - DNA, 414 bp, Oryza sativa
tttttaactgaagatctcgattttagatgaattagcaacttgaaccactcaaatccgagttacgatgatttagttatgaatttatgaagtttaatcgattttcatctaataaagaaaacctagaaaaagggatttatgacgtcatcgctgacgtcatcatcgccggccatggcacagttgacacgaccaccggcaaaagagggctcggttgggctatccgaggacacctacgcgtagaggacgacgacgcgaactcaccggtgcaaagaacaacgacggacaacgacgaacgacggccggcgacgaggttcaatggcggcacggttcggcttgacggcggcgatggtgctccggtggtcttcggcggctgcgaaggggcggacggggttcctctcctccgtgcgcacccgacgg

SEQ ID NO: 3258 - DNA, 721 bp, Oryza sativa
  unsure (1)..(721): unsure at all n locations
tcctggatcgtctcgtctaatcttgtatcgtagtgctttgcaaacagggcatgcttctaggttctcatactcctcaccgcgatataggatacaatcgttcggacatgcgtgaatcttatgaacttccagtcctagcgggcagactatcttcttagcctcgtacgttgtctcgggcaatttgtttccccccggaagaatgttcttgacgagtttcaataaatcgccaaatgccttgtcactaaccccattttttgccttccattgcaagaactccagagtggtatccaactttttgtgcccctgctcgcaacctgggtacaacgaagttctgtggtcctccaacatcttgtccaatttatgggcctccttttcactttcgcagtcctccctagcgtcctgcaacatctgatcaagatcatccgcaacgtcgttaccatcagcagctattttctcctcgcccgtttgatttccttcaaatccaacatactgagcaaagtccggaatattgtcgtcttccacttcatcttcttccatttcaacaccttgctctccgtgggatgtccaacatttatagcttggcatgaaccccgactcaaacaagtggaaatgaatagtcctggatgcagaatactccttctgatttttacacttattgcatggacaacaaataaaacccctttgcctgtnnnnnnnnnnnnnnnnnnnnnnnnnnnnnnnnnnn

SEQ ID NO: 3259 - DNA, 683 bp, Oryza sativa
aaatagaaaaactataccaatacgaatacctttacgcgatcttcttcattgccttgatcaatgctgaatggcctttggcttgatgttcatcaacaaatcacatcctcatgttcttcgacattacatcttacgctgtttcttcaccaagggttgatcctcagcaacttgtgccatccatcccatggcctcgatcggttcgtcggtgttcagccaagcacttgctcctccagcactgagttgggtcctttggcgtcaagcctccgcttgcccttctcccatgcatggtccatcgcgtagccaagtattgccaactcttcaccacatctagacatcttccgtcacttctaggcttggatcatagtgtaaacctcattgtattacatctttttcttcatcatcttcatcggctcttcatcgaactaatcccttcttatacattcaataagcgcattaatcccttaattgtttgtcatcaattaaccaaaactacaaatcttatcaaatcatgtttaaagtattcataatggtaaaacaaatcataacaaaataaatgatacttacaagattaatggtcaaacttctgatgtgaaaagttagcagcaccaaatataaaaatatggagggagtacgtcatttaaattgggtccatccatatcggcacggcacctgctttgtttcaagct

SEQ ID NO: 3260 - DNA, 2805 bp, Oryza sativa
ttcctgcaccccctcaaaatattttctaaaagtgattctcattccttatttttcacttctggtgtttttcggacctgttcgaaagtgattttcggaatttccgaaaatggttgtgagccgaaattcggtactggtcattttcggacttgtctaaaagtgtttttttgggaatttccgaaaatgattgcgctcaaagttttggtactggtcattttcaaacttgtcataaagtgattttaaaatcattgttgatatttcatcgatattactagaaatataattcctagcaattgcaccgaaatattcttggtatatttatggttacatatgtgatccgcaagcgcacggatataccgttgtagcattttacccgggagtaatccaaggtatcatattaatttaatcccaaggaaagatatgataagaaagtactatgctaataattcatatattacttctatagagcaaagtctatgcaggggttaattaatgcaaagggtaggacaaggttgatacacaaaagaaagaaccaagatacttttcactaaaatataatctaggcaaagtggagaaagaataagaaaagaatcattcatataattcttgtatatagtttatttagtttacgcttactagtatacaatcatgcaaccaatacccctagctatgcccttctagtgtttctagagaccacccccgattgccgagttccttacaacaacccgtcatggccatccgaccggtaatgaatatgaccataccgggaaagtgtcttaggattatatattaacatggaggaatgctcgtactatgctgtcaccatcagcagcccacctctactgacctgcaacatataaccccaattaatggtatcgaataatctaagcaccacacttacattattagattatactcgacatctctgtagatgacatagatcaatcatttgcatgaacattaaactcgcaccaatgcatatatctagtaagctagctacacaattatatcgagacaagtacaaactaaagtcggtacttgagaaatgtgaataaagtaaaagaccgaaattatataaagtagaatatttcattatactataagtctcacaaaagaaggaagagctactagagccatacccgaaatctcctaaagactcgaggactaagaaaactattatgtattctattcctactccactcgcactagaacaataaactaaacttgagagagcttcttgatcttcttcttgatcttcttcttgaatgagcacccctttatattgcctctcaatgacggttatggcagttggaaatgctggaaacaccctccaacaatgacagtgcatctggagcgtgcacgtggaagaccaggatgaacctgggctggcccatccggcctccacttttggcaggtgcgtcttttgttgggctttattctccgtgatgtggtggttgggcctatttgatgttattttattggatatgtaagcccatccacccatgagtctacctctcgacgggcggtgattgattgttcagctatttttaaacaaaatatgtagagttctcagcaaacaaataaaattccaagtacaagtggagatagattattcttaaacaaaatatgcatgcaagcatagctagttctccttaattccggttatattgtcggccgaaattggtctataacaaccgtcaacaatcactgtgcatcgaaattttggatttgattattttcggacttgtcctaaagtgatttccggacttaatttttagaatttcagaaaataactctgcatcaaaaaaattgaaatgactctgcatcaaagtttttgatctggtcattttcagacttgtcctagagtgatttttttggatttctccgaaagtgatttttggatttttctgaaaaaatgtgtctttgctctagaaagcagttctaaaactactacagccatctcaaaatataggatcttttagtcacacactggtgttaagaaagtaagtataattaagtgggaaaagattagtagttgagaagaggagttaggtgaagaattcgaatagtggaaaattgtgattgattacgaagagaatgtaggtgaaaaaactattatattctaggataaagttttaatgttaaaatttgctatatttcccaaaaagcattgcaccttatttctttcagaatgcttttgatatttccatttgtataacatctctaaacatattagttatactagaaaaacgtcccgcgcgttgccgcgggatcgcatgagattagtgaggacactaaagcaatgggatatttatatatttatttcatggataaattattttttaggaaaaatgtgttcaatctaaatgaccatttgagggcttttaaagtaatcgacaaaatgttttttttctctttatatgatcttttttaataactaacgcctatctttttggcactaaatattcctttctctatattttttaggagttttaaagaacccaacattgacatattatttccttttatttgcatagaattgacattatacatgtgaatcatccaaataatcagcctcacacattcttgtgttcgtaatttacatgtttaatgtttttcgcccgagatgtgtttctacatcttatcacccagtttcaaacaaatagtatgtgttaaattcagacctctactctacaaaataagtttttcaagttctgtctcgatacctcgatcaccttttccttgtcaatactaatgcgatttctttacttaatttcctttcataagttcactacctaaatatataag

SEQ ID NO: 3261 - DNA, 2355 bp, Oryza sativa
aaatatatttagttttggactcgtttgttcctctcaccatcgaaaacataatagaatacacatattacaaactctatacgttatacatgcaatcatttcaaatctcaatggttatatgaccaacaatttattatattatttaaaaggaagagaagggctctttacaaaatgcaaacgccggccaacatgcattgtggtatttatatctcactgacaaatggcccaaactacaaaccaactgaattttgctttcaacataacagcttgcctcttgtatcactgatgattggtccaacctatgatggaccccttgtacaggctatggagccatgcaaaagccaaagagtttgcatctatgaagagggccaagcaaacggtaaagtaaagcatgtactactactaaccatgaacagtgcaacagtagaagtagctgtgtggatagctatggcagcttaggccgtacctctctaggaatatagatatactccctccatcccataatataagggattctagggtctgtccagattcgttgtactaggatgtgtcacatccacccaaattctcttatattatgggatggagggagtaggtagatatgtgaatgagctcaaattagttatttgttatttttgaaagcttttaaatttgcatggaatcaaactgtgaagcaaataagataaaaacaatgctttagcaatgaagcaatcgtcaaatgtagtatagataaaatatgtacctggaattaaaaacataccccacacagtgtcgggtgtattgtaaaacttacaaaatttttagaacttattctcaatgagtaaaaattctccaagcctgtgcttgtctagattaaaatacaaaaccttctttatttatttcctctcaccacggccttggcccaaatatatttcctgaaaccaaactctactagtcagtgattgtcttcgatctcttgcctggataccatgcatagaatgaactctcatctttccctttttgtctgttaagtgattattattattattattattattattattattattattattattattattattattattattattattattattattattattatcaactttcctttatttgagatttaaaacaacaaaactaggacttctgaagaaagaaatagaagataaaaagttgaacttcctaattgtgatattcttagtaaagaaagtgaaacctgttgaaacgcattttttttatataatctcagtatcaaactgaataatgtattagaatttcacatgcaaaaatcaaaactgaaatcaacagaaaaattaattgtttcatggttttaagtatttatttaaggactggactgaaacccaacgaaatggaagctttgcagaattggagcatgaaaatataaaaggaaaagaaatgctggtataacttgatcatcaaggaatgagtgatgaaccttatcgaagcaaacaacttaattagttaattccagaacttcatgatgaaaaaagtgaaactgttattttccatccatgattaaaatttgtatgatgttgggttatatcttttctgatttcactcacacatcacgcattgacaatatcgttgtattcttcactgataatttaccatataaaatctttgtacatgtacagatagagtaaattatcttttttttgcatgataattatggtgattaattgtgtacaaaataatatatttcaactcattctggtgttaaattatacataaattaatatatttataattacttttaactataggcaaggttgtaaatttttggagcatggggcatgtgacctgtgagggcatgtgcctactcttttcgtgttttagttttattcactatgctccatgctctgctgttttttctttaaagttctttctaatccatttataatttgtcacatatactggataaattgcttgcgcatctaattcttttatcttctgtttttttagatagcatagaccagagtaccatggcacttctagcacggtgtgactaagtagttccagatcttgatggtacaacttggcttctttttgcttgggacaaagatcatgccaccgtagctgcattcacactgtgttgcccccttcatcacctactagcaagtggctcttcttcaagacttcatagtgatggcgatgttcgtccctagcatattcgcctgccttgttgcgctatcggctcaaagctagccaccagagagttgtcagcgatcgctccatgagtgaggaggagattactggccctaatgttcatcgccaccgtcattttgtttgtgtcggtggtactcgtaaggttcttctactactatcttattgagttgaggg

SEQ ID NO: 3262 - DNA, 15705 bp, Oryza sativa
taactccaatggataggggaatgcgaaccaaataagcatggcaaggaaatgagcgacatgcttatgtgatgatcacgtttcattgaacttgttgaattgtggtcagcagtagttgttggaaaagacacaagatcaacatctagcgggtatgatttgatgtaccctgaacgcatggaataatgtgttttcatatactaggtcataactccttcattaaccatccattggattgcttcaaggctgaggccggttgccatggtttggtggctattttgactagcagaagtttgatatccatttccctagccagtgccatttgccaatttggtgcgaagactagctagctcatcttctttttgctgtaatgcagctgtgccctgagccaaccattccgggtgacagagtttaaggtcaacacgcctaataggaagcaaaccctgacgaatagataatcaaaacaatatgactaagccaagcttgagatggtgtgctcgattgatttgcaagggaccatctcaaaccaatggataatcaaaccatccttgcaaatctttgcataaaaccaatggatgttggcatctttgcataaaaatttaaaggtttcttcaagaccaaaacgcttgggggttctaaacattatgttcatcatcatgggtttccgagaaccatgactgtaaaatggaccaaggggcttttcgctttaccaccaaagataccaatcaaataaactccctccaacttataacatgatgaataggctaacaccacttcatataagaagggccaatagggtttgtgctagtataatgaacatataacaggttgtgctaaagcatatcgacaccccatagctatctaagatgccatcaccaatgccctaggccaaatacgtggccctcccttgatgacgacaaaactataaagccatagtgctagaaaagtcattttgtagataagtgaagattcaatatcattaggaagaggtggacctcccagacggttatgaaagtagtcacaccactcttggagcaacacctcaccccctacttgtaactcctcccataacttcagaagccatgataaacacttcggttttgggtacaacagtaaaaggggatccagttcatgatgtgtaggaataaattcctcataaatttttttgtctaatggcaaacccgcaatccgatgcatatctaagagtgttgcagtacgctcaccactctcgaacaagaaagtgttcgcgcctgggttccatctcttcaaaaaggatttcagcaaagaaatggagtagcgtcctaaagagttgaaaatagctccatagatacaatcagtaccttccccatccccttttagatttaaagagtgtttggctagaattgcagcacccactttgcataccccgaaggaattaggacatattcgatatcatagttttcccagccaaggccttctgatatcatccgattgcctagaggaaattctctcttagattgggatgtgggtgctagagggtagaaacggcggtctgaaattgttgacacctattttcatccacaagcgatattatccttctcaccttttcttaactcatattctatgactatgggattggcctcaatataagagagaataatgaccatttttacccatagggtaaaattgagagtttacacaatgtcatgttgcatcaaataaagtcggatgataaaaatgaaagctatttctattttccatcaatgagaaaaaaaatagtggatcataccaatggaatcagttgatgatccggtgggataaaatggatattttgggcatgctcacttggatgcctaaatcaatcttaccaaattttggcacattttgacattaccaaattttgatagtgtttgctttgtttgtttttatgcctttaccaaattatgatacagttttaagggaggaagcttctagaaatactaaaatttggtaaggtagcaatggttgaagtgtgtttagtttgctacttacagaaatttggtaatgctaaaattttgtaaggttgaaagtgacaactaattgaacaggccctttctttctctaacggttgactagtggcaatggcatataagggcataaaatgagttattctatggcatattatagaactgagttttgttagtggcatattatagatttcttgctttgtcgatgatatataacagattatctagtttatttcccactccataggatgctcactttgaacctttttgtgtctaatctccctttctttttgcattcttctctcgtgtttcgccccataggaagaaaggagaaatgataatttttacccaagggccttttcaagttttcacgcggaacgcttttgacattttaggtttccatttgtataacatctctagaaatattagataggttaatgagcacaatttatttatttatttatttttgcaatttttgattgcatgaaatcgaatggtgaacctaataagttggatgtataaaatacttaccagaaaaataaacaaaaggcatcccacattgtttcacggtaggcatgaaacttataaaagtttttatttcttaccaccctcaactcttgcccttcgtcgaattgcatccatcaaccacaaaatcgggtatattgcctcccccaagtgttaaaaccagtgcaaaacgactcacttggtggtttttgacaatggttttgttgacgtggcagcttagttattgaaaaaataaaaaaaatatgtgacggcccacatgtaagttgcatttctattattcttcctccaccaccgaggaatcttcctcaagccaccgccaatgtctcctcccatgacgagctcaagcaccctgacactaccgctgagtagcagccatcactgtcggcagagccgaccatagaggaggcatcacggttgatgagcccctccccccgcgctcgccgtggcaggcgaaccactaggttgccacgtgagcaaaaccactgtcaaaaactaccaagggagttattttgcactggttttaacacctgagggagacaatatacccggttttgcgattgagggatgcgatttgacgaatgacaagaattgagggaggtaaaatagacttacttcaattgaaataaaattgaaaaccttctttactctcatcatgggctcggcccatctgcttaatttggcccacaactctagcgactgaaaccagcttgctcaaatcctcctccttatctggctgccatcagggacccattagtcagtgcttgtcttcctcgacaccagtgaactctcctctgtccttttcgacgattaaggaattactatcatataatataaaacttttttcccagatttgaactttataaaacagcaaaactgaactttatataccatgtattctttgagtgccatttatctaaatttctttggagagctatacaattctcttttggactttatcctccatatagtatatctcatatgtttggaaattggcttgtggttgttagtaaaaaaataaaaaaaacttattctttttggagcttccattgtatgttgggctctttagtttagtagaaataatatggtttttgataaaacaacatcaaaatcctatttgcagatgcttttcagggcaacgtattggcttcggggatgggctcaattacaaaggcatgatgaaaatatcaagctaataaatgatgaatgttgtaaacttgagacgacaattgtgcatttatttgccaactttgggtggaggttctataatagaattcactaattaggggatctttttcttctgttggtatctattagtttgtgtttgcttagctttctttctgctatcgtgaaatttgtgtgaatttttttcatgtgagttctataataatttttttttgaaaaggaaggcaagaaatttgccttatatattgatagagaagtagagtccatagatacaagaaaatgggagttagggtcatcccagaccaagggagtaaaagggattactcacataacgagtagagctctgttaggcactttgcccccgctattacccacatgtgtgcttcctctcttatttttgccatgatggaggccggagtgtttgcaaggttcctgaagatccttgagttcctctccttccataattcccatgcaacaagtataattatcgacttgagagctttctttggcatgttttgtgctgaggtgatttgaatccaccaatcttgtactgtttcaacattggcccattctgatggttggatatgaaggagtgaccaatcacgtacagcgtcccatattcttttggagaggcggcagtgggctaagaggtggactgctgtttccggctcggcgcgacaaagcgggcatatgacttggttttgccagtttcttgcttgcaatctatctgctgtccaaactctgttttggaagattagccacgagaaaaatttgcattttagcagtgctcatgcgtcccagacgattttcttaaggagtgttgggatagaaccttcaaactgtagccaataggctgatttggtcgtgtagtggccatgttctgtgagccgccatcggatcgtatcttcggtgtccggttggagttgcagtatatgcagggctgcccaaaggttgataaattctcgaaagtgctgcgtagttgtgaagagctgtggttgcaggtctgcgatccacttgttcccggtgagagcatcttttattgtcctattttttctcctggaaatctgaaaaatcagcggcgcttggcttcggggtgattgattattgagccagttagagctccagaacttagccttagcgcgccatttccaatagttatttccgtcgccacattgaagagctttctatcagtctcatcgcagggcaccggcagtcctagccagggtctctcaggctcttgccactcaaaccaaagccatctgacacgaagggcgtgttggtatttcttaacgatattactagaaatataatttttcagcaatggcgcagaaatacttctggtatatgatggttacagagttcatccgcaagcgcacggatataccattgtagcattttacccgagagtattccaagggtatcgtatttattttatcccgtgcgaagatcttgtagagagaactcaactaatattttatatattacttgtgataatcatattctaagcagagattaagataatccaagggtagagtgacacacaagcattaactattcatccccataataaataatctaagctaggtggaaagaaaagagaaagagaatctattcctatacttctaatatacatagtatacatatattctagttaactggtatgctagctaatatcctttatccgatgtcctcctggtacttcaagaagccacccctgactgcagagttccttacgatagcccgtcatgaccatccaaccggggctaaatacggaggaataccctccccaggaaattaacttaggattatatataggcgcgaaggaatatccgtactgagctgtcaccatcagcgacccacctctcatccgcaatatataaccccaaataatgatatctcgtaatctagacaccacgtctaaactaccagatactactctaatatcatcgtcatgacatagagtaattgcataagcaaacactatacctgcaccaaagcatctcatagataagctagccgtatattcagtataaccagaacataatataaagtaggtactcatgtactcggaaagtatttcaataccataaatgtatttagaagtgtattcgaacaaaattacaaagcttacaaaagaggaaaggaaagctactaaagccatacccgaactcttccgaagacttccggactcctgattcctattctaattctattccactagctagatactactaaactaaacttgtgaggaatgagagagctcttgcttgaggtgtgtgagtgaagtgagaaggtgaggggtttatatagcctcccaatgactgttgtgacggttggaatggttggaaataccctccaaccgtcattgggagctaatccacaccgtccagaagaaaccctgcttccagcggcgatgaggggggtccggccgaaccaccaggtttggctgaacctggggctggcccaaccagcccatggtttggctggtggcctcctctgtcgttcttctctgcagacttgtgaattgtggcccagtttgtcgtgtcaattctgagttcttggcccattcatacacaagtctggttctcgacatcgtccgattgatttatcgtgggtgttgatgtcgattctccttcactttgtgatcattctctgcaaaaggttagtagacctaatactagtggaatattattactctaacatatttatgcattgcaagcatcactagttctctcctgttttactgatattgacggtcgaaactgatcgatatcgaccgtcaacaaaaccccccaagcttgaacctttgctcgtcccgagtgaaggacgaaaggaaacaaatacttggttgttgatcaggagttgctactatgctgcatatctcaaagatacaggtgcaaggtatatgtactctctctcagattaaataatctttggcacggtggcttacccttacccctgattcccacgagacactgcttctcattgccttgggctgttgaaagacagaacaacagttagagcactagtcacccaatctttattcaactcttattccggaagttttcaaatgattttgcaaagaaaaccaagttcctcaaatgattcactcagtctctccaagtgtatcattttgaattcctcaccaaatgatgccttttgatatgtggagcttggtagggatcaatcatggcatacttgcattcacatttattactaagtcaaaaacttagactaaagcagataactaaacatactcaagattaagatcgtgcataatgtgtgtgtggtatatagtggaaatggtatatgaggaaaaatgaaagaaaaatgcttctcctttgtgcttactttcttctcccaaaatccttcttttattgattaggagaggacatgattacatttttttttcaatcatgctcatgcttgatgaagcataactttttttttcataaccatgcctttccgtcctttcttcttttttttttcaaaatgattttttttctttttaggagaagaaagcacatgaaagcatggagagtttattttggtggaaatatggatatggaatggaatattgcttagctcccagtgtaggagtttagaatgtgcatatatgtgggtgtatgatcttgatcatagagtatgagaagtatctacacaagtcacaagagtttgacaaagttcaatggaatggcaagtaaccaaaatgtatatggtttaatcatgatagcacatttttggctctggtaggaatttatatcaaatgaggaactttcaatttatcattttgaaaaacaaaacatccggaattcaagtcaaactagtaccaagatcatagctactcatatttactatctcatatctcgcaacaacctagacttagatcagcaagtgcagcccatttacctcaggttcccggataattgttggctacttttattcaatcttcgagagagtatttaccaagaacccatatatcagagatataaaacagagcaactattcatcatttcaacagagagaactagcttgtcttaccaagcatgactcaaacctatcctatcttttttggtattttctattttgcaaatttttatgttgttttcaagttttataggatgcaattggaaggcaattatgcaattggaaagggaaatatgcaatgtgatacaagttacctcagtggggggagcgaagtctccccccaagtttggctttcgctcatggtccttggtaaggattaaacccctgaaagcgaaagtacgcctgaaggtcatcatgctgttgctgcatcatgttgttgatgttggcgaactgagcatcagcagattgttgtcattcttgcgtttgagctatgtgttccgcgaggtcatactggatctcccccgtctgcgcatcaagggtgtccattctcctagtgatttcacccaagtcccaacgggaggaacttgagcgccattcacttggagatggaggcacaccacttgatctggaaggttgattgtcccccagtggatgtcatgaggcgcatgccaccggtcctcactggcgcttgcccaggttgagactccgatactatggcgtggagcttgggtccatccaggtgcatccccagatagtgcccaacctgcctcatatatctgcacgggtgtcgaggatgatgaacttccttgtttgttccttgtcatgttgtgcgtctccctgtatgttccacctgcacaagattcttctatggtctgcaggggaatggttagttcatggcagttgtacaaatgataccctgcatttggcaacgggatttcatttgtacaactggggaaaaagtatatcaaagatccatctgcttcatgtttcaaatatgcccttgtactagataagcctcatcaatacgcggacgagcggctgagataaaagcaatctggtcgctaatgacccctagccctttcgctatccgagtaatcagagaagtgcactcaataggagcagagaactttatactttctaaccattgccttatcatacatttcacaggagaaattttgatctttctaaccatggcaaacatgataattaattcatctcccctaatgagtctcagatcacttctaggaaacaaagtcatagcaatctatttgtgcatgagcctaagtgtaggattatggatatcattcgttctaggtttcttgcaaattggagcaccagaaatatcttcccaaaacctatttttcttgaacccagaaattcctttctggagatcaattttacaggaatcgtgaaaaccaagaagtgtactcaagcctttccatgtgagcgtgaactccttatggaaaaaacgaaaagaaataccatcttctatttctttcaaagtgcacagaaattgcaaagtaagcaaacgagaaccaggctcatctaccacagcaaatctctgccaaccaacagctttccaaatagaacaaaattcaacatccatacctatcattttcagcaactccggtgagtattctcgcgtgtgagcatactcctagtcgctcagcatgtagtaggcttgtctctcccgatcactgacaaggtcgaggtcagcgtcgctcaggagttgtcacggagtgtcggcgtcttccatcgagacatcggttgatgaacgaatactagactcgtcatgacaacttgatggagagctcgaccccttgaacagacgagacagtcgccttctcatactgcacaatggaccaagaacaggctaactaggcgggggttagaaatgacaagagtttcacccgccgattagtttcaccaaaacaacttatatgtatgcaactaaagatttgaatttgaggaaaactatcaaagcttaaatgaacttgagagcaaactttagagacggaatgaaaaatgtgttgaaatggggtggaattccctttctcggctggctggcttttataggatacccacaacggtcaagaatgacatgtggggcccactagccgttgcctcaaaagaggaggcagccgaccgttggcctggccggttcggtcgaaccaaggtgttcggccgaactcctggtgagcccaactggccccactttcggctgttggattccaacggtcagtgtggtcgtggcacagtaaatttttgttgaaaattttattttggcttgctctgaaaaattcatttgaagaatttcctcaaaattcaaaaaattcctaaatgcaaatttgaaattcaaatatgtgttgatgcaaaaattcaaattgttgaaagcaaatatgcggataaataccaatttacatgttggcgaaggtcacgtcatttaaagtccgacgtgcaagaccgtacctccttccgtttcagttcgcggattttccacccgtctccggaggtgatggagcgggcatctttggcttttccttccacaccttctttgatttcgatgcggtagacagcttcctctaagccggctgctctaacttcttggccagtacaggtgattttaccggcgtcttccaataacggttcttgggcattgttgtttccttctccagaaagttctgcatgaactttaccaggctatccgttttgggtggctccatttcgaccacttgaatattctgcgggttcggcccgtacttgattctgaccatggagcattgttccgtcctcggttggaactcaaacttttcctccttcccattgatatggaaacggatgctccccattcccacgtcaatgttggctcctgcggtgctaaggaacggacgctctaggatgagcggcgtatctttccccgtgtccatatctagcaccacaatatcaaccgggatgaagaaatcccgtatcttgactggcacctcctccgctatccccgtcgggtaacggactgacgagtcagccagttggaggcgcattggtgttggtgccaacaccgtgaagttgagcttgtcgaagacgtcttttggcatgacgctgacgctggctccaaggtcgcacaaggcctggtgaattgttgtgccccgattgaccaggtgatcgtgggacaccccggatctttcttcttctccgggagcttgtggagtatcaggttgctgcaatgttccgtcagcttgaccacctccattgttgggagcggtttcttgtttttgagtatgtccttaagataacaggagtatgttggtacttgcatagcgtccaacaacggcacgttcatgtgaattttctggatcacttcaacaaagcgagcgaactgctcgtccactgacggtttcctactccgctgagggaatggcaacaaccgtgtgtcgcagtaccccccgtggcacggtcttctctggctaagtctccttgtcagccgaatcagtagatggcgtttccttgggcatcccattagttcctgtagggttaggatacggcggatcacgagtggaattacctcccctcgtcgtgatcgccttaaaattttcaatggaggagtcgggttgccccggaatcctcccagattcatttgcagggactaaagatgccaacggagctaactgggtttctatcattttattaaagctcagctggttttgaaatgcggaagcgaagccatctagcttgacatgacatttatgttctctaagatcttatcattggcagcaagcttttttgcttagcgcatcagtggttttagcttgcgcaaaaacaagatccttcaaggagggttggttagagaaattaccgttattattacctcattgataatatgggcgtggttggttccacccctgacctccttgtggacgatacccgttgttgttgttgcccatgtacattgcctcctcacgggtttccgggcggtcgttcccagaatgacccgtgccgccgcagacttcacacgtgatgtgtgagtccaaggccttgacggtgccttgtggccgtttctcatggtcgtccaagcgtttcatgaggaggtccagcttggcagcaagtaactccgtctccttgacggtgtgcatgcctcgctgacgggtctggagtcattcctcgcttcaacccatattggagaccatcttctctatgagttcaatggctccttgaactgttatagagaagaaggctcctccagctgccgcgtctaggtgatcgcgggacatcggggtgagcccgttgtaaaagttctgcaggatcagccagtcgtccatcccatgatgaggacaggaggccacgtactcctacagtcgttcccatgcttccggaatggactcgtcccttgtctgctggaaactggaaattcgtccacgaagggcattggttttgcccatcaggaagaacttcgagaggaatgccgtagagcatttaacccaggtgttgatagcagcacggttggcatagaaccactgcttcgctctcccgaggagagagaacgttaacagcagcagcctgacggcgtcgggactgatgcccttgatggtgtacgtactgcatatcttcaggaattgctgcagatgagcgttggcatcctcattaggcttgccacagaacgggctagcctgcgccatcatgatgaggctagacttcaaatcgaaatccacatctcctatgttaacttgcggcccgacggccacattatcaacagagggagcagcgaactcgcgaaaagtcttgctgactataatcttgaaggttggtggcgctggtacggctggtttctctgtcggtaaagttttctgcggagcagcgacccgcggcctgacgctccggaagaaagcttctagattttctttgaagttttccggcaggttgaaaccagtcatgcactaccttgttttcacaataaaaactgaaaataaccaaggttagcctgcaaaggaaaatgattatacagaggtaaatataatgcgttagtttaagtaatctctatcataaatcttcccaggcaacggcgccagaaatgcttgttggtatttcttaacgacattagtagaaatataattcccagcaatggcgcagaaatacttctggtatattatggttacagagttcatccgcaagcgcacggatataccattgtagcatttcactcgagagtattccaagggtatcgtatttattttatcccgtgggaagatcttgtagagagaactcaactaataatttatatattacttgtgataatcatattctaagcaggagttaagataatccaaggatagagtgacacacaagcattaactattcatcctcataataaataatctaagctaggtggaaagaaaaaagaaagagaatctattcctatacttctaatatacatagtatacatacattctagttaactggtatactagctaataccctctatccgataccctcctggtacatcgagaagccacccttaactgccgagttccttacgataacccatcatgaccatccaaccggggctaaatacggaggaataccctccccaggaaattaacttaggattatatataggcgccgagaaatacccgtaccgagctgtcaccatcaacggcccacctctcatccgcaatatataaccccaaataatgatatcccataatctagacaccacgtctaaactaccagatactactctaatatcatcgtcatgacatagactaattgcataagcaaacactatacccgcaccaaagcatctcccaaataagctagccgtatattcagtataaccagaacataatgtaaagtaggtactcatatactcggaaagtatttcaataccataaatgtatttagaagcgtattcgaataaaattacaaagcttacaaaagaggaaaggaaagctactaaagccatacccgaactcttccgaagacttccggactcctgattcctattctaattctattccaccagctagatactactaaactaaacttgagaggaatgagagagctcttacttgaggtgtgtgagtgaagtgagaaggtgaggggtttatatagcctcccaatgactgttgtgacggttagaatggtcggaaataccctccaaccgtcattgggagctaatccacaccgtccagaagaaaccctgcttccagcagcgatgaggggggttcggccgaacctggtggttcggctgaacctggggctggcccaaccagcccatggtttggctggtggcctcctctgtcgttcttctctgcagacttgtgaattttggcccagtttgtcgtgtcaattctgagttcttggcccattcatacacaagtctggttctcgacatcgtccgattgatttatcgtgggtgttgatgtcgattctccttcactttatgattattctctgcaaaaggttagtagacctaatactagtggaatattattactctaacatatttatgcattgcaagcatcattagttctctcctgttttagtgatattgatggtcgaaactgatcgatatcgaccgtcaacagggcgcgcgcgaagcgatgcaggtcgagcacgcctagtcctcccagttctttcgggcagcagacccgatcccaattcactttacatttacctccggacaagttgtcgccaccggcccgaaggaatttcctcctgattttgtcgagcgcttccaaagttcctttaggaagtctaattgaggtgaggtggtagatgggttgtgaggttaggactgtcttaacaagggtggatctgccagcttggtttaggagcttcccttgccagtgaggaagccttgcccccgccttgtccacaaagggctggaagtggactttacgtagcttggagagcgccaatggaaggcctaaatatgtcattgggaaggcagctttctttgccagaagatgtagaaggatgtcgtcaaggtcaatgtcgttgcaacgtatgggggcaacttgacttttgtggaagtttatttttaggcccgtggcctcaccaaaggactcaagaatgtgtgccagcgctgagacgtcttgttgtgtcggggagaggaagatggcagcgtcgtccgcgtacaacgaggttctcattctcggcggtcgtccattgaggcgtaacgaggttctcattcttggcggtcgtccattgaggcgtgtgaggtgcccatcctcagtcgctctctccaggatgtgtagcgggtcgattgctaatatgaacaagaacggcgttctgtaataattggctatttgagtaaagaccgggctgtttcattacactattaaaaaaaaagaaacagtagatcgaaagtggaagttcctagctagtaagtcttcttagtttttttttaaaaaaactgaaacctatcgaaacggagttcttttccaaaatttcatcatcaaactgaaagatgttctacaatttcacatgcagatatcaaacggaaattttttccataatttcgatgttctatataatttcacacgcaaataccaaaacagagactttatagctcgagtgctgactgctgagccttcatgatgaaaagttaatttccagaacttagattgctgagccatatcgaaccagaaacttaatttccagaacttcatgatgaaaagtttaaaactgttcttttccaagctataatcaagattttcgtaaatataggttatcttttctaagttcacatgtcacacgcgtttgacagtgtcgtgttattcttcaccaaaatctaccatacaaaatctctgtacatgtaaaagtaaaacatagtatgatgtgcagagcataaataatatcacatcactctttttcaacttttttttaaaaaaaatccagatcaattaattcatctaagatagaagtcaaacacatacggagtataatctaggaccatattgcatatacttaactaacaatttgtacatgttacatctactaatctccattccatgtttgacttccaatcgaacagctaagcttattatgccatattatttcatttagccccttggaattcctccattttacaaatacatccctcaccaatctcatttctatacatatcatcatcgtttcctccaaactcagaagccca

SEQ ID NO: 3263 - DNA, 6618 bp, Oryza sativa
ccggagcctgagcacgagcgtggcgcagcaggtcgacggcgagaacccaaacatcgggctccacgccggcgacgtgatcctgtgcgcgctgcccatgttccacatctactcgctcaacaccatcatgatgtgcggcctccgcgtcggcgccgccatcgtcgtcatgcgccgcttcgacctcgccgccatgatggacctcgtcgagcgccaccgcgtcaccatcgcgccgctcgtgccgcccatcgtcgtggccgtggccaagagcgaggcggcggcggcgcgagacctctcgtcggtgcggatggtgctctccggcgcggcgcccatgggcaaggacatcgaggacgcgttcatggccaagctccccggcgccgtgctcggacaggtacaatacaagaaaaatattttcctttttttggttgaattggttgtcattttttgtgcgccgttggatcatccgatgggcggctcggattccatgttgactttggcgtctgacggtcaacgtgtaatctgagccctccatttggctggtgtacagatccaatggcgggaaatcttaacgtgtgaaggactcaagaagcccttcttttcacgtttttatttaggttttgatacaatatatacgcaataggtgttgttttttaaaaaaaataaacaaaatggacattacattattggctgtgtttagatccaaaatttagatccaaacttcaatccttttccatcacatcaacctgtcatacacacacaacttttcagtcacatcatctccaatttcaaccaaaatccaaactttggatccaactaaacacaaccattgttattattattattataaacttataaaaaggacatgaaaacaattaatgaaactaaggacagatttcatttcactgacatgcttagaaagtatagttgccaatatatgttatctttttaatgcgtgtgtgtgtgtgtgtaaagtggagctccactcccacacacaaacatgatggcatgactatttaataagctaagttggctcaagtcaacatctgaggccaataatatctttctagctagtttttcttttaaaaaaaatcctagctaactgatatgatataaaattagcttgccatttactcaaaagaaaagaagtattcttattccccaatgcaataacatggtagtattattttaaatcccacatacatagcactaaattcacctttggtttgttctatatgacatagatatcaaattagtcctacaaaaatgttatattctaagcatgtccagctaattaagcaaatgtggtgatgatctttgctgcccactatgtggcattcaggggtatggaatgactgaggcagggccagtgctgtcaatgtgcctagcattcgccaaggagcccttcaaggtgaagtccggtgcgtgcgggacggtggtgcgcaacgccgagctgaagatcatcgaccccgacaccgggaagtcgcttggccggaacctgcccggcgagatctgcatcagggggcaacagatcatgaaaggtacagaagatccctgaacatcttggcatgttcaactgttgacttctcagttatgttttgcccctgcaatagagaatgtactacactaccactggcccagatctctagatcaaatctgacttggaaaacatatgataatcaccagtggataaccagctacacaaaaaattatactacaagccattgatctggatttctttttgactattattaaacctgaattatgacaagtagttgtctggagatgatgtgcaataaaacaaggtcaaaaatatggatggccctctctttctaatggaagtaaaagaaagtgttgctttggagaaatgataatacatgttgtagtgttgcttttttatagggtcattgtgcaagaagtccacagtaggtaggatattgtaatcctaattgagtagatgctccagctagcgaattatgttgatgcaactttgatgtcaagatctcaactagcgtgcactggcatgtcacatatccgatgccgttggttcaaatcattcctagcaattccatcgcgctattaatgttcgcctcccatctttcgccctataactttataagccatagctgaaattaaaattttgaaaattaattttggagttaattttgttttttatgtagtttctttcctagtattggtttttcaattgctaatggcataaatataaaagtttcactcataaattaaaacgggttatcagctctaggccaaacggtagcgctgttgccaaacgatatcaatggaattatgcgagttcttaaggccgtattcacaattataggtcttttttttttaggacacaattataggtctaacagagtaaggatgttgctgttcgtcattgtattagagcggaaggtctgaaaggctgaaacaatcaaacaattgttgtttaatttccacactactaatatatggcgtccaagacctgggtaaagtttagaaaatgagagatgtcaaatttgtcactttcagttgcatcactgcaaatgtactattaaatatatatcagtagctaatagtaatttttcaagttgcagtttaaatgcaaatattcccagcccaagtgactcgcattcaaaaaagaaacagtgacagtgacaacgaaaggtccttggaataatatcagaactgaaattttatagcctcatcgtctcgcttatactcataagggacatggctcatagtgatttaaaactagtttgtgggtatatgtgttcttagtgactaaaaacaaatgctaaaaaataaattacgatgaaaaaaccataaaattaaattttaaattttaaatttttcgcttatgcttatgagtgatcacctgtatctaaccacctattcgttgtactaatttccatgaaaattaacatgctaaaaaaaccgttatttttcaggttacctgaacaacccagaggccacgaagaacaccattgatgcagaagggtggctgcacaccggcgacatcggctacgtcgacgacgacgacgagatcttcatcgtggataggctcaaggagatcatcaaatacaggggcttccaggtagcccctgcagagctggaggcccttctcatcacccatccaagcattgctgatgctgctgttgttgggtatgtctttaactagctcctgttctgaaaatgtagtaaggtttaatttgcttgatagataatgttgcagagttttgacatggatttgaatgaatcagttcttgaaatggcgttttcatgatatgattggccacttgcaggaaacaaattgagcctgaaatcggagaaataccagtcgccttcgtggcgaaaaccgaagggagtgagctgagtgaagatgatgtcaaacaattcgtagcaaaggaggtaaattcctttaccatggttattcataggacaaaaagagaacactttaccatggctgagtattgtttttttttttacttttccttcattaaattattcatttatatgtggttttaggtgatctactacaagaagatccgggaggtcttcttcgttgacaaaatccccaaggcgccgtcagggaagatcctgagaaaggaactgaggaagcagctgcaacatcttcaacaagaagcttaatttacaaccggcctcagacatgaaaagaatttagcatgaacaagcaagttccatgattctaatgttgcaaattacacattctgttctgaatagtttgtgtcttccatttatatgtgatgggggaaaaaaacccaggtacaaatggattctgtgcaatacaaagggtggtgttaccgtgttaggtcggctaggtttgctcatttgcagagagacaggacactggggaagccatgtacaaaaatgttcagacctgtttattgttcttgctggtgtctttgtaatattttgtttaaacatttatatcattcattattattgttactactactgttagagaaggggcgagaattctatctatatagaaagtcttttttttatctggtcctaatttatatcacaaagttcataccttctccagggaatgacacactctgtattttatttctattagttatttttgttccatttcgactacatcctgaagaaataaaaactttatgatgttaatagatttacataatataaaaactccaataatacaacaaggcgcccatggcctaatggataaggcgtctgacttctaatcaggcgattgtgggttcgagtcccactgggcgtgtcttactttttaggctgtgttcggctccatccattcccagcgcgcacagtgtacacggaaaacggagcgattaattaagtattagctaaattttttttcaaaaatggattaatttgatttttttaagcaacttttgtatagaaactttttgtaaaaaattgcaccatgtagtagtttgaaaagcgtgcacggaggaaaagtactttagtttacctttttagtaactcaaattcttaccagtttttttagtacctcgaaatctttattacctttttagtaactcaaattcttacctcgaattctcctttgtagtaactcaaattcttacctcgaaatctttgaatgacaggtttgtttgtttttaacattctttttttagtaacgcaaattctttttaccgaatgacacaggtttatttttagtgttgtaagtatctctgcatcttaaatcatatttcatccataacatacacaatacgtgtaaaaaaaactaacgtaccgtggccgcaactgcaaacaaagcaacactgaatgattggatcaaacacagcgtccttgtttgattgtttccccgctaaaaccattattgtccttgcagaagagcagttctcattttgtttttgttttggacaaaccaaattgctttaatgctaaaacactaaattacatcaaaatcatcggtgctggatccttctgccaaattaagccttaggaaccaccaggctcaatcaaaacgatgacagcatattggcgtgtatcgaaaacttcacaaaaatacccagttttacagatggccacaaactcgtgtgaacataaccagatagcatgtctcacaccccaccttttatatggttccaattatgtcaatagtaatgacatatttcaaaaccgtgaaagttataatatcatggatacaattaacccttttattttacgggtactgtctgacacctcattattctgctcattaaatattattggcaaactcaattcaacgcgaaaattataatggcatggacacaaacccttttattttatgggactgtctgatacctcattattctgctcactattgttagtggcgaactcaattcaacttttgaagtctacgatgcactttggcgagctggcgagtgcagctatcttgagttgtgcatggaccacacataaggtatatcacattacccaggggccgagcgtagatgttatcctcctcacgaagttgtcggattaaggaactcgcataaagtgatgcgtacctgcaggaataacagaaccaaacatgttaagtggaatacaacaatagtaccaagaactggagcgagaaagggtaaaggtattacataacagcgtagattatattgaaaagataatatgtgcagggcaaaggagagatttgtgtacccacgctgagggttaaccagctaaattaagaatctaaacagttatgagaggggcaaaggtatttgaatattttatttgctaagcaaatctgcaaatatagaggtacttccttcttataaaaaaaacttccagttttgcattggatgctagatattttcactgcttccaaatacgtcaattacctttttttttgtttaaatgaacagtcatatgccccatataaaggtcgcatcaactcctaactatttggcaactagatcttaaaactatgatattactagttttttggacaagcatagaatatcaacaggaaactaaattatctagaagctaagcacaacacagaatgctaaactgcccattgggtgctcttaaccgagcagttatataaaaaaaatatagaataatatcagcgaaggacaccagctataaatgactcaagattgtcatacccagcatctgatccctcagcctttagctcgattgcacacagagttcctaaggacaccactcttttcacatttggcagggacgataaatggttcactagtgcactatcccatagctgcaaataccagagtgaacttttaagtgtcaatatacttaaataaattgactgtatatagcattagcaaaaaagaggtgttcctggaaattgtattactccctctgtcaaacctggcagagtcttcaaaaataatctttgaatttaaatttctcatatctacaatgtttgtaacaacatcataaccatgtgaaagtaaatttaaatgtcaactaatgatattatttttatcaactaaactttaatttatattagactaatcgttggtcaaatatttgaagagttgaatttcaaaaaggcatgtgccttattcagtgggacagagggagtactgtatatttctatatgaaagatagattgaaatacaaacatcataagctgcagga

SEQ ID NO: 3264 - DNA, 17653 bp, Oryza sativa
tagcttttactgctgcgggacagcccatgggatgcgcggtataggaatggccatgcaagagtgctgttagctgggtcagataaaagataagtcaatgttaacctaaaagagtagactccttgtgatactctctgatataacatcataaaaatcgttaatgaactgtttgtgcatgccaaaaatacattcatgataattagatgaataccttagagtcacttctgaaggcttcaaaaataggctctgtagctaaagttgcagccaatggtacaatgccaccagtcatcaatttagcataacaagagatatcaggaaaacagccaagcaactctgaagcagactggaagagaggaaagtagtcaagagtttgaatacactagttacccccaccatccatttctataagatgtcgtttgacttggcacaagtccattgaagtgtagtttcaccacaaatttatcttgcagttactactaagaaaaccaaaacatggaagtgcattgaaatgataatgtgatggtgacacttttatgtcactaaacatctaaacctgtacaaagctggcctaattcgtcaaagcttactaagtttgaatcacagaatacttgtgagccatataaacttggatggatggagtaacttttaaggtataatcatccaaaagaacatattttatacattacctccacaccgagacgccaaaatcctgtaaatacctcatcaaatatgacaggaatttttcgatttttacactctttgacaagtaatctctggaaaaggggatctatcaaatgcattccccctgcaccttgtattactgcatgaataagagttaatgatgttaaaatcctatattagagtttacacaaattaaaagaggcaaccaaattagactattgaagtacatcccaccctaacacacaaatacttagtccgatttaaaatagtgaatgtgaatgcaattgcacaagcaaagttatctgtgggcacacatttgccagaaaatatcagcatcagattttgtatagtccaaacataacaagtactaaagtaccagaatagacaatatagagagattaaattcagcatgagtgacatcatatattggaaaagaggtactcaaaacagggaatatttatagtaacctggctctataattaatgctgcaatatgctctgaattatttgacatagcatactgtgatagttgttgtgatatgtatgaaacatatacattagcagcagacgatgtgtccctggtcttgcaaaaaacttcagttaatgaggaaaaacctgcagtcccaacaaaagaataatcagataagaacctatataaaatataacttcatgtaaaatttgtgttactgacatgtatcacaagaactcagttgatcatgcattatcgatgggggaagagaaaggttggcgcttttgtttttaatgtacactgtaggaggatctagaaaaagtcctcgccccgagtacctacagaacaaaactcaagtgaatgatctcagctttattgatttcagaagtgaaaattcaatgataatgcttccagtacaggaaaaaaatatgcaccatgctttaacgacaagataagaaatctctactaggccatataaacagataaacaaagttgctatagcaaatcacttaagaaggctacagatacatcaatgcacatgaaattcatggttaccatggctgctgaagaaaagatgtgtaagctgatggagcttgtgcttccatagcacccaaagtatccccgtggtaggaaccatttaaagcaaggacctagagaggattcaattaaaaatgcatatatcaaaagaagaaacatggagcaagaattccacattgcattatttcttcatcatattagtattaactacaaaatggtgagatgaactgtaaatacaggttttcctttaaaaatgcaaggtcagcatatgtagttcactgagaacacgtgaatagcatggcggtaagccacctagttatggggctgctaaccagggttcgattcctgggtcccaccaaaaaagatcctcgctgagatagctgctttcagagtcatacacgaaaagcaccttggtagtcagtgttcggggctttctcgatctgagctcaaagccttgtggggcacctctccccaagagtcagtttaatataggcagttcactgtgatcaaatgagcatggtggtggataagaaaagaaaagaccagaatagtgcacagaaatcagcttacttgttgagctggaggtgtaactacttcatgatactttgagttttactccatatttcagtcttttggagttctggttctactaacttgattttcctgatacaaaatatctgccagtgtggatgggtagatgaccacaacattcaccacgttttatgagagctatatctaagcatgccaatgaccacagcacagatgaaaaatctgctagacgtggcaagtgatgaggtattgtgaaatcaggaaatgtaaaggagcagctcagatacaacagtttctaatgccttgcaagaactcgccaggaggataagcaggaagaagaggccactaaatcagagttaaagcatctagaggggtgaaaactgctggccctacagctgtccaggaacatagctatgtcgctggaaaactccgctctctggtgggcctagacgttggccctgatagctataatggtgaaaccatcaactactgcagtatgcattaaccatgtccatccatgatcttccatggacacttaaatagacttgtatcagatcacacagagggatgaaaggacatcagcattacagattgtcgagatcagcaaggatggcataagaattggaggggaatggggaagagggagcgcactgagccagggaggaagaaaatagaatgcatgtaggggtccaacaggtataggtaaataaggaaaattgatgcctgtactattctacagtggcgatctgccacgtggaaatttgggcactgttacaaaaagggttcattcctaaacaatttactcgattttaaatgcatttcctgaatcaatcaaaaggtaaatttagcatgcattacacacttaagactgatgctgcgctccagtcaatgcacacattcatcatgtcaaataaaaataaaaataaaaacaattccacaccattgatcattgcatagaaaatataatgaattaaacatcaaatccacacaaacatgtgcaaaaaatctactttgttcatttgtcactaagaaaatatgcaaaataactagtggtttagaaaatgtattgccaaattcgagtagctggatgattattgaagttactatgcagatattgcccagcattcaactaaaagcataagaaacaacagtgcatcaagccatcaatgcatatagagatcatgtcgattcaacatctatggactatagggaaaaaaaaaatttcttgcagtgaactttaatatagttgaaaaaacaaagtagattgacaaggatattcgatataaccagaacagaccttaaaatgaacacttccttcacttctgatatctttttcgctgtccactataatcccatggtcacatgcatatttacgaaatgccatcttcaaagcaatttcaattgcagtagatccattgtctgaaaaataaactcgagaagcccaatctaacatacaagagaaggtgtctaatgaatgaagtgtttctcaacaacgtgacttgtatagtaacataaaagtaacattaaacaacagctgtacttagaatttgtcagtgataataattatgcaaaatcatagtgaagttacagcacatacctttaccaacaccaccaagcaaaagttctgcacaacgaagagcaggttcatgaacattctctggaaacatcacatgaccataccttgcagcagcataacccatatctcttgcaagttcaatctaatgagcaaagagaaatttaggctacaaaaattgcctgtcaaaagttcaacatacagagctttagaaataaaacactactaacaatagttcccttagcaaacgagaagacaagaaatttcacggatgatggaagatgtgtagacaataacctgtaagttagaatcaggtccttgtgtccaccaactagcacatgcatcaaactggggaacaatcgttttgtctttaacctgcaccaaaagaatgagcaacaatgtaactaaaattctattagattttcatcataattttcctttttacaaaatagtcctagatgcttggcaaaccttgtatgctgagaaattctcaccaaaacgcgaatcaataactgtaacagaatctacaggtacaagatcatgctgagtgaaaggccaccacaacaaatactttgattttctctgcatactgtttagcctttgaactcttcgtgaatgaaaagattgcagactatctttaagtgaactaaaagctgaggatgactcagaaaaccaatcagttaggtcgtctttgggatcctcaggaattggtggcaggacatgcacaggtaccctaaataacagaaatagcacaaatcagtcatacattgaaatacagaaacaatacaagcaagttgcagtaggtttatcatatatccaaatgaaagactgaaataattattattaacaggataatataattaaaataaaagagatgcttctatgctcctgcacactttcagagtgatttgacaaagaacagaaaggcattaatcacctctttctcaagtatgagagcaggaatctgtcattcgacaagccacgatcttccaaaataactgagcccacatcatatcctctgagcaacagagtttcgtaggcagataaagtagatgaaataccacctagacgaccatctccaacaagaactgcaggtaacctagaggacctgttaagagttgtatgtgatcaattacaccagaaagtaaagcaaaccagcatgtagagataccaaagtttaactttgacatattacaaggttctccataaatcattctaagaaattcaaggtatctacggtactttaatgcatgataagaaatattaggtggcattgccagttcaccacaggtgataacttctgaacgaataaaacatatattaaaagaagtgacaaatggatatgccactgtgtacagtagtgtaaattgaacatagaaattgatgtaggacatgaatatttactcagctcatgaatatcaactactcaaatgaaaaatcctaacatgtacagaacataaaacctcacaaaatattaaaacaacaagattgctcgccacaatttagcatagctaatatgttcattcacaacgtgcacattactctcttacatctgtaagaggcagatgaaatttgctagcgttgagctctcctaagtagaggaactatacagcgcaagcatcacatcaattagctcgaccaagcaaatgtcattgaatgaataatatgcacgaaacaaaacatgctaaagtaatcaaatgtacccaatttaatttctacttgaacgaacgcatacacattcaagtacttgaattcactacgactagccaaaaatgaagaatgacataaatcagaagctgaaccgcgcgcaccgatagagatcacattggagcgtgccagaagggccagggctggcgacgccgccggccgtctcgagcaccttccacacctccccacccccgtcctcctccgccagccaccggtccacgagccacctgacctcctcgtcctccaccggcatcccctccctctccgccgccaggtgcggcgacacgggctcccgccacgcgtacaccgtcctgcacacgagcgccttctcctccaccccctcctcaccgccgtagttcaccaccgtgtcctggcgctcggggaggggatccacggcgggggaagggaagagggtgtggttggacgcgacgaggcgggtggaggcgccgccgccggcgaggcggaggcggcggaggagcgcgggggcccggtcgaagacgaagcgcgcgtcggagtcatcggggaagccggtctggagcggcttgaggtaggcgacggtggaaggggaaggggagggggaggcgagaagggaggcgacgaggcccgcggaaacgagcgtcttgccgacgcccgtgttggcgccgaaaacggcgaaggccggcgaggtgagggcacggcggcggcggcggcggaggaggaggaggaggtggagtggcggcgagcgtggcggaggaggcggagcatggcggcgggggttgggtttttggacggggttaattgccggggtaatcggtttttggacggggttttggcacagtccgactggtgttgggtccgtggctccgtgccagcacgacctgatctttgagtcgtgcctgggccgctgcctcgacagtcgacacgatgtgctggtctggccggtccggtcggagttaaatagatgagagaactaaaatagacttattctagaagatattagataagcaaaatagatttttttcaagaaggagcacagtgggttttcgtgccttccggctgacccgagtcttactagaccatgcctagaccaatggtgcagcaagtggactggcacggcctggcacgtgtaggttgtgtcgtgtcggcccatctgatctcgccctgggcctggccatgtccgggccggacatttggctatccatactgttatctatacatttatcgataaatatatattaatataataataaagtaatttacatgtataactacagtgtggtaactaatatgtaacttttatctaattttaaaaccattagatttgctttaatgtttgtgcaagtggagaagaaaaaatcacaacatgcgcaagtgaggggatttagtctagtgacctccgctttgtaaaaatagcatgttatcgcaatattttcaaaagttacatgcaagttgtagttacatacatgtaagttataatgcaattatactacaattacattatatttacatctgacaatttttttaaagaaatttatcgacaaattatagcaaaactgattctagtttactccggacaacgtgggtaataaatcttgaacattgtatcatatttattaaaggaaaaagtacaaattaccccctgaactatcgcggtcatccgaattaccccataaaccagaaaaccaatcatcattcaccctaaacttttaataccggatgatttacccccccccctccacactgtttcgagcggttttgacttgagtttgcatatgtggcgccaacgtggcaatctagttagtaaataaaaataaaaatagcttccttgggcccacctgtcaccctctctctcccgtgtacgcactcaggcaggcggctccgcaaacggaggcagaccaatcagtcgacggtagaggcggagctcgcctgggcggcgggtggctgaggcaaagctcgcccgggtggccggtggctgaggcggacgcagaactagcggctaaggctgaggcagacctggcggccgacgatggaggcggaggccgaccaggcgacggtggttgcctcctggggaccagaccacgggggccgcgtcggcgccgtagcgcacgtggagagggagcgggcaaggccgcccgagatggcgccggtgaggcggcagagcatcttgcgcggggacgtggaggttgcggcaaagcatctctctcactcttcttctctcgcgcgcgcggtcgaacggtggtaggtgttcagcgcgcacggcgagcggtgggcggcgccccgggacatagaggcggtggtggcggcgcgagacgacgaggcggtaacggcgaactccgggaggatttggtcaccaggaacggaggatggacggcgacggagaagagggccgacagccggggaggggattggggaagcagaaaggacttccgggggtgcaaccaattggaaggaacccaacggcggcgcttggcgggcgcggcggcgatggtggcaggacgatggcgccgactggtttcccctcccgcccgaacctaccgccggcatccgggggctgcgtcaccccccggaggtgaggaaggcggccgtctcggcgtgggaccactgcgggaggcactcccacttgactgacagcgggtcggcggggagcagcggtggcggaggtggaggagggagtggtcgggggcaaagtggtggggcgggcaggcgaggagggggtggaaggggttggacagctcactctcggtgttcgccgctctcgtttccgcgtccctcaccgccgtccaccgtccgccgcccgcccctctgcgcgtgccgtgcgcacctgcgcccacatgcgtgcccccgtgcgtagtgccgccgcgccgtgcgtgcccccgtgcgctgtgccgccgtgcgcaccgccgcgccgtgccgaccacccccgcccaccgcgctgaccgtccctgcccaccgcccatccctgcactgttgtgcatgccatgcgcgcgtgagagagaggaagagtcaggcgagagagagaagagagagaggaagaggggaaagagaggtgagagagtatgatagatgggtcccacttttttaataaataaaatgttgatttgattgccacgcgtacgccatgtaggacaaacccgctctggattaggtcaagggggtattttgtccggtattgaaagttcagggtgaacgatgactggtttttgggtttaggggtaattcggatgaccgtgatagttctgggggtaattcgtactttttcctttattaaaagggatatagcatgtggttttggtataaactgtgcgcaaaatataaagagaaataacttttgattttagatagaagtaactttgtgttttctgataatgaaatatccgtttgatgtagaagtaactttggtttagatataaataacctagtgctagttatatctcaccacaaagcagatgtggagattctttttagcaacaattatttttttaaaaaaaagttgatactatgcaaaaacaaaagagattgatgataagtataaagtgtacatgttgcactgatattgtattgttttgtaggaattttgtgtcccgtttggcttgcgacaaagagagacgaggcaaggggccaagggcttatggtttgggaagtgcgtaaagtttggttcagtttagttaatttgatgatagtaattacggaaagaaggggtagtgcgtttagacaatcgcacgactgtgcgtaatacaatcgtgtcctttttgttaggcatagcgtcttgctatcgagcaacaaagcgaggaagatcctgatatgataagtgtaagtgaaatagtagacaactagtagataaacaattaaattagagtatatcgtaccagcattccttaaacttataagcatgtttcatttagatccacgaacttacaaattgtgcattgagatcccttaacttggtttattatattattccgatccaaagtctcgtttggtcctggtcttatctaatatgacatgccacgtagatttggcatgttaatgctccacgctctgccttatccatttattgtaattttggattgtttctttggcgcagtttaaaagcccattcttgcatggatagatttctccttcacttttagtctgattttcctcccaacttcggtggtttatgacatgcatcgaatattcaccaacactcgtggaatatgttagaaataatccctatcactatgttggatgttttattatctgtgctttatacaagtgttggtggtataaattgggcacttaacagccgctaacaggcgacacgacggcgacggcgcaacagtggcggcggcggcagcacaagggcgacggcgcggcggcacaggagcggcggcgcggcacaggataggggcggcaacgcagcggcgtagctagggcagcggcggcgaggcacaggagcggcggcactacaagggttttgacaggtaacactattagggttacaacaacgacgctaaaagaattaacacctaaactaggagatcacgagaaggttcctcaccaaaccgagacgatcggcgaggatgagacggtgacgacgatccagcggcaacccacggggacgacggcgacggtagatgagaaacaaacggaatagattacatagatgaattgatggttgcagcggcaaacacatcaatggagaaggagaacggagtaccggcgatgacggcggcggcgggaggcggaggcaccggcgggcggcggcggggctaggggcgaccggcggctagggctagggttttgcaatatgagggaaataataaaaattaaggggcatgaagacttatatagggggaaaatagatggattaggtgggtcctacaaggactaggattggggggaggagggggaagaatccgactcggctggagaggggagagggggcgcgcgcggccgaaatagggagggagaggaaaaatccgattaggaaaaaggttaccggaaaaaggaaaagaaaataaaaggacacggtgccgttttgggaaagaatgaaaacggaaccggaaactgactcggactcggctcgttatgcaaaacgaaaccgcagacgaagagaggagtgaatcgggcacgattcacgaccaaaggtggggagaaaaattattattaattcaaatcctgggaattcaaattaataacattaattccgatgctctgaatattccactttaagtcccgttaatgattttagagcaaagagaattcgaaaaaaaaattctccctgacattttcgattattaatacattgttaattagggttttctcctggttaatcaaagtaatttttatagacaatttattggtgaattagaaactacgaaaaaggggaaactctccgggtgtgacaagcacccacaagacggcggcgccgagcacgagtgcgtgctggctgggaacaacgggttcttgccatcgatggtgttcgcggagagcactgcccactcaccagggttgcacgggtacacagcgcaagcgcaccttccctcgaccttacacatgttggagctacaagggatcgtgcggtccatggacgggcacgtcgaccagagcagcggatcggcaaggtcgacgacgagcagcgtgtgtgcactactacagagccataggtgccggttcacaactgggtataggtaccggttttctaaccgacacctattggtcggcacccatactagctgaatttttcacattttggtccttttaaaaaacttatttcgcaaatagacccctaaaaaaacttatcccagaaatagtcttttttggggcaccagagtggctggcgccgtcgtccaacgggacggcaccagcctctccggcgccgtccccccgccgacgtggcggggcgatgctgaggtggcattgggggggggggggggcggcgccagagtggctggcgcccccccccagaaattttttatttttgttttatttttttgatatttttttcacgcttaggaacgcacaagaaccaaccatagaaaaaataagctcaaatggacggaatttgtgacttgtagaatttttcctttcttctcatctctctctaaactagtgcagaagagagagatgtgcaacttttttttttattttatttctttgatatttttttcacgcttaggagcacacaagaaccaaccatataaaaaataaactcaaacggacaaaatatgtggcctgtagaattttccaaagctctaccgaaaaacttctctcctcaaaaacataatcttgcaagcgcaattcggaggttttaatctcgccaaacccggcaaagcggggaagaatcggatgtaaccttttctgtagatgtccgtggatatattatttgcctgattccgagtccgtatgagaaagttacacctattttaataaatggcacccgaatgacttttcggtagagctttggaaaattctacaagtcacatattttgtccgtttgagtttattttttctatggttggttcctgtattctcccaagtgtgaaaaaaatatcaaaaaaataaaataaaaataaaaaaagtgcatctctatgtactgtttaacttatggctatcatttcatttggttatattttgaattagattaagtaatttcatatagtggtggagtgcattatatttaatatgcagatcaaatggttttactaaaggagttatggtctaattttaatgaaggtgcaaagtagactaagtggtatgctatttctaggcttctaactaagtggtatataagtatattacatttgagtttaaatttttttgtggttggttgtatcgtgatcctaaatatgaaaaaacatccgaaaaaataaaacaaaaataaaaaagttgcaattccatatagagaaataggaatggaggcgaggggtggggtgggggggcggcgccagccatgctagcgccctcctcctgccacgtcgattcgcgtgtgccacggtggcaggaggacggcgccagagaggctggacgacggcgccagccactctggcacccaaaaagaactatttatgggataagtttttctagggatctatttgtgaaataagttttttaaaaggaccaaaatgtgaaaaatccagccaatactagccaccggcacctatgaacaaaataaaaccggcacctttagctttactcaagccaaaaaaaaccagctcggctcagctcactgaacactgtcactacgtcatcgcccgagttgctctcaaatcaaattaaaatccccaaatccccaaatcatccataaatcgccaccaaaatcaattcacaatcacatatcacagtatgaacatactccaatccacaaatccaccaaaacatctaaaataaatcccaattccaccatccgcttcgtcgccgacgagcccctcttccgctgccacccgccgcctcccctcctgccagatccagcggaggggagggcgctgcctccgccgccgcctgccgcctctcctcccgccagatccggcggaagggagggcaccacctccgccgctgcccaccgcccgctgcctcccctctcgccagatccagcaaaggggagggcaccagctccgccgccgcgcgccgcccgttgcccggccgcctcccctcccgtcggatctggcggaggggagggcgcggcatccgccgccgccgccgggcatccgctagagagagagagagggagtggataaggacgcaacgacgtgggtgggagtagttgatcgagtagataaggacggcgctcggctcgtcggctcgtttttgtatatgtgtcggttacaggtgccggtttttaaataaaccgacacctataaaaatcggtgtcggttcttttaaataaaccgacacctataaaaaccaacacctataaaatattataggtgtcagttcttttaaaaaaccgacacctatagcattggtatcggttattactaatgaaacgacacctataataatgccttaaaggtgtcggttcttattttttttccacgtgcggaggtgggaaaaggcctataggtgtcggttttaaaggaaccggcacctataaggccgatccctatgagggtttttgtagtgtggtggtagtggtgcaggggcacgggaacaagagagcggactatgcccggctcgcggtggcactgcggcaggaccatggcatgccggccgtcgttgtcgctcgagtgtcggcgtgccccgactggctccgcaaagccgtcgcgtgggcatcgtgggagcatggatgcgcaggacatccatctcggtctgaggcagcagcgccaccaccaccctcttcctcggtcccctccgcccgaggcgacgagcttatccatctacttcctcctggcgtttgggcggcagcagcggcaacaccccgcgcagacgccacggtgggcacactgttgatgcgaaaacacgaggcctgggagatctgcttaactccagtgcaggtccaaaaaatcttgctttcggatctatgagcgtgccagttgatttgatcctgcaatcaataagaaataaaaataggaaaatagcagttaaatccataaatgatagccgatcggctagttgccgatgacatatcatttatctttgagccgatgtcatatctgaatcgatcggcagatataaataagtgagaagagactaaatctactcgatcggctgtagatattaacaatatataacccttatatcgatatatacttaaaccaagtgattgggatagatctgtcaccatgccgagacagtataaaccacttagatcaaaatatatattaaaaataagattatagatgttcatagcatagccgatcagatagatctagcatgtatcggctaatactccgatactattctatattaagatattaaaacaagtaaaatatatcaaacaaaaagcctaatatatctagatgaaacaatatcttaatgtaaaggacagatctagcatatcaataaagcacataaaatataaagctaaatcaggtaagatcggctgaaaccccgatactaccctaatcggcaaccaaaaggcaggctagagattgatattctaatcacgacttataaggtcaaactcaactgatgcagctataagtatgaaaagagggacaatatctagacaatcaagctattggctgtttcatagggtggtggataccttatataatctaagccaacattgatatctaacctaatcggctgccttccaatgatagatgttagccggttggaggttaaatagcaatattgtcaaagattatataagatatatgataactcgacgaattacataaacaagattagagtatcataaagatggaagcactaatctcgagaacgcaagccgccataacaagttttacctctagttgaagatcgaaaccgatgcaactcaacccgaaagaaagaactcgtcgaaacaaaacgaaagtaaaagggtggcgatgcgccaagattgttattgaacatgtgttgttgttttacatgaggctcggggtctatttatacccgagattacaaaatatgtccatgtcggacacgactcttatctctaacaaactctaagataccataagtctttgcggcagacttttgcccaagcttatctctaaggaaattaaataaaatatcctaattaatagatacaattgcctttccaggactcgatccgagtgtggcaatccatatgaagcatattaactcaacccgacaacgtgtaatgagtcgtattgtcagaatcggctcaatcggctaaccctgtccgactcgaactgggccaattaaggtcgcagccgattcggacttaaccgattcttgctttgtttccggaaccgatttttgtcttggattctgcttcgatctaatcttcatctccgatactcaaattaccaaatttggtcgttaacacacacggaccgcgcacgaggtctctcctggtcccggaacctatgggctctacatcgcgcgtcccatgtcgtggcggcggcgcccctctatgtcgtggagcttgagctcctatgcagccgtgaccattactccgcctccatccgccggttccactccttccgttcctctcccacccctcctctcctcttctcctcattgctactctaccgccgcttgcacccgtcgctccactcctcattacccgagcccctttctctcccttccatcaccacgcaaccggtgccagcggtacgccaatgccccaaccccttctcaagcgctggcaacacgccggtcccctagccccctctccggtgcccgccggtggctattgccaccgctccctccctcactagtcaccactgccgatgggggagagggaagggagataggagtgtagtgagtatgacaagtgggccatagctttttctctctagacacttagcatgtgggtctacttctactttgtattgtaactaggctgccacgtcagggtagggttgaccaagccaacgagctacgtcagtgaatttaaaactaccctcaaaaccgttgagggaattaaattgctctcaaaacagaatgctatatattttttttgcgcattctgcaagggagatgcggatcgtacggtcgcaaaaaaaaggtgacaaaccaaaatttttcagctatttgttacataaacagtcctataaatactactacgtgcaacccacaggttgttaactagttatgtaattttgcatccaaagtcaaacagcggctgtgttcttctcccatcttcttaacccacctctctcgttttccgcgcgcatgcgtttcaaactgccaaacggtgtgatttatgcaaaaaaaaaatttctatatgaaagttgttttaaaaaattatattaattcatttttcaaaaaaaatagctaatacttaaccaatcatacagtaatacgagctttgttttacgtgccagagagttcccaacccctcctcctgaacacagcctgcatatgtaaaaaaaaaaaggtagtacatatgaaaaatactgttgtcatatacgccatcgaaaggtttacattgcaaattataaagaaaattacaaagaagaaatcatgaaataaaagacaataaagactccctccgtccctttataattatcgtttgggagttgtacgcccctctcacaagcacagattcctagcgactaataaaaggggacagagggagtagtatacacgagagcaagaaggattttctcccgctatggtgatcactggagctcactggccatcgcttatcctccagtgggcttgttcccttgtcgcaggatcaatcttttttgtgaaagcaggatcaggccgcatgtgctctatctctaatctggaatccctgtcatctaatttgcccttttgaccatgaagtttttggcctaaaagccttctttccgcagttgagctgagcaagagagctgatttagagtcaacgacgtcttcactattttttgtaccagaaagctggtagtccaacgcctgatctggccattttctggtgctggatttttcacattttgatccttttgaaaaacttatttcgcaaatagacccctaaaaaaacttatcccagaaatggtcctttttggggcgccagagtggctggcgccgtcctcctatcaccgtggcgcacgcgaaccgacgtggcaggaggagggcgccagccatgctggcgccgccgcctccattcctgtttctctgtatggagttgcaacggtgtcatttttattttattttttcggatgtttttttacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgctaaacataatgcactctaccactatatgaaattacttaatctaattcaaaatataaccacatgaaataacatatataagttaaacagtacatagagatgcaatttttttatttttatttcatttttttgatatttttttcacacttaggagaacataggaactaaccgtataaaaaataaactcaaacggacaaaatatgtgacatgtagaattttccaaaactctaccgaaacgg

SEQ ID NO: 3265 - DNA, 439 bp, Oryza sativa
gataaatgcaaagtaacatatatatattgcatttcacattcacgttcgttcgctcattcacgttccctcgttcacgttcgttcgctcgttctcattcacgttcgttccctcgttctcgtttgtcttcattcgatcgttctcattcacgttcgttccctcgttctcgttcacgttaattcgttcgatcgttctcgttctcgctctcgttcgttcgatccttcatcgttctcgttctcgctctcgttcgttcgatcgttctcgttctcgttcacgttctcggtaacgttgacgtgtttgttctcgttcacgtgttcgttaacggcggtgtggcggcatcgggccggcgcgtggcgcggcggcgtggcggggacggcggcggcggcagcgtggcgttgcatgcgccggcggcattgcgcggcggcgaaggcggcggcgtggc

SEQ ID NO: 3266 - DNA, 471 bp, Oryza sativa
tcgaaaagaaacatgttgtgtaggtacacaggcccgagaatactgatctctttcacaaggtgacaaagcagatgcgtcattatattcaaaaatgaaggtggaaatatcaactcaaaactgacgagacattgtaccacttcattctgaagggcttctaatctatccggatcgatgaccttctgcgaaattgcgttcatgaatgcacatagctttgttattgttgcccggacattgtttggaaggttaccccttattacaactggtagcagttgtgtcatcaacacgtgacagtcatgagactttaggtttgtgaaattcttctccttcgtgcttattattcgcctggtattcgtaagtatccagacggtacctttatgctctccaagcattcaaatatactttctttctctcccttgctaagagtgtagctggctggactcaagtaatggcttcctttctcctttggttccg

SEQ ID NO: 3267 - DNA, 3798 bp, Oryza sativa
  unsure (1)..(3798): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgactgttcatcgaagaaaaaacaaacctactcacggacttactataaagaaaatataaagccaaaaaaaaaagtacatagtaccattggaaaaaaatcaatggttaaaccaaatctataggattttttttaatatttaaagatctatataattataaacgtatgcaaatacacatggttaaaccatatctatattataaatatgaaatatccaatcaattctctttaaactttctatcttaacaaatgaggctgacatatactaattaatgttatgacaattttttaaataatttcgcatcatattttagttgtcaaatataacattatgaatatacaacactaatttaaatatacatgtttaatgaaataaaaacaacacaatttagttgttttttctattagatctgatttagttttaatttgtttgagattaagattctcaaagtgtttattgaaaatttttaaaactatttaattggtattggagaagtgagcagcataaatgttacatagatgtgaaaaacaaatataaaaaaatgttttccgacaatgatcttcctataatacaacccattaatctaccatgagatttatgatcagatatgtatgttttatatttgccaaatagttttgacaataaatgaacaatctagtaccatgcacaataaatatatatatccttatagttaaggaattccaacatgttagacataattgatggatgtatgtcttacaccgcactgacatgactataagtatactctaacaaattagttattataaataagtttggggaaataaaagtattctctaaattagtaaaggcgtctcatgtgattatgtatattatatattgaaaataaaccagtagctaaactattgatatttgtcgaaatataaacaataatatggagctctggagattatcgcagtggtattttttaaaagaattcacttttgtcccagttacatataaattcccccattgttctgggataaaatttgactccttctatttatgtggcagatggagtacaagtaagataactctatatttagttggatgaagtagtactattagctatatttttaagtagaaaatatctttcattaatatatcatagaataaaatatgttacttaaagtcatctatagcatacaaaataaaagatgttacttaaagtttggaaactccaaaaaatatttcaaaacagaatcgcacaaaatacaaataaatatgaaccaactccattattgtgatacaattttttttaataaattcaagatgtgcagttctgataatatgcccaaaccagttattaatgaaaacatgtttaaaatagagtcaaagaacataaaaaatatcatccacacttaaacatccgtaataaaaatttaagcaatattaaacaagatgcccgtgcataagttagtcttccttccttgttattcaagaattcttgtagatgatttaaccggtctaagagctgctttgcacaaattggcaagtgagaccctattcaaatttttttaacgtggcttccacagtgtgaaacttgtgagtggtgttgtggctgcaccttgtgaacaatacttgagcaataaagaacatattcaatcatcaaggcattgacgatctctaccggtttcgtaagttttatgtatatatttggttttggcattaacttttctgcgattttggtcaagttaatccatccaaaacctttttaatattttgtaaatcatatctggaagatttcgttgattggttcttgctagattcgaatttgcttaagttttaggttttgttcagatttactaaaattccgagatagctggctttagagtgtgtttcctcttaaaccgtttattattttgcaaatccctccggtggagttgtatcttggtttgtctagtttattctatcaaaatttaatttcaattcaatggttggttttggagaaaacacgtttttacagaagtactgttagcctatttttaggctgacggtcagaccgcgagagtacctgcggttagactgaccctattaggtcagatagaccgttataagtgtgttccattggattttgaggttggggtgtgttttaatctatctaatttcgattatttgacttatactgacataatgtatcattcaccccccctattggggctagtatattcgagacaatgtggtgtatgagctggcccctcataaaatggttgatgatgtgaataacattagatgtgacaatcacctctacgatagaactttccctaatactactacgtgggccttaggattctgcgccaaagttgcattgtagaactgaaataataaatattaatatggattgcagactatgttctatattataaaaaattgggaagaatgaaagataataaaggagggagtaaatcttttcccgaaataatttatcatgatttactgcgtacctccttgaaaacgacacggactgaataatcggccgagaacttttccagctccgatactcggtatggatgcccgacgcaggagcatgcaattccatggtgtcgcgtgtgcacgacgatgcagctgccatttttcttgtcaggtaggtagccccttacggcctcccagtcaaccatggtggtaacgtcctccaagaccactaggaacttctgacttaattgctgcttgaactcctcaatgagtacgtcgtctgtcgccaccatcaagtccaggatttttacagtgttgtcttgttctggacaaacatttttgtggaactgagccagcaagctccggatgaactcaatgggatggaaaggatgcaccattttcacccaggctcggcagttgaaacttttcatggtttctgtgtcgtcgtaggccttcttgatggacatcatctccagatcgcttcctgttccccacactgagatgacttggagtacttctttctccaccttcaactgctcttcacaacaatcatgataacaatcaccattatcatcatcgtcctcgttgttgttgttgtcgtcgtcatcatcatcgtcctcgtcgccgccgcccccgcctgctgttagggatggagccataaaataggaacgagggaaaggtgctaatatatgaagtattaagtaaggaacaaaattaacacttgtcattgtcttattgagttacataatgaaatttcatatacataaaaggagttcacctagcatatggcgtgcttggccccccttcctgttgatcaacatgacaagatccacttgacggctctgctttgctgcatctgtcggtgccattgcattggcaacagcttgttgatgcgcctgctcctcaggcttatgaccggagtcaccaatacggttgtaacgcaagttccggtgacccatggcctcgaccctagccttgagctgctctatattagcaacggcagcgtccaggtccttccctggtgccgcagacggcatgcaccaaggcagaatcatgcggcgccaccagtgcggcttgctgtcgaggtaaacaatggtctcgatgcaatcctccacgtctagggccgtgttgcggacctgcctcaccaaggtcctcgtcacgttgtccgtgacgcggcccttggcatcattaaggaaggagtgcatcatctcaaactcgtccgagataaccaacagatcgcgctgcacggtcttgtgcagcttctcctcttcctcca

SEQ ID NO: 3268 - DNA, 16606 bp, Oryza sativa
acccatgtggtcaaaaaaaataaaaaatgagtctgggcagatcgtccaccaaacgaaagagaacgttggagcatgagccaaaatttaatccatccccattaaaatataggccatctcctcagtgccatcaatttttgttataaaagcttggtattcgatacatgggaacgaggactaaccttgaccttttcgattgttttagtcattgatcactcaagatatcatattacgatataggagcacacaatatttcttaacgaggttcagcccaaacctatatccccggactttgattatgggtgctcctctccaatcaacatagcacctaatcgctacgagtcaatgactgtcagggttatggataaggcatacctcctattcttgaggttacgatgtatatgaatgcggtatactctcaagtatatggaaaggttactttagtcttaaggaattaggccaatgtataaggaaaccgactcccgagtagaaggttttagagtcctattcagatgagaagcagactatgtcatctcgtacgcgtaaggtactctccgagttctacttggaagctaagtcacttaggggtataaatacaaggccccaggtggtatgggatcatcgaatcatagcattgccaccaaccatggtagaagcaatccgaaggactcgaagccaagtcggcgattgatctcgtcgagtcgttctcgacaacagtctaatcggtaactcgttgcttctgttgttctctattgtgaaatctattgttctgttcataatcgcatataaactggattaggtgggctattaccttccgaggggcctgaacgagtataatccttgtcttttgtgagcttgatatcgtatcatagacttagaacatgcagtgtgcaactcacatctctcaggttctcggataatgtttggctttccttacttaaaacttgagcgagtacttaactatgaaccaatacataagagatacaaaacagagcaaccgttcatcattttgaaagtgcattaattcccctagtgggttttggtgattaatgacaaatgtggttaagggactaatgagttcattgagtaactttcaggtgcattagtccaaatgtgtggaagatggatgcttgaagacccccccaaaagtacaaaatcaaagcggaccggaactcgagaagtgcataggatagtttatcttttgaaatcgagtttttagaaaaaaaccatactattaagaggggttccaggtgatgctctgagatatgtcaagtgctcttagtatgaaccaagtgtcaagtttccctaggagtcttttttgcatatactccttctgcccaaaagtgcaagtccggaacttcctgtcttccaggtccggaacttcctgtctagtttccagttcaaaattgtgagtaacggctagatgacgccacctagccgttatacatatacagctcgtttccagctcattccttggccattccactttcacttttcaaacctagagctgttgctagtctctcccaagtgtttgttgccttctccactcaatctagagcctaatacttgtgagaaagagagattgagagggagagaagaagatttggagaggtgtgaagactcggatcttgggtgagcacttggaatatctcgtgggttgtcatctcgttgcttattactcttggagatgatctcctagacggttaggtgtcgcccgcgagaatccgttgcatattgtggatgtcccgggtaagtttgtgaaggatctcctctcctccgaaagggaatgaggtaagttaatgaagttcttgtgctgagattctagaggttttccaagtagagcaacctacacttgtggtggatttctagaagtaggttgagttggatcttggtggtcactcaattctagaaatttgcctaggagtgtttgggttgaaggctgtggattttctttggggtttttgcacaagtgaggcaaggggttaatcgagacccagctctttggagctcctcaacggagagtaggatcgcaagatccgaactttggaaaaaaatcgctcttgtctctttctgtgatgtttctgtgatctatccaaaacttgaccaaaatttaaagtatacatataggattactaatatgtgctcatgcgacaaaactgaaattaagcgtgagctaatataccaacatctgagctgttaagtaagcaagaacaagaagcacacaaacttgcaattaacaaatcatgaagacaacaaaatggccattagctgtcacaccacggtgtggcaagggaatccatctattcgaaattagagacaacgatctgatcgagcaagcaagcccagctgcctcgctggcaccatctgcattgcacgcacgtccatcgcctagcacccactgattaattaattaatcaatcaattaattagtcctaacaacaagtaaatttaaaaaaacttctctgatccgttcatcaaatttttaatagacgcacatacactaatccagatctaatgtcggtgtaatcaagcaaatccagatctattaactaaatgtcgggacggtgtcgcctggtgatgaggataattacaagagttcttcaggttacgaagctgtataacttaaattaattaacccaagttgattactcctgcttcgattgcttaattagcgagcagagaagagccatagctttaaaagacgagacctcgtgcaaccattatattcgtacgtgtgttcatgtacgtcatgggcaagatctgacggcttcacatacctgttccgtttgatccgttcgccgtcactacggccggccttgatcgattcatcgaccggtttagctggcatcacattcacacacacacacacacacacatcactcctcagatctgatccaattcaggacagctaaggtagagttaattaggacaacattatgaagttaactagtgataaggtttatccaaaatatttgaattcaaattcaaatttgaatcggatataattcaaattcaattttgaaacgggtatataaacttttgacttataaactttaggtgtataactttagatgtatagaaatactatatataataaaatatttgaattcaaattcaaatttgaatcggatatataaacttttggtctctaaactttagatgtgtaaacttgaggtgtataaactttaggtgtataaatttactaaaatagaaaagtaatgcgatgccaaaaaaagaaaccaggtggagggagggagaggggaggggatcgatcgctgcccccgtctcggggcaatcgatcgctgcccccgtcccggggcgatcgatcgctgaacagcattctcagtttaagaagaccgaactttctttagaccaaaaggactagaactctctttcctaagtaggggtagtttggatacaggactataactctctttctttagtgactgtcatatcggttgtttggacactaatttagagtattaaacataaactaattacacaaatggaggctaatttgtaagacgaatatattaaaactaattagtccattatttgacaatgtggtgttacagtaaatatgtgctaattatatattaattagccttaatagattcgtctcgtaaattaaccttcatctgtttaattagttttgtagttagtctatttttattactccaaattaatatacaaacatcggatgtgacagtccgccattggcccttggcagtccgaggatgacatggggcaaggagcacgcggcgaggacgaccgtggcgtcagcggctggcggggcgcgcggcaaggacagcatgggcgacggactggttggggcggtagagtagtgttggtggcgacgggcggcgaggacgggaaggacgaccgcgcgtgggcggccggtggccgggaggacgtcgactccctggcgcggtccgtctccgctcccgtgtaccgtgtacgcgcgcggattttcggacgtcgcggcggtgctcgatcctatggtccgaagtgtgcgcgcggcgttgcgcggcctaatggcgtggctcggcgatatgcaaagcggggtgctgacgcggcgagtcgagacgcgtcgcgcaggccgcacgtctcgtcgtgatgcggttgggccgttggggtagtgttgcgggtagcgcagcgtggccagttcgcggtcgacggcggcatggtgaggatggcgtgacgtggtggtcgcatgtggcgcgcgtcggctcggagacaggagctgcaaggacggacggcgaggtaggcggggacaaacgtggcgtcaccagcgtcgttgtctgcgcacgccggtacggcgactcagggcagggcgtggccggcatcagcgggagaagttgtggggtggttggcaacggcgacagggcgggcaggcggatgatgccagcagctctccgtgtactggcgatgttgcggcgttcggaccagtggatctatgatggcggcggcgtgcggtacctttggcgatattctgtcgagcagttggcgggcgtgcagcttggggaggccaagtctggctgggccagctgggctgcggcccgggtggagaaggaggaggggaaggctagaggccgcgggagagagaagaagggaggcacaacgagctttcccagtaggctcagcccaacagaaggggatgggaagggagatggttgggccggctgggattggcgcaaaaggaggggaaacagacttagtgctaggatttgaattctagggagatccttctctatgggttgaatgatttgttgtttgactataatgatttgagtctcatgtctcccatttaggttagagtgattccaactcttgtgataaagtaatatccattacaatcaaaatgttggtcattataatatggattgttttgctttcactttgggaggatatgtgaatggttgcatttatttattatttggattctcgtaacccattagtagttttgcaatttgtgaattaaatgcgcatccccaattccagggcttttattaccgaaatatatttttggttgaatgcctgcattatatctggattggaaattaaattggcatttaatttctccttggtagcattgtatatgcctcattcgaggtttgtaaaataattcattcagtttacttggtatatttcgggatttgattattcgtggctttgttttagggtggatttccacacaaggaaagcaaagatgactgcatgatgcaaaagtttttaaaagttcaaaattttactgatttttttcaactggatttttagggtgttacaatggtggagattaaatttctataactaaaaaccgtgtatgccaatatgtattttggttccaagtgagtgttgatatggacaatgtgtatgatcgatttaattaacagaactacctctctatctacgtgattgttctgtgagtgtgaatgtgaatttgtttgattgatgtgcatttatgctagtaagaaacatactaatgttttatatcggcatacattgttacatggctactggatttttgttttcgctataacagaacaatgcatatgtagttctgtctgctaaaacggttacaagggcggatgtcttcagtaacagcccttgaaaaacctacaccgcatgtgaaatctgaacatatccacccgtgaaaatatgtttttgtaggcggtgtttgagtgcgcctacaaaaatacctgatatttacatgccccggctagaggcaggttagaaaacgtatgtgcaaagaacgtgtgctgtctggacacatgttttctacgacagtgatataaagtcttataataccatacacattaatttggcctatcaatcacctctaagttaattttttaaatttctttcaaccacccaaccaccctaaactatctctcgtttagtgaacgcattaaaatctttttttatataattttggaatcttctaagtaacttataaataattatattttggaactgggagaatatggtatttttccaacagagaaaaatgccaagtcgacagcagcttgccattaattatctcaggtcaacacaattaggttgaggatcggccggctctgccagctcgcctgcaactggatgtgcatatgaccttgcaagttgcagcgacagacatagtatttcctttatctaatcgtaagcctgcaatataatttttagtcaattattggttcatcgccccttgctattagcatgtcgatgtaacccattaaactaataaatcctagactaaacagatagaagatgctcgcgatgctaccacaccccctgtcatcaccatatttcctttggacaagtggactaacaaaatcattttattttctttcgaagggtccaattaatgtaatacaagtggaaccaattgtcttgtcaagtgggatatacttcctccgtccctaaataaatcaacttgtagaattcaaactttgtcccaaaataaatcaacttctatcttctcatcgacactcggttcgcaaatcgaaaaattttgttccttcaatacctctacctccctatccaccaatactaatttgctattaataagtgatattttggtcatttatcctcttttttaattttgcattgtgaagctagaagttgcctctttttaggacagagggagtatgtgtttatcactgacgttgacattttgtcctaatgattctctccgtttcatattaaagtcattttgactttttcatagttaaacttctttatctttatctttgattaagtttatagaaaaatatagtagcatttttaacactaaacaaatatattatcaaaatatattcaatactagatttaataaaattaattttatgtttaaaatgttgctaaatttttatgtaaacttagtcaaactccgttcgaggtggctgttgtttggatgtcctcgaatagagttaatagtagactctagtactcatcgtatcttatcttctaaagccgacggaaccgcgtaatttgattggtacaggtgatgcagtaattcacaaatcgagttagcgcgagactctctcgtgcagtaaccgtcccgatggttcggcctctcgacccatctggagctctgggcaatacttggcatcaagctgggctgcatagcctaattacgtgcgcttaggccaagcaaaataggaggaaaggaaaaaaaataaaaaagatatacataaaatcactgctgcagaaaggggcataagtcccgattgataacccccctatagtcccggttgtgcaaccgggaccaagagtccggtattaaagatatccatctttagtttcgggtgaaataaccgggattaaaaatccatttttagccccagttggtgttactaaccggaactaaatatcgaaccaggccagatccatttgctagatttttcctttttttcattgtttttaacatcgaatattgatttcacttcatccccaaatcgtgaaatcctaaatcgatcatcacagatcatagatcaaaaggatatctccaaatccttaaatcgatcatatccaaacacatcacaaaatcttaaaaaaattacatcacaagttctaaaaaaatcatcacaaatacatcacatatttacattacacacaaatcaaatacatctcagatctgaatcacaaattctcaaaaaaaaaacatctcatatcctgtagaagcgcaggccgccgcccgccgccacgcaggtcgccgcctgccgcacggccccgtcgctggttgccgccttccgccagtcaccaccctccatgcggccagccaccgcctttcgccggcctcgctcgctcgctctcgctaggtctgctctcgcgatagaggaggaatagaaaggagaggataaggataagacagaggaataggaagatgaggagtttgggaggataagtcctaaggattatatattgtatatggatttttagtcccggttggtgttaaaatgcccagccccctaacagcctcgtacagaaaatgaaccgggacaaaagatcaccttgggctgatagagttttaaaccgggataaaaaaatcatctttagtcccaatttctattcaaacagggactattgtggcttttgtccaacccattaaagatggtttctcattagtgaatatattttgattaaactagaaaatgaaacctgtatcctggccacatatgctgatgatactatcaacttttttagagtatgatttacagaaagctaaaaatataaaattgattttagctacttttgaaaaattatctagcttgaagataaattttcacaagagtgaattattttgctttggccaagcaaagaaatgtcatgagcaatattcaaatatttttgggtgcaaactaggagattttcatgttatatatcttggcattactatgtattttagaaagcttagtaataaagattggttaacaattgaacaaagaatttagaaaaaaacttagtagttggaagggtaaacatatgtttgtaggtgggagattggttttgattaactctgtgttatcaagtttagttatgtttatgatttcgtgttttgagattccaaaagggttcttcaaaaaaatgattattatagatcccattttttttggcaaggtgatgaacataaaaagagaaatatagattgacgagatgggaaattatttgtcagtctaaatatcaaggggaacttggtgttcataatttacaaatccaaaaccaatgttttttaagtaagtggttgtttaaattaataaataaataaggtgtgtgacaagatattttggaaaggaaatattttgtactaaatctataactcaagtcaagaggaaataaggggattcccattttttgtcgggtttgatgaaggttaaaagttcttttctaaatatgggtttttgggttattaataatggtgagcatgttagatctgggatgataagtgattaggtaattcatctttaaaggacaaatacccatctttatattctatagttagaaagaaaaatacatcgattgcaagggttatgagtgctgttttaatgtatcttttatgagagcgttagttggtcaaaacttgattagatggcacaatttgtgtgcttcaattgtgcatgttaacttaacagaggaggatgatatatttagatggaatcctcgtcaaagtggtcaattttcagttcgaagtatgtatttggctctaattaataatgggtatatagacagaaataagtttatttggaaacttaagctgcctcttaagattaagatttttatgtggctaaaaaatctggatttccttgtcgctttagaattggtggttcttacttgacggttggccgccaagatatattgccttggcggtttttagattacccttgacagtttttggccacaaagaaaactacggattcttgtagtatgtacatattgggcttactggtgtcacctttgctatactagcacttctcattggggccatcattttggacatgaacttaaggtaagatgtagtacgggctcttagttaaaactagtggataccctatgctttgctatgggatgtgtggatgagtgcatgttattattgatgtgaaaacacggcagcttggaagatctgcttaactccagtgcaggtccaaggctagcctggagtgtgtcaagggcataccaactgatttgatcctgcaatcagcaagaaagaataaaaacagaaccagttgcccgatagtcgatcggccgataggccgatagcatatcattgatggtgtcagccgatagagttagaccaaatcggctatggactggatatatcaaaaaataataaactctaaacacgcccaatcggctataacactatctatagagtttaacaaattgatttaaaacaatattatgaaagtagccgatgtacttatatttagagcaagagagataccgtactagctaatactctagtacaaacttatatagacaaattgatccatataaacatatcgaacataaatcaagcatgaaggtgtagaaatctagccgatatgcttatacaaaacaatctatctatgtaaatggcgaatatacatgaaacatgggatgagacatgcatattaggtaagatcgactgaaagcccgatactatccttattatgcctaattgtaggctagtttgcatagttctaagcacgactagggatgatgcatctcaaagtatgaaaaaaaacatgcagtctagacaatcaagcaattatacacttttcaggatggtagatgccttagataatctaatctagcaagataatttaatcgaacccagcataaaccctaaagcgagcagtagctgatagagctaaattgagaagctaataatatattaactaagacatatgatagcaatgactcacgatatcgagcctaacaagtctaaaacggcatgttagccccagtagcacgaaccattgagacgagttacctcttacgaagaactcaccggaaaacaagaaaagtaaaatgggtggcgatgcattgaagctgtatttgagttgctcccgtattacaatgctatggggttcatatttataccccgagtataaacttagtcctttatggacgcactacaacaaaaaccttatataaagatacttttgtaaagatgttttgcaaattgcctcttagatcaggagtttcatattgtaaagacattttatagaggcactttttaaattgcctagaaaacttttactatatagacattttagaaatatttttagcacatttattagattttatcttgtagagacattcttttggcactttaaactatgtctgatatgtaaagacattttcttgagacactttaaactctgtaaagacacttcttagaataaaaatatatactaaatgactaaatataagtatctcaaggcaaaaacatacaagtaatgacttgtggttgagtaagttattgccttgaatataagaatgatttgtgcaattgatcatgagttcaaggattggcaaacacaagagaaaatattttatttttttacattggttacatatggttgtggtacaatttaatgtctctataaaatgactctaccatcttatagacattttataaaatgcatttttgtttgtagagacaattcaccgtaaggcacttattaggcatatctaaaaaaaattaggcattttttaaaatacctctatagtatcgtaaaggcatttgaaaagtgtttctatatagtactagaaaaatgtctctacaaagcatttttctctgtagtgacacgactcaaaccttactaaagttaagatacaaacaagaccatatacgacggtctcttaccaaatctctaacaaaccaactcaatatcttaattaataaatacaattgccttaaacgagctctatctcttattggcaatgacggttatcccaatctagacccatgctgagcccaagtcacttcatatcggccgcatcggccatcggcttcatcaagcttcaaccagcctcgtactctgtttcggccaatatggtatccagtcgatgtgcaatcggactccaagttcggttcgattcaacaccaaatccgcttcgattttcttccttcttttccgaatctgatgccaaattccgttgttaacagttatacattataagaatggtagatttatatgtttaaataatgtgaagataatgatttgacattgcttgcatattgagttctaaaaacataacaaaactgtaaatgatatatgatgtttgcatgacatttaaaataattgctagtgggtaatgatgtgacataattgcgtatgatttaaaatactctagataagtaattgctagtaagtgagcgatgtgacgcacttacatgttaaactttagtaggtaatgagcatcttatagtaagatagaatatgtcacttagagcaggtacaagagcaggctataagctagttataaacatattttaaagagataaaataggagagagaagagcagcgggctacagatctatagtcaactgcagcacggactccaaaacgtaatgtgtatatgataggtgggaccaggtattaatagtatagtaagcactattgtatgaatcgactattaaattggttatagataaattggagcttgtagttggctatagtattaaacttgctcttagataatactcttgcactcattgagacaacgagacgttgtagtcattaatgtaccaatatttttttattattatcgttagttctttttctctacaacatgcagcaaacttgtatcatgtatacttgcatagcaatgatattttcctttctcccttctttctctttcacgtcatatatgataatagagagaggacgctaataaacaattaatgttacatgtgctaatgttcaaaggtgaggaatagagcagtcacatgaaaagaaggtatatataaagttaaccaaaaggttgtcttgaggcacaggctaagcccatataattaatggatgcataaaagattaaaaaaactgtagtctgcttgatttggcagaataggatcattaagagtactataatgcggcatatgttgcctctaaaaatgccacattagattaagtgatgagatggaggagagaagtaaggagagagataatgagccaccattaaatcaagaagcaacctccacacaaataagacttagggaaaaaagaatttggtgggtgagagttgactgtgagcttctttcaagtctttaaactacaggaagaaaagcatcgacaaccaataagacacagagaaataaaaaaattgataatggaggaggttacaatagaagcaaatgaaggcgttgtacctattttagttctaaccatgcactggggattgtacaataccaaaacaaagagaggagaaatagcaaagaggcatgcaatcgatctagactgtttggtgaagacaagatggatattttccgcgtcgttgagtctatccttacgaagatgtgcagtgtgattgaccaagattgggagctgggaggcaaattgaagaatgatctgatatgcatcaaggaagaaatgggcatgatgaatgccagcatcgagcaatgggaggggaacatccaagggccggtgcagcagcaatgggtgcatcagcttcaagacttggcgtatgatatcgaagacttcattgatggccaccggattggacctcaagagccgaatcacttcatgcctcgtgctgcgcgcatgatttttgggacggatcgacgtcctcagcaagtcctggacgtgaagatcttgaaggaacgtgtggccatcttacagaagtggcaacaaacgtttggatctactcaagccgtcggcggtgcaggcaacggtagcccaccatccggtggcttcggaggctgtgaggctgatgagcagcttgtgggcatcgacaacgccaaaagggagctcctatcgctgctatcggcagccgaatcccagccagatcagcaaaacaagctgaaggttatatccatcctgggaagtaacgggatcggaaagactaccctcgcccgaagagtgtacgacgagggcgatatcgtcgagcaattccatcgccgtgcttgggttgcgtcctgggcgtgtgaagactcggctagcctcctgaaggagatagtcaggcaacttacaagcgaggaagacggtgcgcagggatcaactagttctaccgagcaggccggtggtgccggtgcccccaatgttcgaaatctccgacaagatgtcgcggcacacctgcaatctcacaggtgagctttttaccagagcaatagttattcgcctacatatgcaagctaacatatggagatctgatctttatctattacttctgggcaaaatgtaagtatttgctagctagttgtatactagtatcttgatctataaacataagtaaaacggtcgtttatctaaatgtagacttttcttctttcaaaacgaaaatggactctgcattttaatgcttagattaacaggaaaacaaaaactttgaggtgtacaatgattttttattttgtatctgaaagtttagaattggagctgtaaaaactaccggtttacaacaatagtttggaagctttgaggttgacaatcatatttgacatttgattatttagactgttattgaaccatatatataggacctaaatctttttttttacacaatcaagcaaacttcatgttcattttttttaatcttatgtttttgtatgtgagtaattttacagttcttaagtatcttaagatatctaaaatttacactaagaattttgatgccttgagatacctagtactgcaggtatcaagttctacacttgaaaaatatggtacctcataatatcttctaaagaacagtaaaattatcctttgtgcgttgtggaatatccattgatatatagttttccatgtctgttaggtacttaattgtaattgatgacctgaagaaagttaaagtatggtcagatatagcatctgcatttccagaaaataacaaaggcagtagagtaattgttactacaagtattctgtccatcgctactacatgtgcttatggcagttgggtgtacaaaatgcaatgtcttcaaaaggatgattctgaaaatttgttctggaatgaggttttcaagggtgcaaatagaatacgtacacctgacttggatagaggttcagtaaccattatcgacaaatgtgatgggctgccgcttgcactggttagcgcagccaaatatttgaattgcaagcgacatgctcttagcgggagtgagtgcaaaaaggttggtctcaatctaggtaatcacctagcaagtgaaggttctttttttaaggaaattaagagagttcttgcggaatgctacgacagtctacctgaccatgggcacaggatgtgcttgctatccataagcatgtttccgaggggccaccggataaggaggaaaagtctgcttcgccgatggttagcggaaggattagtggtcagccagatccagttgaatgaggaggatgcagaggatcgtttcaaggaatttattgaccggaacataattgaagcagttgacattggcaacgaattggaagctaagcactggcgagttcatggtgttatgctggagttcatttcccataagtccatctccgataacttcattacattcattggaaacgaccggtccacaatgagcagtaatggccgtgtgttacgtcgactttccatttacaatagaactgctaaagacacaacaactgcagagaaaatggaagtttctcgtgaggtctctgacaatacgcaatagcagcgttccgaacttgaaagaatacaagtcactgagagtactggatcttgaagaatgcaatggcatcgatcaaagggttgtcaagaaccacatatgtgagttgctctttctgaagtacctgagcctcaggggcactggtgttcgccttattccgagcaaaataaaaaggctacggtatttggagacgctagacctgcgggagacagaagtggaaatgttgcccctggaggtccttaagctgccacgtttggcccacctgtttggtagtaagctcgagatgcctcaggagctctctaacgatgcagacctcgacctgcagaggtttttccaacacgaatctgaactgcaggttctggcagggtttgtcatggaggataacaaggcgtttgtacatgtgattcgtcacatgagcaagcttaaaaaggtcaagatatggcgcaaagccaacgctgctcctgccaaggacctaactgaacatttagtcgtctgcattcagaggcgtttacagggcagcagaccccttgaatccttgtcaattgacttcggcgatctctccatagacttccttggtgatctggcgccgccctgtgccctcgagtccctcaagttgcgaggggctatgaccagcttgcctgcctttttcacatcaccggaaaatcaactaagggagctgcacctttggtcaactggattgagcgggaagccctctctgccctacaaaacctgccttaccttgtctatctgacgctaaaagaggaccgtcgtggattttggagcgacacctttgctgtgcagagcggcggattcccaagtcttcggcggctgcgctttcaggccgccatgcttccaaaagtagtattcgaacaaggatccatgcccgatctcgccgatcttcacctgctttgtccagaaatttgcagctccatttttttctatcgttctttcgatatgccaaggaatctaaggcttggtgtttggcacatcgaaaacctcgtcagtcttaacgacgtggtactccatcattctgctagtgagcaacaattgacggcttggaaagatgcagcaagcgcacacaagaacaggcccaatgtgaggaggcaaccgcaataagggcattcctagatatttgctactttctctgtttcactttaatacgttttgggttttgaatacgtttattcatggatccatatatatatatgtgtttcatatatgtattcaaattaatatggatgttagggaatatagacgagggatggaaatgtcaaaatgtgtgaaacc

SEQ ID NO: 3269 - DNA, 11426 bp, Oryza sativa
taccactcgacgcgctgcgcggtggaagaaaacgctgagaagtcgaaggaactctcgcgaagtagcgcgcgtcgatgtagatgaagtagtcgatcgcacccgctcgaccttctcctcctcgtgcattctcctcgccgtactcccacaccgatcagcaccgcaaaccagcggcgcctctaccggtatccacacgtacagggacggaacgccacgcgcaaatgtgctagcacccgcgcgcagctagggttttgctcgaggagggaagtgacggctagggtttctcacgtgatgcaatgcctccgccggtcacaccctcacgaatatataggatccatcactcgggcctccaaggcccgtaggactcctattcggatccctatccgaattaagctcatattggatctctatccaatccccttattccgacccattaagcgtgcgaccctgtaggttcatatatactcgatcggctgtaacccgaaaactccttttcggtccacgcgtcaacagcggcccctagcagaatgtattgacccaccgggcatacataaagatcatatcggttgaacctctagtgtatacttgtatgaacccctttgcttcacgatatcgattaagctcaaggctagatatgtgccatcctctaatagctcaatcattcactcgaacctgttgatagattatataacttatgattggctcatcaatcacctttggcatggccatgcacttccataatctacaacatcgaggggcccagagatatctctccataggaggggcaaatcccatcttgattattcatatcccactacatgtttcatagcatacccgaaaactacttttataactacccaattacggagtagcgtttagccactggtggagaaagggtttttactcccggttcgtaacccccctgtagtcccggtttttcaaccgggactacgaatccgggactaaagatctttagtcccgggtgaaaaaaccgggagtaaaaatccatttttagtcccagttggtgttacccaaccgggactaaaaagactagatccggttgctctttattattttcttttcttcattgtttttaatcaaaatcacaaatcaatcccgtgcccaaaatcacaaatcaatcattcttaaattgcttccaaatccacaatcgatcatctcaaatactcaaatacatcacaaaatttcaaaggaaaattacatcacaacttctacaaaaggatcaaatattcacatcacacacaaatcaaatacatcacacaacaatcagatccaatcaaatacatcacacaacaatctcaattcttaaaaaaaaatatccgccgcctcgccgcgcgccgccgcctcgccggccggccggccctccgcgccccgccgccctcgcaccggccgccgctgtaggctgccagccgccgccgtgccggctggccagcctgtcgcgccccgccgccgcgcggctgccggccgccgcctcactgcgcgccacgccggccgggcctccgcgcccgaccgccctcggtctgttagagagaaggagaggagaaggagaggaagataaggttgaggagataaggttgaggagaggaagagataaggttgaggagaggaggagagaggagttaaaagagaaaaggaaatatctcgatccgatcgcgcatgcctattcgatctccgcgtcgatcttttttcccggttggtaacaccaactggaagtaaagcgtatggcgatcttttttcccggttggtaacaccatccgggactataaatagatctttagtcccggttggtgttaccaaccgggactaaggattgaaaagtagcatggagctttcaaaccaggactaaagatgtttttagtcccggtttttaatacaaccgagactattgtgaaatctggtcgaccgaccaaagatggtttctccaccagtgagcagtccctaagtaagctactacacatgttgagaatcatgataatctcaggtctaaggattcaacaccaacacacaatgagatcactgatgacacaacacatatggctcttgtagtgtctcatgttgggtctatccaacaacatgttcaccaacatgtgtccacactattaatttggtatctctataccatgatccatgagacatgatcatcaattaatacatgtgctgatcatataaacatatttgttccacatatgatatttgatcagggatcctttagaaatagtaacaaacaacataaagagtctcttgaaagaatcacatattcattaaccaataaagagttatctatttcaaggaacaatgtcggataaatatgtaaacatagtatgtgatacaatcatctctatgattgcctctagggcatatcattaacagtctagcacggtcaggatgccatatgacaagcactactacggaaaccatctttcgaccatcaatataactaaaataaatgagaactagctatgcttgcaatgtatatttattttagaataatttatttccacttatacttggattttatttgactttaggaattgagcaaataaaataaagagaaaatgataaaacctcactcctaagcaagcttatggataagatgccacatgtcaggtataaccgtcccggaaaccgtcatagggacccacatgtcagcgccccggagaagtttggaggcttgcagggccagcccaggttcggccaagacgcgttgagtgctcactcgtccgtcgacatcgcaatggaggatgcagagttcacaccaagattgttgagtgacttcgacctcgacctcactggtgaccaggagatgcaagcctaccggatgctcaaggactggatttgttggaggtatgtcacgagggcctttggccaattcttgaaaccattagagttatcaaaatgtcggttaagtcccttgggcgaagccgttgggcaaaaccgaaggatgaggaccactgggtttgccatcaagtttgggcgaagccaggtagtgaagaccggtggattcgcatgttagggaaccttatgcatctaggtgattgatatttgagatatagtttagatgaaggaaattcttgtgttctatctcatggcaattggggatttgtttttaaaatcaaaaattcatttgaaagcttaatcctcatatgactttattcctacctaccaaggtcatacaccaaaatattaatgatgaaccttattaatgtgtatgacttcctgtcattatattgagctttaccaaattattgtgactcgtgttagatctctctcatgctctctcgatcaaggttgcacaaccattatgctaagcttctacattgtaagttggcaccattccatccatttccgttaccactgaaaaaaatatgatgaataaattctccatccaatttatgccttcttctcctagaaaaatccttggaaaagaaaaagtaacagaggggaatgcatggctatgaaaaatattgctctttcaaaaatatggagcaacattgaaaaaaaattaaaaaaaagaaagtttacaaaggagaaaattggagaagaaggcatatacaaaggagaagcatcttctttatttcccattttttcacatatatcatacactttccaggtgcaatccttgatccgagagtatgatcgactatcttcttgagtccatttatttggttttgcaatatatatatatatatatatatatgatgcaggtatgtcccgaaattatccctaccaaactccacataaacggccttcagattagggaataattttggcaaaatatgcattggtaaggatccacagacattgcaaaatatttgagtgattgagggtaagtcattatgaggagaaaagctgatttgtgaaaatttacaaaacccaaaagtctgagatggagtatgagaagaccggattcaagactgttgcatttttcaatcgcccaagatggtaagtcggagtaattccagagttgttggtaatcctcttcttatttcttttgctctgttaattactctgattataatagaaatatcttttgattaacttagttttgcttcatgagaattatctcttggttagttcctaattagcatgcaggatcatcgttcactataatccagtaaaatatagtgattgctttagtgtgtagctaacattaaagtaagttattaactgcgtagacacagtgtctaggtagttgattttcggtgtttgctccgcatcccacggtaggtgtgaggtgggtgtagaggtggtgatagccctcgagatcactgaagtcctccctgtccgggtgcgtaatagagcgatatctgggagcggcgagctggccagtgcccgagcagtggttctacacgaaccgggtgacagttaacacctgggacagatgctccaccacgttcctctccaaataattcccaatgggcaaaactaacgcccttcgcgagagaatatcaagtttccagcagaccagggatgagacgtttcccgaagcgtggaaacgtctgcaggagtatggagccgcctgtcctcatcatgggatggatgactggctcatcctgtagagtttctacaatggactcactcccccgtccatggatcacctggatgctactacttcgggtgctttcttctcaaagactgatacgacccctgtagggggatgtcccgatcttcacggtgtaggatcaagaaccgataactagcctcaaagagaccaagataactagctgcaaacagccaagataacagtgcaacctaatgatcgtactcgaagccaaccaccgtctctattacggcaacttgaatcgagagtttttccaaccacactctaagttaccaaccaacacaacctggaatcaatcaaggaaaaacctcgaagggaccaggagcaccaattggggggcgtcgaacgccacttctataatctcacaaggaaatcacaagagcaaaggggtagagatctctctctgaatttgttagcacacagctgaacaaaaggggttcatattctcattgtcaaaagtcttccaaatgataaaacataggggatatttatactaggaaagcccctcctagatggggataaacatggcttttgaaattcaaggtaagtgggctagctcaagtgtctccatgagtcattcccgagcaggttcaatagagcctttcagcttttgtgcagcctccactaaaatagacattactctctaataggaagtcgaaacgatgagccgtttattggaagtgaaactagacttgattatctttcgaaccatatatattatgcatggaggaatttgactggctgggtcacacacccccttagaagttgaagcatctatgcataaccggtctgctcgttgtcgttaaccatctccacttgagtgagtgccactccatcttctgtgcaatacatctcatcctttatgcaatcattcattgttgtagtagcgaaatgatcctcggacataaaccttaaaaatgcaaatgtacaccatttagatagtataaaattctcatcaatagtaaaaaaccgatagcacatccatgactcgcatggaacatgaataattgaagccggaaacaaagaactaaattgaaaccatattgcacatccatggcaagcatggaacttgaattatttaaccataaccagaatccggaatattgatacaagaataacgtcgtaaacataagataaacttgaaatctaaatggcatgaacaaccgtttgaacataagcggtcacatatcacatagaaatataatggaaatagatagatagagcaaacaatccatgaatcacacaattaattcgtcatgcacttgccttttaacctcgacggcaacccgacagaccaccctccacaccagatatctccacacctatggagcaaaactacaaataaaccattatattcaactaatgatagttgcaagggatatttactaaaaccgaaacctagaacatagaaactttgactgatttgtattaaacaacctacagcaattctgttactgttttatacataactcacaaacagtctaacggaatctggcaaataatacaactccgatcatctagaaaaaaatgtctacaactttcatgatggacgaaaaatcagattaagcctctgaaggtcttagattaaggaaaaacgaattgatgtcctcgtttccagacccggccagcagtactgttgattcaaacctttatatctcgaaatatatacattttggaaatcgacagaacaagacctacaacttttatgtagaaagcatatttttattctgccatttagatggtctaatttgcgcttgaatgcaaacttcagaatctgcccaagaattcagactatccagactaaaacaaccataactggagttctactcgcccaatcaaagtgtactttaacaatatggaaagctaagaaaaacctctacaactttgtttataggcagcctgactaattccgctatttagcccctccgaaaacagttcaatctactactatctagattatgaaaaaaaaacaacagtcatactaaaaaaattcatatcgcctaaaccacttgagataaaataactccctttggtcaaaagatagatcactacatgatctacaacttttatatggacactttgatcagaataaatcattttgaccacgaaattgatggaaaacagaggcgctataaatcttcccacgcccagaactacccatccgaatcacaacgcccaaaacgcttctctaaccctcctcaaccacaaattgaaccactaaaaccaccctagaacaacggatacatcaaggggaaaagcctcacctagggtttgctccggagaacttgtgagattatgatgggaacgccaacccaccactcctcctgcttccctcgtcttcctcgatccgtttttccaatcagattcttgattagggctatggttcttggagatccatggagtagggttaccaggggagaaaagaatatgtgagttccattggtgccaagggggagggtgtggcggctagggccgcaggagcgatcccccccttttttatgttggttaaatagagaggctactaaagatcgaacgaaccacattaattcaatccccggaacttcgttcggactccgattactataagcttatagtctatttcgcactacatgatgagccctacgcatccacggttcctgatcgcctattcgaacaacggtttaaaagttgaacttttgcgcgtttgttctaatttttcccaaaatacactaactcgaaactcggggtattacaaatgttaacttgtatatgcatatttcccttcttgcatgtttcctttccttgcatatttcctttcatgcattgcatttataacttgaaaacaacataaaaatttgcaaaatagaaactaccaaaaaatataggatagattttattatgctaggtaagacaacctagttctccatgttgaaatgatgaatagttgctctgttttatatctttaatgtatgtgttcatagttaagtactatctcaagttttaagtgaaattagccaacaattatccgggaacctgagagatatgagttgcacattgcgcgatctaagcctaagttattgagagatatgagataatgaaatagagttgctataatcttgatccaagcttgatataaattcctgatgatttgttcttcaaaatgataaatttgaaagttcattatttgatataaattcctaccatagccaaatatagattttactattgaaaccttatacttggttgcttgtatttccattgaactttgtcaaatcttgtgacttgtgtagatgcttttcatactttatgatcaagatcatacacccacatatacacacatgctaagctcctacattggaagatagcatccatgtcatccaccatatccatgtcattatccacaaataagccctacattcattcttcctttccaaagaaaaatcctttgcaaaagcaaaagaaaaaggagggaaaggtatggctataaataaaaaataaaataaataataaactcttgctcttccaaaagtggagcatgatgaaaaaaaatatatagccatactctctctatgaaaactaaaggatattttggaggaaaagcataagcacaaaggagaagcattttctttatccacatgtcattttgtaccatatattccacacacactttgcatgatcttgatctaagtatgacttgctatatgctttaatctagatttttagcttagtgatatatgtgactacaagtatgcctcatttgatccttaccaagctccacatattcaaccttagtataggaatcaaaaggcaatttttttggtgatgaataaatattcaaccacttttgagtgattgagagaatcacttgaggaatatagttttaatttgcaaaatttttgaaaaccatccggaatgaaaattaagcagggagatagaaaatggtactctatgatttgttcaatttctcaatctcttaaggtggtgagaagcgtgttgtcacgcccagaaatttagcccaaatttctagactattttgtgtattaaatccctgtctaggaccagccagggtagacaaaacgacaagtaatatatagttccaaacgtacataaagcgtaaaatacttacaggagaggctcttagtcctcgcaccgaaaaggaacgacagcagcggaaaaaggcgatcctagcggggcttcagctccactccacaggcaaaactcaactggggtctgagccttgggcttctaactttatcttcaactcagaagcactacacttctgaaaaggggaataatagcaaggctgagtacaaccaccgtacttagcaagccacaccaacgatgcagacgtgcaaggggatacaaggatggcttgaggctatttgcataaaggcggttgtaaaacattttattgagcaaaacagtaaagctattgagtaattaaggtaacattaaatctccactgatcaacgctacaccgcgttgaacaggcccaaccaactcacctgaactacagtgcattgagtcgatttattaaggtgagactaatcacggtgaatctggtcgatcgcccataaccgcgggcacggctattcgaatagttttactctggccagaggtgcacaactgtacccacaagacacaatccaccggcatgtcaccgtgcccggccggacacgccaccatgtcgagtgattgtgacaagacccttcatataacccgctctgaccaagcacaccacacctcaggtttcacccccgcccccagcaggcagcgggcagtcccctctcctgcctagatgaatccggaagcgataaagaccgtcgcagggcccgccccgctccatcatgcccacccttgccaataccggcagaaaccctaaagcgagaagcagccgatagaggtaaattgatatgctaagactagattaacagagacatatgataaataggtagacaattatatcatccaaaccggagcaatccaagaggtcgaatgtactgatgcagccttgaacgatgctgatgtagattagacaattgcctgggccgacggaacattggacttaccctttagccggagattgaacactgatgcagccccgcgtcaggtgccaagtcccgccggatgataaaataaagtagaaaaggtaaaaggtggcgatgcgccgaattgtattgatcgtagcgatagattacatagacctagagtgtacatatttatacccatgggttgatacaagtccttgtcagacaagaaagaaactttcctaaagataaaaggaaaagataaagtccttataggacactaaacacacttttctaaagataaaaggaaactaacaaactattcctaattaatatataacttgccatgccgcattctctttgaactcggtcttttctggataagcttcctttagtagatcaatttccttaaccgaatatagcaagaatccgacaactgacgacatgacaactctcatcggctaatctcaggacttcgaagccgatgctgactctaagccgatgactactctgggcttaccaaatttcactgttaacaggcccgtcctccgcctactctttattctaaaaacaaacataactatcgttggaatttattttttattttctaaaagtcccatcaaccgtcagcggctctgcaactatactactatacacccgccggctgcttctcctttttattgtcattgacattttaaaaattgaatatgattatcattggggtttacttcttttttactttctagaagtcccggcaatcgccttcctcatttgcttcacggcctcctgttgtccctccttttaaacatcattaggattctattcggtgttttattaacaattttatatgttgtatcaacagccactgctctactcctctgtaggccatttacttaagttatctcgtcatgtgttttagatggtcttttctttcaatagtatttatttttatcacaaattttagctatttataaattgtattcctaattgaaatcttatttttccttttctagtttcataaattttttttcaaattttaattaatacgtattgtgctcttttaatatttttattttttattttcaatttcagttgtttcaaaattatattcctacttgaactcttttttaatttttctaattttgggtattattttatttttttctgaattttaattaatctcatattgggttcttatatggattatttttttaatattgcttatttttaattccgaatttcagctaattttaaattgtattcctacatgaactcttcttttattttatttttttggctaattttggattttattttatttttattatgaattttaattaatctcatattgggttcttatatggaaacttacttatttttaatttcgaattttagctatttttaaattgtattcctacttggactctccttttcttttctaattttggattttattttatttttattttgaattttgattaatctcgtattcggttcttatatggaaacttctttcaatattgcttatttttaattccgaattttaactatttttatattgtatttctacttggactctccttttcttttttttctgtttctctgattaatgtgggaatttttagcccccacagcgaacatggtacctcctttcaaagttattttaataatataatagatagatactcttctttatacatcttcggtactttgtttagtatgagtaatgttcttattttatatttgtgtcatattgattgtgtgggtagcctaccagagaggtgcgggtttaatgtctgatttatcagttgctctatgtcatgtgcacgggtgtagagtaatat

SEQ ID NO: 3270 - DNA, 4343 bp, Oryza sativa
ggtactgctttgtatttagccccggttggatgggcataacaggttgtcgtaaggaactcggcaacccatggtggtctctcgaagtaccaggaggacactgttagggggtattggccacacaattgtatactagcagatgtaaactaggatttgagtgtatatcagaagtataggaattgagtgctttctaattcttcttccacttagttagaattactttattatgaggatttgattagctttgtttcgtgtcactctacccctatatattaaacttaactcatacttagactttgacaattacaagtaatatatgtataaaatacgttagcaaagtccactcttattatcttcccttgggattaaaaatacgataccttagaatacttccgggtgaaatgctacaatggtatatccgtgcgctcgcggattacttctgtaatcataaatataccaggactatttctgacgccattgctgggaatgaatatctctagtaatatcgttaagaaatactaacagtgcactagatgctagaaagaaatggtgacatagtgatttatactggttcagcccctcgggatgaggtaataccctagtccagttgtttggtgcctaaccctccaggggtgttgccaatacccagaggatgcgatatcccttataatccgggtacctgccatccgtcatgatatgacggaataggtttctatctctctattctccgctacttatagtaacagattatataggcctgggcccatatcacgcaagagatccagcctccgagtaccatgatgggctatcctggtacgataacttccacacaaccatcggagggagcaaatatcacgagtgtatacagtcctcaacgaccaagggcgtccgcacgtggacgcagtcctcaacaacgtccgcatctggacgctataaggaagagcgtccttcctatttctttaattttgaaactatgtttactacttatttaattttagagttattaattattacaaattacaattaattttcttgttatccatcgatacgtaatgggcagtgcttcgaactttatttaaggaactgtctatatgagattcatatgattttttaggcttccatcatgcactgtctcaaccttcccatttatttaagcaaactctggaatgaattacattcgatgcacagcataacgtggcttagtaggtagggtatgtataaaggtagagtctaatataagctctctatactaattaatattactagagattatctataatagtagagacaataagatttctataaaccattaatgcaccaaatatttttattattatgcttatttccttttctccaccctcatgcaacaaattttccattaataaatgctaagagtcgactttgagctgttatcatgcgtagtaacgatgtttcccattacttccccctcattcttccacgtcactaaatttatttgaatgacaatgaagagagcccgttattagatactaccatttgtacatgccctaagcttatttatcgggaagcttatttatcgggaagactgtaagccttcttaggctgcgttcggagataactctttctctccgcacggaaaacggaatgatccattaacgcgtgattaattaagtatttgttaattttttttcaaaaatggattaatttgatttttttaagcaactttcgtatagaaattttttgcaaaaaaaacaccgtttagcagtttgaaaagcgtgcgcgtggaaaaagaaggagaagggttggaaaccctgagtagcaaacacagccttaattaatgtcaagttgttgtcctacaatactccctcggtccctcccacctatcgttgacctttgtgattactctatggtaatggcacactccaacactccattatattatcggtctgatgaggatgaggtgttagcttgttcgtctcacccatatcatttcttgttaggggagagaatcagatgctaaactgtgcgcttcaacggggatgatgaactcccttatacggaagctcgccactgtgtcgagcgaggacatcgatgtgagacccttggagaggaagatcatcagaattaactctgatcgcttgttgaaggtgatccatcatgtgggggacgcccaagccatggagtggatgcggcaaatcctggaggtggcctacgacgtggaggattggattgatctgtgcatccatctccatgggcgcgttagagcagatcaactggaacggatagaagaattcattgtccggatagacaacgtggaagaacgtctgagcaggtataatcttttatcatatattggacgaatttgaaccctattctgattatcctcctctgagccaatcacccatcggtgataatcctcacatgctctatgcgatggaggaagacttgatccatcactgtgaacggaaagtccggctgagaagggaccttgtcttgaatttgatggataagctggtggtggattccgaccagcagctgaaggtgcttttcattctcggggataggggtattggtaagactacactagccagccagatttatcatcgtacaattgaagaacgatttgattgccgagctttcgtttctgttggtcaatatagcctgtcagatcaaccatactgaactgtacatcaaatcaggcggcgatgagcaccaagtcattgataacttcaggaatttcctcagaaataagaggtaactgtttcacgacttgttttcaatcgggtcaaattttctcctttttttttctgctttctaaaattttctgcagttctaacaatgaaatcttaccgaagatttgggtttgtggggtgggtccgtgggtggtgctggactgctggtggtctgccggggtgggtgggggtggggtgaggggcggttatatgtgaggggatcatttttttctataacgcaacccatgtgtagtatagcatggatgtcagtgaatctagtcgagggatggagaggtcaaaacgccttataatgtgaaacggagagagtaattgatttttctctaacccttaacccaaaagcagccttatgttgataacctaaaccagtcttaaggaagcctccaacctcgcaatcaccgcgtgcttatctatcctatcagtgccatctcgatcatgcagtcctcactgccactacccacgctacttcaccaaccccaagcccccacttccctcttcagcccctcatggtcgccaccatcctcgatgccctagatggccagctcctaccagccaacattctggctcaagtcgccaccaccaccactggccagtactagggcattcctctcactaggcggagcttcacacgtgtcggcaacaccaggtccgcactctgcaagaacatgccaccacgttgagaccacactccttcaaggagctcgtcgcagcggaaactgttggatttcaaatcctctctgcgccatctaccagctcacaacgccttcaagacgacctttactcaccccagtcagagctcaacctgagcttctccccgcgcatcacctcagcaccagttctactccatggcctataaagctagcccggtgaaggggatggagatgcgacacatccaaggtactcctgccacggatgactttaattactccactcgaacctgtgtggcatcatgtaagagtgcgccattggtggcgtcgggcaacgcattcaagcgagctcgaccgcccaaattcaagttgatgggatctgaattcaaggcgaccctccccgctccttgacaacgccttctatggcccatgcccccaaatgccccccggctgatctccacgaatccccacgcctttcgaaacgtgcatctcatggaaaatgaggacaggatcacttggaaactaataaatcagaacaagtaaatggcagcgttggcctacaatgcacaattcctatgctcaagaaagtacaatttcaacgtcatcatctgaaaaccttgggcaccacgaaaatgcaagatcttcacatggttaatgattagacatgctctcaactaagggatagccaaacaactctctgtcccacctatgccaccgaacacaagagacggccctacaccttctagcggaatgtagatacataaggagagtatggggggcattagcagaatggataacatgtcatgacctaaaccccacccagtgggaatatgctacaatggtgtaggagtggtgggaggtaaccgcaaacatgagagaaatgccaaagcaagtagtccgcagcttaacactgctagtcaactgggagatttagaaggaaagaaatctgatgacctttcaatacaaggag

SEQ ID NO: 3271 - DNA, 1400 bp, Oryza sativa
ttctcgatgattggactaatcgctaaaaacaaggagaaggccaaaacgtaggccctagtggggcctagaatgttagccgattggctgcctagttcctagccaaccttctggtcctaattgtacattctttcttgctcctttttctttccgtataatttcctcccgttctatccaattttgctcatcgattcatttaaaaaaaacaaaagtaagaacagatcaaaattgtactaaaatctccaacaaaatcactctgcaacttcacgccataatatttttttctctatgacactgtgaaagaaagggggattgataaactcatattcaaaatatgtgaaaatgaaataaaaaaggattgtgattcacatcaaaagatgcaagaaccaccctatgcattttttttattttactcaaactgttgatgtttctgcacaatttggtgcctagccagatttaaaaaggttgaattggatttttataccaatcctaccatttgtcgcattacagctgcattttgtatacaactataacaatcaacatgcatcgctataatttgaattcactacaatttcagtgacatgtgattcaagtccacttaatctgaatctactcaaaggataaaaagtgaccagaaagtgcagagatgaatagtgtccgttttatagtttatggattttttaccaaagtggcataatacttagattttaacaagtcagattgaatttgatgtaaaataattgttctgttcattcacaagaataattatatattgtggttgtgggagagcaatataattattcctatactgatactttcatcaattcattaggtacttcattgtaattgatgatatttggactacaacggcatggaaggctatcaaatgtgctttcgctgacaacaaaaatggaagcagaataataacaacggcgcaaatcgacaaagtatccagattatcttacaggcatcacactgatttggtcgttatgcttgggggtctcagtgaggaggagtagagaatattatttgacaacataatatcagccagtcaaagatatttgttgcctcattatcagttacatattggatttaatgcacataatgatatgctaggatgcacgcctttggccataaggattgcagctggtctgtcactgtcagcatatcctcctccttattcatatacttcagctttcaagcaatatcccctcttacaagggataaaaagatgctgcacatcagttatgcttatctgtctttgccattgaagtcttgccttttgtacttgagtctctttccagaaaattgtaccatctcgaaaggtcggttgatacggaggtgggcagctgaaggttttattgatgaaagagatgaaggtagcatctgggaaacaggggaga

SEQ ID NO: 3272 - DNA, 2138 bp, Oryza sativa
aagtttttcaaaaggaccaaaatgtgaaaaatccagttttctggtgagctccagtacgggctcgttggggttatccttcactagtgatgtgatggcagcctcggcttcctccacatccacaacagtcgcgtcacgacagtcgacggtgacatggactcgcgtgagggaacggaagtcgcgcattccgaaatagttgccgtgaagccgaagtccattcgccctcaagtaaagcctgagccttcggaggcgcggcatggctgcaccccagaaccgtagcctgagccacccgtcatccaaacacctgaaccagaacacctctagactccgaaatccatcatcatatatgtctatgtggcagatcctttgtgcggaagacgccgaagtcaaattgagaacgataagactaggcattcttccgaggacttcgaaatcactttcgttcacctcaaaaacgctgatatgcaggtgggtgagttctctcatcccgacaaattctcctggtacccttatgaggttaccacgcaagacaattctcaactcaggtgttttatatcctccccaccgcaacagcagtatttcaagtagagcaattggacaatcaaaaaggaataggtacttaagtgtacctctgccgaggatgatgttgtcaatgaaagtttcaatactacttccataataactttaggatgttttactgtcaccatctcctggaccccactgtaatcccagcttcctcagcccatctttatctattatatctattatatactaaaagtccattaaactccctataaacgctctcaagctgccacgtggctccctcaaaacgctctcatattgccacgtggcactctaatataatagagaaatctgaccatcgattttcatttaaatcggtggacccattattttacatcgttagatctattttaaaaaccaaaaacctcccaccggccccaccacctctgtgcagtacgtgcatctgtttagtacttttttttttcgtttgttcctttcttttctttttccaatcctaattaaaattgaacctatctttatagaaaagaatacccccacaaatagacatcaaacgcgttaaaatccattaaatatcatataaatgtttctaaccgttgtgtgccactcttaaattagagaaacgtccaaccattggttttcactagaatcgatggacacattattttacgtcgttattagatctgtatattaactaaaagtccataaaactttctatgaacactcctaagtcgccacgtggcatcctagaaacgctcttaagccgccacatgccactccaatatataaccgttgatttcattatatttgatggacccattatttacaaccattaaatttatcttatagaaaaagttaaccacccaaacctaaccccacccagcgtacgtacttatatctcatatacaactacctactatatatgaaaataataataatatacctcatgtattattattattattacaccaccctcttcctagattaactcttccttctcatattttttacgctttattagttagaaagaaaaatcttctattatatactaaaagttcattaaacttcctacgaacgctcctcaattaccatgtggcatcctacaaaacgtttctaaaccgctacgtggcgttctaataaatcggtggatccgctatttgtttaataaattgctagactcactattttcaactattatatttatctttataaaaaaaaatcccacaacccaccccttctctcctcagtacgtatgtatgtacgtaatacaatgccatgctttctcccctcttccaatccttctcttcctatttctagatgaaaattttaacatgaaaaaatattataataaaacatctaacctttgcttttcacttaaatcgatcggtgaaccaactattttaaccattgtccctaaaaaaatattttaacgattatttaaaccggtgaacccattaatctatatataaaagaaacacttccctaaattttaccatagaacattgtgctttgcatgaaaagcaaatataaacaaacattaaaaccattagatttaggtatatagatggtttaaaccggtgaacctatcaaatctatatata

SEQ ID NO: 3273 - DNA, 771 bp, Oryza sativa
tcagtagagccattaattatatatggtttgtgtatgtaatgtcttttataacttaagttttttctctttcactatggaatcacaatttcctatgaggaattatccatagctatgaccaatcaatgtttgccgtcaaataataaattaattatcatttttttctaaaaaatgggtagagccattaattatatatggttgtatatgtaatgtcttttataacttaagttttctctctttccctgtggaacctcaagagtcatatgtcttaggtaccattttttataccgtaagataccaatcctaatctccaatagataattttataaataacaattaaattcgtcatgcaattctaacgaagaaaattcatgggaaaaaaacataattttaaaacattgcagatattaattcgctggtataccgcctttataagtttctcaaatttatcctacgtacggtgcatgcccgctcgtatgcgcgggctaccttcctagttcgacttaactagcagctctgagaccatgtcgagtgagcttctctcactgacatcgatcgtcgatacttcctccaggttttgcatagccgtcataccagcctgtgcttgcaaaccatctcccaggaggaacaccaatttctttagctcattcacggatacaggcaactgtttcacgcgggttctcctcacatctatggtctgcaactcatggagttctccaatgtcttcttggagctcggtgacaccggtccctctaaggcccaggtatctcagta

SEQ ID NO: 3274 - DNA, 185 bp, Oryza sativa
cccatgcctcatcgacggagccaccggcggcgtgctcacctacgccgacgtcgaccgcctgtcccgccgcctgccgccgcgctccgccgcgcgccgctggggctccggcggggcggcgtcgtgatgagcctgctgcggaactcgccggagttcgtgctgtccttcttcgccgcgtcgcgcgtcgg

SEQ ID NO: 3275 - DNA, 712 bp, Oryza sativa
cagctacttgcaatatgcagctgctaaatgtaatattgttgtgttgacatgttttgatatttatattaggcatacgacgaaacaaggaagtacttaaaaaaacggagctaggatacttgagtgcttttcatgactcatgggatcaaaatctagagttccctgatattagctatgaagacctcacctctgcaacaaacggtttccatgaaactaacatgcttggaaaaggtggttttggcaaagtatataaggtggtataaaattttaccttgtaaattacacaatgtgagtgtagcattcatgtcactttattcttgtttaacaccatgtctccatggtaatgaaataccacagggaacattggaagatggcatggaagttgctgttaaaaggcttaacaaggattctgagcaaggggtagagcaatttaggaatgaagtagttcttattgcaaaactgcagcataagaacctagttagacttcttggttgttgcattcatggagatgagaagttgcttatttatgaatacttacccaacaaaagcttagacaaattcctctttggtaagttttatcagatattaaatgaaaagcttgtttttcagaaaaggatgcattaaaaaaaagtcttgattttttttttttggaatgttcaccggaggggagaggttccccacctgaatttccattaagacaaagtgcatactctaa

SEQ ID NO: 3276 - DNA, 39774 bp, Oryza sativa
tggtatggcaaggatttttggaaacagtgaacagcaagcaagtactagacgagtcgttgggacctagtaagtggacttgttctctagccgactagttcaacatattcatgtgcttgaacttattcacttttttcctgcttgcttgcaaatgatttaaatagcggctacatggcacctgaatatgcaatggaaggcattttttcagtcaaatctgacacctatagctttggcgtattgctactggagattgtaagtggattaaagatcagctcccctcatcatattgtgatggattttccgaaccttatagcttatgtaagtgcatgctgctaccaatacttatgttaacaattcgaacacaatatagttaaaacaagttaagaaatctttactaatgttattactttcaggcatggaacttgtggaaagatggaatggcagaggctttcgtagacaaaatggttctggagagctgtttgcttaatgaagtattgcaatgcatccatattggactattgtgtgttcaggacagcccaaatgccaggccgcatatgtcattagttgtgtcgatgctggacaacgaggacatggcacgcccaataccgaagcagcctatatatttcgtgcaaaggcattacgacgaagaagaaagacaaggctcggaaagttccgttaataacgcgagcctgacagcgctagaaggccgctagactgtaagagattaaactctcaagcagtttctgcagttgtacattactacagtaggagctgaggtttatagatcttgtaaaagaatgcattgcataagcagattgatgtacccctaatccgatttgcaacatatgggtaaaaataaataagtggttccatgtgcaattcactcatgagatgttgaaaagaatgacttgcacaggcagttttgttgtgatttgatcacctgctatgcttgttcaggtctctgaaagtccatcttcgtttggcggaaggtctccaaaccaaagtgctcccgcagcaccgaaggactgaaaaaaaaagaagaagctgttgtgtgaatcttcagcgcctgtggttcctacttccaatgcaaatgatgtctcctcgtcgcttccaaatgggcaaatcggcaagagatttgggggcaaaaggatcaagggggtggtaaccaacctgccctgccacgatgtggtgaatccgtgatacgtctgctccccggacacgcggaaccactagctctctcgcctggcaacaccggcgctgacgccgccgccgcgccacctcgcgcgctcgcggtggcggacgaaccgccttcccggttggcgccgcccgctgccggctcggtggtcggtgccctcttctccgtcgtctgaactccacgcggaagggttttgtacctgcggcccaactgggtctgattcggccctgcgtacacggccacggatggattggcccacatatagcacccgcggcccatgtttaatccatgaagcccataaggccaggccggctgtttacagcccagcgctgccatggagcacgtcagcaagccgttgacgacacaaattctgtttattattaattttatttattgaaatattttttcaaatttctataatctacacccctaccacttttagcagaacgtttttttttgacgtggcacatattcattggtgcatgttaacggtcacatagaaagaggctgaagtagcattcttaccgccttattagaaggttatatgggattatatgtgaaatgatggctagagcattttgcaagcggccatttcacaacatctcaaaatatgtgacaaggggttgcctgtaaaataacattctcggttatttttgcaggtggcctccttatagtcttttgggaagatgtcaaggcaattgcttgcaaaatagccggcctctttttacgcggtatgccaacacccgtgtgccacgtcataaaaaaaataaaactctctcctagacgtcgttttttaggtgtagatttctaaaagttttctagaaaattattatgtaaatatttaaataaataaaattcaaaaaatcgacgacttgacgccatcaactcctgtgttgattagtgtacaaagtccccgtgtgtcccagcgtcatcacgctcacgcgcaacgttttgagactgaaattttcgttttctttgttgtttttgttcaggagagtcagcgaagatgtttcggacttcccgtgtgccaggcacaaccgcacaagttgcattacaacactgactacctgcctacctgctgcctctcggcattgcgtaacgcgccatggcggcgaccggccgacacacgcgcatgccgcgaggtttcgctctcttgccaacttttcacggtcgcgtctctctcgaaagtttaatcagctgaccctgatgtcgtagctacagtaattagtttgcggtttgacactgcgtcttcaccagaggggcagacaagtcccggtcaggcgttacttcgttggcccaccgtactaaattcactgttcagaaaagagtcgtgtatggattagtagcaaaaatcaaaggtgccaattgttcacgcttcatagccacaggcgagccaagaacaaggccatatgagatttaccagattatggcctgcctcccagttttcatctccttgctgttcctcatctcttcctgcaaaggcgatgaccagctcacacaggcaaatcgactgatctcccccggcgacgtactcatctccaaaggcagggtcttcgcgctcggcttcttctccccaacagcctccaaccagagcttcttcctcggcatatggtaccacaacatctccgagtccgagcgcacgtacgtttgggtcgccaaccgcgacaacccaatcaccaccccttcattcgcaacgctcgccatcagcaacagctctaaccttgtcctgtcggattccggcaatcacaccctttggacgacgaacgtcacggccaccggaggcgacggagcttacgcggcgctgctcgactcggggaacttggttctccggttgccgaatggtacaaccatatggcagagctttgatcacccaactgacacccttctgatgggcatgaggtttttggtgagctacaaggcacaagtcgccatgcggtgcatcgcttggaagggcccagatgacccctccaccggagacttctccatcagcggtgatcccagctcaaaccttcagatcttcctttggaacggtaccagaccatatatccgctttattggatttgggcctagcagcatgtggtcttcggtcttctcattcagtacctctctcatctacgaaacatcggtgagcacggatgatgagttctacatcatatacacaacctctgatggctcaccttacaagcgtcttcaactggactacacgggtaccttgaagttcctggcttggaacgacagcgcgtcgtcatggacagtcgtcgtccagcgcccatcacccaccatcgtgtgcgatccctacgcctcgtgtggtccattcggctactgcgacgcaacggcagccatcccgaggtgccaatgcctcgatgggtttgagcctgatggctccaactcttcttcgagaggatgccggaggaagcagcaattgagatgccgaggcagagatgatcgcttcgtgaccatggccggaatgaaggtccctgacaagttcttgcatgtccggaatagaagcttcgatgagtgcgcggccgagtgcagccgcaactgctcgtgcacggcctacgcttacgccaacttgaccggagccgaccaggcaaggtgcttgctttggtcaggggaacttgctgacactgggagggccaacattggtgagaatctgtacctccggttggccgactctactggtatgcccaatttctcttgccctgcggtgaaaataaagctcttaattagatagcctgctcatcgaattaaaagcaacatccatatatacacttgcaaggcatggtatagaatttctgaagaactgaatatgcagaggtcttgccaggccaagattttccacgaacaaaaaaatgttcactacttgataggactcttctgaagaaaacaaaaaaggaatatataccttctgttaaaggaaaaagaacatatatccaatgtgctactccatatcaacctcaaattttataatccgtgttctcttggtgggccgtattctgcagttaacaagaagaagagtgacatcccgaagatcgtacttccggttataacaagcctgttgatactcatgtgcatatgtcttgcgtggatatgcaaatcaagaggtaggccaacaccaactaagcttttcaggctgcattgtttctaaggtaacaatttatatgaaaggctttcctgccaggcatacaccgaagcaaggaaattcagaagaaacatagactacaacatttgaaggattccagtgaacttgagaatgacaatctagaacttccatttatttgcttagaagacattgtcactgcaacgaacaatttttctgatcacaacatgcttgggaaaggtggttttggaaaagtttacaaggtacaaaaggttttaccttggcaatttcagaagaaatatcttttatattctcttgttcaattgaaagagtgtgtgcttgtgcagggagtgttggaaggtggcaaggagattgcagtcaaaaggcttagtaagggttctcagcaaggtgtggaggagttcagaaatgaagtagttctgattgccaaattgcagcatagaaatttagttaggcttatcagttattgcattcacgaagatgagaagttactcatctacgaatacttgcctaataaaagcttggatactttcctttttggtacgttgttactcacttatttgtggtcgtataatacaaacattcttgaggatattcatggttaatgacaattaactttgtttcacattaatcttggaagatgctaaaagaaaatcagttctcgattggacgacccggttcatgataatcaaaggtatagcgagagggcttctttatttgcaccaagattcaaggttaacgataattcacagggatctcaaagcaagcaacatcttgttggacacaaatatgagtcccaaaatatcagattttgggatggcaaggatctttgaaggaaataagcaacaagaaaatactaccagagtagttgggacatagtaagtaacctgtagaccacctaatgatatatgttttcattataactaattcaaactgcacattacattgtttttggaatgatctaaacagcggttacatgtctcctgaatatgctttggaaggctccttttctgtcaagtctgacacctacagttttggggtgctactgttggagcttgtaagtggcttaaagatcagttcgccccatctcataatggatttccaaaatcttataaccttcgtaagtggactgcaatcctcaacattttaatcagtaaaacattgcaaaataaattgaccacaactttcttgtatatcttggttcaggcgtggagtttatggaaagatggaaatgcaatggatttggtggactcatcaattcgggagagttgtctacttcacgaagttttacgatgtattcaaatagcactttcatgtgttcaagatgacccaactgccaggccactcatgtcatccattgtgttcatgttagagaacgagacagctgctcttcctaccccaaaggagtctgcttatttgacagctagggtctatggaactaaagacactagagaaaacaaggaaagatctgtaaataacgtgagtatcacagcactagagggacgttaaatgtttattacaccattccctgtttagtctataaacttctgtagcttgtagttgtacacttatacattagcaattcaaatttatacacagaaaatgttctgagcaatacattgtaaccagcattttctttgttgcttggttgcataaaaggaatgcttccatacatccatatttcagaaacttaactatttctgctactgcagccttggcttgctctgaaatttgcagactaataaatgcaaatcgtttggccaaatcctatcatttgatagcattgcataggaaagaagcagtctgcttacaggtgacgagtttgaactttgaagggcatccgctgctgcgttgtccaaagcagcaaagcacgccggcgccgccttattcatggaaagccccaggccaaggcgaaacctgcacaccaccaccaaccaggaagcaatactctcaatcacaatccacattccacagtggagatctggataaaccctattaatcaatggcgcactggaactctcatggatctaaggcctgaagaaatacgcaccatctgcgttaacggaaccaatccccatccttccatgggagcgccgcccgacgggaagcagccgaggcggctgcgccgctgcggcattcaggattcgccaactgatcggtcttgcaagctatcgagcacgcgcaggcagatccggttccatccagcggcggcggcggcgacggcggcgacggcgacggcggcgatctctgacgaaagcgaagtggggtggatgtgacgggccgatttactgggccgcatggtgaggaaacggccacgatgaactttgcagctcagtatggatatgggcaagcccagattgattcggaagcaatggtttacgatccaattcatgtccgtgggccgaatccttcggcggcgagccggcgaagcttctcggtccgacaacctgtgcagccggcggcgcgccgccgccgccgccgccgccgcgcgcacagcctgcccaccatgcccgcccgccggtgcctccttgtccctccgcttcaacctccctcgccgacggccacgaccggggcctcgtcgggggactcgcgtcatgtccccttcgacggtgccctactcctacctccgccgccagggacctcccatcacagccgccggccgtctacggcgagatttccccggagacctaaggtccgcttcagtcgcctccgccgcgagctaaaaccgatggtgacttggtgagccagccagtttctcaatattccccccttttaactgtcatactcacacatgttcgatgaactttcgactttgtatttctggatggagatgtgccgatgtatttgacttactgtccctggtaatgaaattcaaggaaccttcactcagacggcattatgtagttgctggctcaagttgggcagacgatttgctggatggccaaatcatttgagtcaactttgttcagctggatgagaccgacccttgtttggcttgttgttcatagttcctaccaattgcgtgtcctcgctgataagagcttcctacaattggagggaagaattgcttccatgcttactcaaccttacacagaatagaaggcctaatgggcacggctttcgctaccgttttcgtactcgtgttcttgatttctttgtgcaaatcagatgatcagctaacacctgcaaagccactctaccctggtgacatgctaatctcggatggtggtgtttttgctcttggtttcttctccccaacaaactcaaatgctaccttatatgttggcatatggtaccacaagattcccaatcgcaccgtggtgtgggttgccaaccgtgacaacccaatcactgccccttcttctgccatgctcttcatctccaacagttctgaccttgtgttgtctgaatcgggaggccacactctttgggaagcaaggaacaacatcaccactggaggttctggagccacggtagttcttcttaattctggtaatttggtccttcgatctcctaaccacacaatcttgtggcagagctttgatcatttgactgataccatcctccctggcatgaagctcttgctgaaatacaatggccaggttgctcagcgcattgtttcttggaagggccctgatgatccatcaaccggcaacttttccctcagtggtgaccccaactcggatttccaggttttggtttggaatggaacaagtccatactggcgtagtggggcatggaatggtgcgttggtctctgctatgttccagagtaataccagctctgtgacataccagacaatcatcaacaaagggaatgagatatacatgatgtactctgtttctgatgactctcctagcatgcgcttgatgctcgactacacaggaacaataaagatgctgatctggaacagcaacttgtttgcatggtctgtgttattcagcaatccctcttatacttgcgaaagatatgcctcctgtggaccatttggttattgtgatgctgcggaggcattcccaacatgcaagtgccttgatggattcaagcctgatggtcttaacatttcaagaggatgtgtgagaaaggagcagatgaaatgtagctatggagatagtttcttgaccttgcctggcatgaaaacacctgacaagttcttgtacatcaggaacagaagccttgatgagtgcatggaagagtgcaggcacaactgctcttgcacagcatatgcttacgcgaacctgagcactgccagcatgatgggtgacacatcgaggtgcttggtttggatgggggagcttctagacctggcaaaggtcactggtggtggtgagaatctgtacctccggcttccgagcccaactggtactttttatcattccctgcccatcatatgcctctacattgtgattaatgcccatacttactccacttatgcactgttaagtattaattaatttgattacgcatttttttttatgctttttaacttgacccagagctttctaaactgttttataaagcattctttctgatctatgctttctaatccatttcatactgaatgggcaccttgctgaattaggcacttgttgctcttactctttagttgaggaagttatattaggaaagataatggtggtcacgaaacatagcctagtatattacgaccaattgttcagttgacaccgatttcagtaatttgttttttctagccgatgcatttcttggtcagtccagttcatgtaccattgacaggactcaaattggtatcctgctgcattagcaacttgtggcctatcttttggcgtgccacttctgctactatgggacccaatactctattgcccaatgtgtaaagatttgccaatttaccacttcctctgatgtttgcagacacactaaatctgcctgtaaaattcacaattcatctgaagtctgtagtagcatcaaatatggttaaaatgaaacattactaatagtaaagtgcatctagtccatgcacttgcaagcagcttatgaagagaacctgaaagtcccattctcttgtatggactatatttctgcagcagtcaagaaggagactgatgtagtgaagattgtccttccagttgtggctagcctactgatcctcacatgcatatgccttgtgtggatatgcaaatcaaggggtacaacaacactcacatcacttctcaaaatgcagtccatgtagttttgttagtaaaacaatttctatataatactgttcttgttaggcaaacagcgaagcaaggaaatccagaacaaaattatggtacaatacttgagtgcctcaaatgaacttggggctgaagatgtggattttccattcattgggtttgaagaggtcgtaattgcaacaaacaatttctccagttataatatgcttggaaaaggaggttttggcaaagtttacaaggtaaggagaagatatatcttgatatttcttttttttttaatgtcatagcttgacatttccagttaatatttggcttttacttgtttaattgaacatttggttgctcacatagggaattctggaaggtggcaaggaagtagctgttaaaaggctcagtaagggttctgggcaaggaatagaggagtttaggaatgaagtcgtccttattgcaagattgcagcacagaaatctagttaaacttgttggttgctgcattcatgaagatgaaaagttactgatctatgaatacttgccgaacaaaagcttggatgccttcctttttggtatgttctgatttccggccttatattaaatgattagtgaattagtaaaaatatatactgaatgatggctgacgatacactttgttcatgttaatattgggagatgctacaagaaaaacagtgcttgattggccaaaccggttcaaaataattaaaggggtagcaagagggcttctttatctccaccaagattcaagattaacaattattcatagagatctcaaagcaggcaatatcttgctggacgctgaaatgagtcccaaaatatcagatttcggcatggcacggatctttggtggaaaccagcaacaagcaaacaccacccgtgttgttgggacatagtaagtgatgcatgaattatctaatgcttaatgtgatcaaatttacatgtttactgattcaaacggtgcattcctcaccgcttaacaaacagtgggtacatgtctcctgaatatgcaatggaaggaatcttttctgtcaagtctgacatatatagctttggtattctacttttggagatcataagtggcttcaggatcagctcaccccatctcataatgggcttcccaaaccttatagcttatgtaagagcagcagaatgcttaatttcttcagctcaaacgatgcatacttttgtaactgattcttatattctgttggtgtagtcttggagcttatggaaagatggaaatgcaagggatttggtggactcgagcgttgtggagagttgtccactccatgaagttttgagatgtatccacatagcgctcttgtgcattcaggaccatccagatgataggccgctgatgtcatctgttgtgttcatgttagagaacaatactgcaccgctacctcaaccaaagcaacctatattttttgtgcacaaaaaacgcgcaactgaatatgcaagagagaatatggaaaattccgtgaatggcgtgagcattacagccttggaggggagatgaatgtttatatttgttttatccttgtctgtaaatttcggcattttctgcagctatgcgttattgtaggaatggtgattcattgcttctgcttttgaaacgaatataatccattatcaacaaattttgtatccgttgccaaatggacgacggacaattgtcctgacatctattgtagatcctagttatgtcagtgaaatgcaatcatcttattaagggcgcgtttggttggaggaaattgtttggatggtgggtgtcggagttttagaatgaattaggaaggagagtttgagagcaaaatctcaacttttcaatatgtgtttagtaacagttaatttggaggggattcccttcttaagtatgtcaggatatatctgaattgtatgtcatcacttgaactttaattcccactcaaactttgtatgattctcatctctactaccaagggacgagaaataaaaatgaaactcccaacttcctcctctaaactaccaatccctttttgttaagtcgccaaacatgccgtaagggttagctcagaatggaatggatggaaaacatcagtatagttccatcttctaatcttctatgccatttgtccattgcctgactgcaatctaaaacttgaacaagcccattcctgctgcatcggcccactcgtgggtacgggccgatttgtttggacccaagttgaagaaagggcccgtatagttagttattcgggcctacctttggagcggaatttaactatttgccacttttaggtttgccaattattcaaatatccctcttatgtttgtatttaataatttgtagaggtaattgcttaactatgtgccacttttgcttacgtgtcatgccaccgtacgtgccagcgtgaaaagcaacgtggacctcacccgtcagcccctctcctcaccttcttctctatctccggtcgccgcccacctcccaccggcccgcactgaccctgagccgtcgtcggccaccagcccgcgctcgcccatccccccgccagccccgctcgccccgcaccgttttttttgtccaccaccactactccttctggtctcccccgactccgatccgacgtgcctcgccgatccacgcgacagcggccggcgagctcgccgaagccatgccgagctcgccgaaggtcttctcctcggcaaccacctcccgccgcgccacgcttcgccgcctcctctccaccccggccttctccgccgcatgccttctctttggcctcgcgggcttcctcgccgatgcgctgtccatttgttggtcgccagggagcgcgccacgcgcctgctgccaggactcctcgcctgctcttcgtctctgtcgcgtggggccagcggccgacgacggcgcggggctggcgggaggtgggcgacgaccgaccggagatagagaaggagagcagaggggctgacgggtggggcccacgttactttccacgctggcacggtacagtggcacgtcacatatgcaaaaatagcaaatagttaagaaattacctctctccaatggcaaattattaagtgcaatatttggataattggcaaacctcaaaatggcaaatagttaaattcgggtcaagattggatcggtaccctatctgcctcttctcatgggccgaaaccgccgaatccctcgccgccggcggtctgctctccggcggctcgtcctccatctcctccgcttccctgacctcgcttcgcagccgccggccgtcacctcggtcgccgccgccgcggacaatcccgtcggatctactacaactgacggcgaccaacccgtctgtgtccatcacccatcgaggttaacgagaactcgtcgagatctcaaagcaaagcgaggaggagatctgacatggaagcacatgcttgactttcatcagagattcagaaaaaaagtgaataattttacagctgtgagcagtcggatttgagatgcagctgatagaaaccgttggaagtacaagggcttgacttccagtaaatgacaatgtcagcaagtgaggctcttgcaaatctctcagtatcaggaaggtaggaaagcccctttcaagtgaccatgacctgtaagatttcagagatctgctttcttcaacattgcagcctaactcagcccaatcatccacatttcatcactttgtcagcagaaaaagaaaatggcattcagcaatagtatcatattatagctacaaaaacattgtcttgctgatctttgttggatctgataggttcagttaacaggtggccgagactgagatgagtttgcagtgtagccttcttttgtcactgtcaggtactctcgcaagccggccatattgtgcattctggtggctagtcatgtaaaaatgttctaacagaattgagcatgcagagaaccaatgcagctatgtgagtctctgagctgacaatacagggcaaaggcaaaccggggaggcagatggtggatgcaatgcagatgtctagctcatggatttctaaatgttttggtaaataaagagaaaaagggtaatgctccttattgattgaccaaacttttatatatttttataatatatatcttctagatgtacatagtggttcagtaaggactgaattctattattgtgtttttgcgcatgatgttgaattgttcttgtctgctagctttacaggagttcgtcgcatttggtttaccatttcactaaggagaataacatgtatggttgtagctctcatacaagtgaaacttgaatcaaattccatgacagatacacatgatggttcactcagttctaagaaataaagggttcaaatagaattgtattcgtgcagtacaaatattaatggattgggtgaaaatcaactatttgacatatctccctctactttttggcactgaaattcttttgaagagcatttctgttgaattttgactctgtataccaaccatgaatcttggtaaaaagttcgttttgggggttaaaagctatggttttactcatgctatttgaaatttcaacaccctcaacagaaccagaattgtattggacatgtggtgcgttgaatttcttttgaagagcattggtgtgataaaaaaaagttcaattttctctggaaaaagggtaaaggcttcgctcatgcagtcactaatccacgcgtatggactcaactagaccataagggttggatgggagcgtatcctatgcacacatgccctcacgtgtacacaccatgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgttagattttttgttttttttgttacggctaaaatataatgaatttgacgttaagattttaaccctaggtgtaatacaattgaaagtatgtgtatgattttttctagatttttttgtgatattttttagttggtgtgcacgtgtgtacacgtgagggcctgtgtgcataggatatgttgccgggttggatatggtgcaatgctaccagcataagcatactggcatatatagaccagccagtcgaagttagcgtccctaacaagggggtcagtgggtaaaagagatatacggaattaccgaagtcagtagtcaagtcacaaaatggtaattataaaattattatatttgtgaaaatatttttcttgccaaattaaatggtttgcatttccatatatgataaatctaaccattctttgatataatactgagcaccgaaattataggaacttgacagcatacgtcaaaatatcttcctaatatgattttatcaatggatcaatttgcatttttcctatctttgttcatataataataaaatgcagtagatgagtagaatatgcccaagcagaagtgttcggcatgctgatatgcactacagaaatggaattgttaacctgaaagttctggaaataattaagcaaaagaaacacatgcacaaattcttgaagctctacttaatagcaaaacatgcggtcagatttaaaagagaagcaagcaaaaggtatcattaatcaaagagatggcacttttatttggtacaatcaacagagagaaacctgctacattacttaattgatccaccattgaatcgaaccatcaattctataacaaattcttccgcaactactcattgatacgatgcaacctagcaaccaatcataagaacctgatgatgatcagtacataattctgtcccctctcaactagccgattccttattctgtgatgaacctgaagaatgaatccaagtcttcaagcactcattccaaaggttcatctagctaactagctcagtgctttgctgattacagccacagcatcagtactactagggttacgaaattatcatcatacaactagtacgtagatacaatcaagaaacatcagatctcgatttgtgctagctaggcgactatattagcagctagctactcgatcgttaatttgacgcttctgatcagtgttcttcagttccaggacttgttcttctacctaataaagttggcaccaaatggagtccacagctcgacgggcacctcgctggcaacggcgaacgtgctcgatatcggcaccagacaaagcccccggcccttcagtgatatctcgccgtgcttggacttgtcaggacttgagttctgaaacgaaacaaatcaattgcagaagccatcatcagcactggcttgaacagagatgacacacacagatcgatcataagtacagtgatcgatcagaatgctgaaaaggagagcaagcatgcagcatccaacactggcaataccttcaagtggggcacttgatgggcaccgttcttcaagtatggagcactaagagcctgcagaaaacaaaacacaagacaatgttcaggtaacactgatcatcagtctctcttctctgaatctctgatgcatgattcatctgaagaaacgtgcgagttcgtgctccaggatgctataattaaaggtggggaatcatggtgtacttgcacacacttacaccaacttggtcgtgcaggaacttgatgtactcgatggtctcatggagcaccgatgcggtatccgtctgcacgcgcgcacatcgagaagagaataagattgtgttgttttgcatatagtgtatagatctcgaaaggaggaggagatcaaaaaggaagaactcttttgcacagaagatgttgatgcatagttccaagcactcttgttgtttgtaatatagtgcacattggccatcaaaagcctccctcacctttccaaaaggagagactagttgttggagcgctgtgatcctgtcccctagcttctccttcctaacctgaagtatattgcaatttgcacatacgaacaactttagtaaagatgcatctatatcgatctcttaaattgcatgacctatatattattgtgacatcaaataatgcagactgttttatactaattaaaccagattgagttcaactcatgatgcatagcagctagctatgtctctgtgagtatctatctaccttgaaggtcggcaatggcgacggtgtctcgagtctcggtttcttgaacgctgtctccttcttggtgatcactgagctagagtcccctactccttccatagcagtctacacgtatacacataacaaaacatcaatcacaatgccctaaaattaaagtagctaatgacagaactagctagctatcttgtatgcatgcatcatctatgtacaaacctttaatgcaagggttgctgccgcacgcggcggcgccggcgacgagcgtttggcagagcgaacgctagcttgatcttgcgccgccgccgccgccaccgccacagccgccggcatgccgaatccggcagaagggttccagaacggcgcgtcgttggtgaactggagtgaatccctggccccaactgcctgcgcgaacttggcagcagctgctggtgcgtgtcccatctgctgctggtactgatgatactgctggagtccagccaaagccggctgctgctgctgctgcttcgccgtcggctccatgaggctcctcagcagcgaggactggaatccgccgtacggcgacgtcggcgacaagagcaggtctgagccgaagctggacagcagctcgtggtggtgacctgcttgctgcagtgctaggttatttgatgagtgattcatcaagctcgacgcgctcatgtcatggtggccatcttgcagaaactcatgcagaccagcaccgttgttcctgatgaaacgtacacaaaatcgcatgcaaacatgtcaggatcgatctcagctaagctagctctccatatgatatggtagctagtacgagttaattaattggcttgtatatataactcacatgaaaggctgggtccagtcggtgaagccggcgagccccggctgcggcacggcggcgacggcggccgggtcggggatgctcgccggctcttggaaggtcaccgagctgttgttgccgggcgactccgacgacgccgtggtggtgctcttcgcctgcttgccgccgttgtcagctaccatgccatcgtatccagcggccagagccgacgaccaggcggtgtacccggcgagctccgtcgtcgtcgagcacgtcgccgccgccggtacccccaccgcgttgctccaccacacgccatgagagctcgtcgtaccaccgccgccgttgtacatcgccgccggagctgcgtgcatcatctgatgatcccccatgatcgacgaccacgacgatgtaataatctctatcctgaacctcgatcgatcctccgtttcttggctagctagtttcttcttgtggtggagagagctagcaagagagagtgagtgcttgcttggtgtgtgggtgatgagcaagttgcagtggtgaaggggaaagcgagctgaggagaagtagtggaaagatgtatagcttgtgtatatatatataaaccgtttggaaagaggggagatgagatcgaggaggagaattttggctgtctgaccacaccggagatgaggcgccggataaaccggccgggggtcgttgccggtcgtccggcattgcgtcaggttattctggtgcaactgatcatgatccagcggttgttcaacaacccacagagagttcagtactactactgcactaatggatgttagaagagcttaattccccttgggatatgtgtacttaatttagttatgtcagtagtatatgcatgcatgcataaatgtagtctatgcatggtagtcttagggttttgacatgccctagctagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgtgggccggcacggcacggcacggctactgtagcgggccggcacggcacggcccgcggcacggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcagttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacacagttgggagtacgatcccatggttgctcgggaatctcttgtccggttaatcgccaggcaagatttacccctgaactttggggagtcccctgcttttgaacattacattcagcaatctcataaccctaggtttaaaactgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaataatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagatgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattactttttttaaacattttatttccatttttaatttttttttccttatacatttcctttgctttttttttaaaaaaaaacactgtgcactgcaggctggcgggctggcggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgctgaaacgggccgtgccggaaccgtgcccgtgccgggccgggccgtgccgcccgtttggacacctatagccctagctgcttgtgtactactgtaaaaaaaatgtaccagctttgttttttgtctggtaattaattagttggatcataattgtcgttcctcagaaagagcatctgtaagaaatgtagggggggtggatgtgtgcagtgtaactcatataggaatatagattatattattcctttggaattaattaaaaggagattagacaaaaaagaaaattccctttatttgtgccaaacatatcacatctagctatactgttgtgctatgtctagaaattcctacctccatttctttcttttttttattttacgatgttccagtagtggtagcacacactagtactagctagacatgccatttgtcagcaattttgagattctcttatatttattttttttggggggtacacaatattaatatcacttcaataattgattaattgatagcaatatgcatgcatgcttttcacgatagaatcaggataaatatgtcgaatcagtttaaattaatgtcttattatccttctgcaaataaaacaagcagtgaaagactagcgaataaattctatgtaatcaaaggcattgacctctcaaaagaagtcttagcgatagcaacagaaacaaataaaaattagaacgattagagggaatgtttgatgatatcacctaaccgtaaaggggtaatgagctgcggcacctaattcccggcctgtaccaagaagtcttgtttgtgtgtaccatagtcttcatcaattgctctaatctaactctctacgaattactttctcgttggtaattattgttaatcttcccatcaactttagtttattgtatagcatttcacactagaagataaactcaacgtcacaatctaaacacaaattacacacgtaccctctgacctctacaaattatattttatttgcacgcctgctgtcattgtagtatatatatgatgttgcgctaattaaatcatgtagtacttgagtggcatgcagaatgatatgcacatatactgattgttatattgtaagactaaacgacttattaattaaagcgggtatgtgtgaaagtcatttttcctatgggacgtccctcttttttatgtcacctaaaaagcggtttttttaaaaaaaatagatatatatatatatatatatataaattcacgaacatatagatttaaatttaatttttatatacaagttttaaaaataaaaaatgtgactgtgaatctcgcgcacttctcacagagtcacatccatatatacaagttgagattatctcctatcactactggagaaacccacgtcactcccagttcgaaacaccttttaatcctggatatgttaccgggatgcccaatccggaattaaagatgtccatttttagtcccgattcaaataactgggtttaaagataaatctttagtacctattggtgttacaaaccggaactaaagttttttttccttttttttcattgtatttttgttgtcagcatattgatttcacgccgaactcaccaacgtcacaaattcacagctaaactcaccaacatcacaaaattcacggatcaaaatgactacacgaattcatagaacattgacattactaattcacatgctcaacaaacaacacaagtccacacatcacaaaaccaacaatccgcacatcgacatcagcgttgccgacgacccctccgcccgctcggccgccgcctatgccaccctcccttccacctgcccgcccgggcaccgcctcccttccaccgaggagtgtgcggttgaatttttttttcaatctttggtcctggttggtataaataaccgggactaaatgttaatctttagttccggttggtgggactaaagatagtaaggcctgatgactttttaaaccggaactaaaaatgttatcaaccaggactaagatcaaaaaattcccttcagctttttaacagggactataaagataatcttagtcccggttcttattcgaaccgttttttagcgatccaacaaagattaattctctagtagtgtattagttgcctgaaaacatgcgtatgtgtgtaagaagtgaagatagaagagtgacagatcaaaataaatcaaagaacaatacacctctgtcccaagtacagtcgtagcatataacttcgcaaattacaaacttaatgagaagtaaattaatctcatacgtactcatatcagtttcgtttggaaaagcagattgtgatagaggaacaagaacccctcatgtcgcgttaggcatgcatcggccggcgatttgtcttggattcttatgattctgcctttctcctttttggatttttgtccatgtattatattctctctcagagttcagacctgcaggtcgacagtcaatgcgtatttgtactcttcgacgtttttgtttttcctcgccgctcgctcctggcacacatatacatccaatcaggacgttagatgcatggcacggtgcaatatggccaaattaagcgtgcatccgcccatcatgcatagtcaacacattattcttctacttatggtcaggaaaccatcgtattcgccgtagtacatagagagatcctctgaatgaagagactggttattgttctagctgtgagttcacgccaaaattgaaagtttggttgaaattgaaacgatgtgacagaaaagttagaagtttatgtgtgtagaaaagttttgatgtgatgaaaaaattggaagtttgaagaaatatttcggaactaaacacggcgctagtactattaaaattttgaaatgaaggcaagggcataagtcataattgagtactagttggtaatttagagtactcagcagatatataattaatgtactttctccttaaacgtaaattcttcatctggtttgcattttagcagcgttgctggacggctgatcttctccagaagcgtgatattgatagcactcagcctgccccttttgcacacagaatcttgagatggcgaaccacaccctcttcaactgtgtattcgctcgacagatctagcaccacatgttgtcgccctctggctaggttgccctccccccgtgacagctcgcttcaggtctagtggctgtcttctagggtctgcttatctaagcatcttcgcgccaacttcgactccccggtccttctcgtctcttggtagctatggaaggagtggaactctagggtattcgactctgcgctctcctcggtctcagtagttctggagtctatcctctcggagggtcgtatactcgtatgtggtcttctgctggtgttgctgcttttgggggcttattaggagtgtggtatggttctgcctccaccctcccgctgatcggagtagccttttccgtagtagtttttttttctttcctttacctggttgtagcttttgtttttttctccctccccccataggcatgtctgactgattgagttgtataacaaaaactcttctaatatattgacatgcaatgagcattcgcgaaagaaaagttactttctgctacaccataactaaggccagtgatcctatgcagtcgtctaggctcgtcgatttgtgactgataataatagacatgcgatgtcaatataatcagctaatattacttagatgatacccctgtaatttactacggaataaattttttaatgcattgctttgcccatatgttttaaattacatatttatcaaaatacttaacatatgtttacaattaaatagataatctgtcgtaataatttactcgacaatctgtttcaaacaaaatcttggaatattgtaaaagatgataatatatatgtttcaaacagaatcttagaatcttttctagacagacggtggccggcctaggctacaacacacggcgggcggcggaccggcggtacagcttaggcaattagttagccatagtagccagtttaagcgattgaagaatgaagaccccgggcgttgacgtcacgcttatgactgcggcggcgaaggcgtcaaaagcgcggggcccgattgggtcgcacgcgtgcccggaaaaagccagccgcccactcaccctccatcccgccttgccaagccacacaccacaaacgccacccgttctcattctctctcgcgcacacacgcacgcacgcatgcacctgcaactctgaacaacgcacggcactccactgctgctgctactactcgcttagccgatcgaccgatcgatcgatcggaacgccgagtcaaaaggcgggacagggacagcatcctcctctgaaatctgaatcgcggcgtccagcgacacaccacgccgtgtccctccctccccgtggccgggggccagcgacgtcgctgccacgtatcgacgaagctttgaccgcccgatcggaatgattggggtttggaatggaggtcaactttcgattcattccgttttttttcccctatcgagtgctgggggtgtttttttcagaggtgaaattactagtttatgttcagaggttgatctctttcctcctcccctgcctgcctgacttgatcgagtagtagtgatacttcaccggtaattcgcactttgcagaacctggagatgatgacagcagtagtagtagtagtaatctcgatcgatctcttggatgcgttttcgttgaaggattggttattagcacaaggtgggatggtagcttgacccataactacaaatatatagtattattatcatgctcgtgcatggtttgtgttagaagcgtgcaatcaatttcctcttgcgaacacttacttatcctgcctgtaactttatactcgaatttaccatttttgctagccacaaacatatatacagattttaatttatagagtctaatgttttgttggtggagtcgtccagtcgtagatggcaagctacgctacgctacgctgtcccccctgccactgccgtgccacccagggcacgaggtctcccgaaaccgaccgacctgccgctcgctcgctcgcgcccgcgcgccggctagaatggtccggctgccggtgtgcgaaacacggcggcgtgcgcgtgcgcgcggggcggcgtacgtacgtggacacgcacgccgcgcgctcgatcgccacggcaacctgtacacgcgacgagtcctccgctggctagtgcgcaccgcaacatcgcggagcaaaccagacgcgcgtgcgtgcgcgcggccgcgcgatcgatcgagggttcccggcctgtaacacgtgcctccgaaaccgacgaggccagcgacgacgtcgacgctgacccaagacccaaacccaacccggccgcggcgtcggtttcggaggggtaggaagtagcagtagcgccggcatccgtcgcgtcaggaaaagcacacgctctgcgacacggatcgttgacgtgttggccggtttaggctgggcgttgacacggccgggctaaggacagtaggacacacgagggcatctttgggctattaggctgagacaaatgctagtttcctactagctgtttgattcctgggtcgcagtgggtcaacctgttcgtcaaagtgtgctctgactttagaattagatcgacacgctcggagtctactcagtttgtcccgacagctgccgggacggttgggttgggcacggatcgattggagcttagctaagttgggtgagtgatctggcatcttgttttaatttcggcgtaactgtatggtaatgtagtgtggccgtacgtgagatcgatctagcaagcttgtgatctctgcgcctaacacacgtggttaggacagtggacagataacccaaccaagcaagaggtcaaccatacgtctgatgatgcttttaataacccatatatgcacgggattgttcacgagactgatctcatcacagtgggaacacatgctattgagacaaaacaagtgtacgccgtgttaatgatcttgaactcttaatgatgaggctacattctcagtactacttacctaacaaaacccactgtctagtgacaatatatactggtgcgcgcccgttacgtcataaacaaacaaacactatcctgtccataattaaaggcaataaaacaacaggttttgtgatgaataattgaatgcatttctatgttgtgaattcacttactttaatgatgtactcactctgtgtatgtgaaaccaaggaaaactctccatctgttttgttaccctttcttcagcagagtcaacactcgatggaccccgaaaactgctgcacatgccaacagttcaggtgggctctgacgaaagcccaaaggcccgcggattcgctatctgtctcgctgaccggctgggcccaccaaccccccatcgtgattgtgttaggtataccgggccagctgatgggcctgtcaagccagtgtctatcgcattcatagcctgggtgggcgggtcaaaccctttttgacccccggctacttcgatcgttttcacaactctccttttccttttgtcctgcgaaaaaaaatttcttgtcgagtcaccttcggattattgcatcagtttcctgtgtgcattctttcctcgtcgctgacgaaaccattgcgtagatcgcaacaagaactaattaggcaaaacttagtgtacattcgttttcagtttctgtgtttgacttagacgtttaattagcaacaggtaagagtattttctctgcattgtcgtccatggcaagcatgcgatgatctgtgaaaagtagccgggatggcgtcggatcatcccggccgtgatggtcgccggcggccggggccaagctgctagctagctccgatgtccctacctgacaatatatatcaaccgacttgatgaatgccctggtgactactgacaatgggaatatacttggtggtgcttagcttattgggcactaccagcagcatgatcacagaaagggcacttccacacacaaaaaaaaatgttttactgtatatatgattgcgtttcgtgacgagttcctgcacaatgagatgtacatagttctgtactttccatgcattatacactggggcagctgtatatggagccttggacaccactacatcagaagatgggatcattcttgaaatgattcctttgacgcgcgttgtatacaatgttgacaaattaagcatttatattttgcttcacatcattgtgcacaggaacctgctatagtaccctgttacctaggtcttcactgatcaagagtactactgtatatgcaccaagccgccagttgctccttaacctagagagcgtgtgggactgcaatattttcggtgatgaaaacgtagaagccagcacagcacgggggcgtcaggttcatgtatggaccgaccaggtgaggacccaactaattggatgccccatatcattagctatagcactactgcactaacacagtagcagtagtccaggtatgaaaactgtgaactggcgcccgagctttatgtgaattattaggcagcgttcagatagtcagagtgctcataagatcacccagaagactttcttgaaaagaaagtagagatcatacgatgacacgtcttctttcacaagtgaagataaaaccacaaatgtgttcgcaactttcaaggaatctcaagtgaggcgtcagagggatcccccggggcatggcgaaatggcccggactgttgcctgttggcgccatgtgcgcgctacagcctttgcgaatttagtagatcgaatcatcgaacgggattcgattactgcatgctggtctgggtcgatctctgggagaggctctgggctaaccaccgaaaggaggaagcctttgcagcgagacatatggctcaatcagctcctccattaccctgcagtgcatggatgtccccgcagcaacaatgccacggatcatcaggcccgcacgcatactcatttcagtgcaaaaagggcttcagccttcagctggcttttcacgaaatatttcgtggctaactggcaggtccttggatagaccatgtgaggccggtttggctgttcaatggagcatcctgtttagctaggacttggatttagggcctgatcggaactgctatctgctgctgccgctatggctgtggctgtttttcagctgctgccgctgcagccatttttagctcttgcagccacggttgctgcagcagcaagcagtatcgatcacacccttaattccagcaatgctgtgccgtacgacggtacgaggtacgagcaggtcagcgggtcaccggtgttgtgtgaagctaagctgtattcactagctcgggatagttggcacaaacggcatgaaaatgtggcgccgtaaataagtgaaatacagctgcgaactttttgaacacgctgcaaacatgcgacggagaaaactcaatgcaaaacgaaaaaaaaaattgggagcctgtcagacaacctgagagccatcctggccaagcgaggcccggcaaggaacgatcctctacagccgtgggatcgaatcagccagtgacatgatccggccgttaatcacgctctggcccacaggtcatgcgtcatcaaccaagcttgagtgcttgcctccttattagtcaaggatgcaacggtacgagcctatagaacagatcctgttcaagtaaggtcgtgccatggatcatctgcacaactcttttaaaccagctttgatctatgtggatagccgaggtggtactaatactagtctttgttgtcctccaattgcgtaatgggccggcccatactgcaatacatgtcctgaaaggcttcatggcccactacgaaatgcttttctcctacagtttatcttactccttcacatagccatcacgtggttaaaaactccacctgtaaacattagtagatggaaattgtatccaatagtgtactgtcgtactgatccgtgcccaaactgatgataatgcaatttaacatgggggtttatgtttctgaggacccagctgatgtgatcagggccttgacataatcatgaaagatgctgtaatttaatttcgtccaagtctggacctgcatagcagtcttcagggcaatccctttgataaaattttacacaatgtcacatcgaatgtttggatacatgcttagagtattaaatataaacgaaaaaataattaatcacatagattgtgtgtaaattacgaaacgaatcttttaagcctaatcgcgccatgatttaataatgtggtgctacaataaacatttgctaatgattgatttattagacttaataaattcatctcggggcgaattctgtaatttattttgttattatactacatttaatactttaaatatgcgtccgtatattcgatgtggtatgtcaaatctaaacatagccttagtagtaccactatgtatgctcacttaatttcactagttaggatttgtcttttttagacggagggagtacgttgttgagatcttgtacctcagatttgttgtgtatatgcatgatgtgactaaaacaccttaattatcagtccaatgctccgtagcatgaacttggatttccatttattacgaggtagtccaaatgatcaatgtgagcagcagaagtatcaattgatgaatgatcaatgtgagcagcagaagtatcaattgatgaaggataataacacactatgattacaaaaatctacaaattactgtttggattgtcatgcggatgacttgggcttgtcaaagattttactgttagtaattcaggcttctcctaaatattgaaaaaacggcctaattaatggagtggtgaagataactgaaaaaaaaaatgatgcctgtcagacaacctatgggccaaccctgaccaagcgaaagcccggcaaggaacgatcctctacagccgcgggatcaattcacacggaaatgatccgggccgtcaatcacgctctggcccacaggtcatgcgtcatcaaccaagcttgagtgcttgcctccttattagtcaaggatgcaacggtacgagcctatagaacagatcctgttcaagtaaggtcgtgcttagcggtcaaaggttttgcattttaagctagattcatttcttgaagacttccgaggtggtactatgtttggcaaatgacgccctcccatgttttgttttgtattgtctcaaactctaggtctgtgcacatggttgtcatgtactgggctgctgggccttccttcctaaaatgaacccaggccttcggctacaccatggagccgtagaaagtggaaacatggttagtggtaaaaacagttacagaaattcttaaccaaccaaaataaactagtaatttgcccatgctaacgctacggcgatatctagcaaattttctacttaaaaattattttactatttcgaggtccaaatttatttaaatattattatcacaaaccggagtagctctcagtatgaaagttcaagtcgcaatcaagagaagtaatctgttcactattatttttctacttctacatgcataaacaaatatcaattaaaggttttctatttttttcatcaataatcaccatttgtatcacaattctctatccagcatttaagaaaggtttaaaaatatgtatggctatttttggaaatatcatatttgatagagaacctccgtccgtcgctcctccgttggcctcttcctgtcccagcgacagtacgccgtcgatcttcttcagcgagccggcatgtctgaatgccaccccaccgccaccccggttgatgctcgggccaagctttccgcctccgacggcgcccccgtcaaggatccgaccgagtacaggagccttgcaggcactctgcagtacctcactctcactcggccagagctcgcctatgctgttcagtaagtctgcctcttcatgcatgatccacgggagccccaccttgccttggtcaagtgcattctgcgcttacgtcaaaggctctctccaccggactccacatcagcaccggccctgtcaagtctctgacggcttattctaatgccgactgggccagctgtcccgactcccggcgctccacctccggatactacgtcttcctcggcgacaatccgatctcttggtcttccaagcgtcagacgactgtctcccggtctagcgcggaggctgagtaccgcgctgttgctcacgccgtcgccgaatgctgctggcttcgacagcttctccaggagcttcatgctcccatcgcctctgcaaccgttgtttacggtgacaacgtcagcgctgtctacatgacggccaatccggtgcatcatcgtcgtacgaagcacattgagatcgacattcacttcgttcgggagaaggtggctctaagacaggtccatgtgctccatgtaccgtcgtcccatcagttcaccgatatcatgaccaaggggctgcttgtgcagttgttcactgatttcaggtccaatctttgcattcgtgatcctcctgttgtgactgcgggcgggcattaggaatgtatagccatatatgtataggattcttttgtatccttagcttccttgtatactcctctaaggatcttgtatattggaaagactataatatatggtcacccccctcattggggagagtggtgttctctcctattctctttacaatatatatgttaatgaatctagacacacattaacatatatatatcaatgtgggcaatgctagaaaatcttataacctaaaacggaggcagtaatatatttgttcagaaataacgaaatgctctattctcattcatcaaaagttgcaagtaacgattgtggttacgctgttatacccaaattaattaataatggactaaaaagctatggttatcctttaaaatgatttagtagagcgtgtacacatagatggtaacattatctgcaaacgatatatgtaactcgttttccctaaataaataattttaattaagtacaaagacatagaattaaaatttttatgcaattaagcaagagatctgctggttgcctgggcatataaaaggctaaaacaggttagtgcatactgtgttggagtcatgattgtcaatacacatagaaaggagattcatggactgaattgcttgctccaagtatagacaagcatatgaatcagctccattttagaccagaaaatagtgcactatgcatctcgaaacatatgaaagcccctcattcttttttttttccgggttgaaagcctctcattcttcattgttaagataatgttgtgctgcttttatactgaataaggtgtgtagatcaacgtcagcttacagttgaataggacttagcaaattggtaaatgatccaagttaatgagctagttttgcaatttgcagtacattcagttattcagacgatcgcacccgaacttgcagccatatatagtacgccaaaagaaaatccgaatctcattctgttggacatacctggtccaaatcgaatttctagaaactaatctagacagcaatgagcatttgtttcttttgcaaggacccatgaacaacttacagaaagggcatatcaaacattaaagtatcaaagtaagattaatactattgttttagactaatagagctttgatagccacccatcaagaggtacaaggcaatctatgaattaagaagacctaaattataaaacaagaaacacatatatattacatccaaatcaaggtctccaaaatactgctacgtacttatttgcaaatgcatatccacatgggaaaaaaaaacgtgaacagtgatttgacaaactgatatttgcactaagttaagatagacaaggttcggcaaaaccctgatcaatctagtttgtgaaattaatctgaattatttctctaaaaaaattaatctgaattctgaagctctttatacaaggagcagatcatgatgatatatgccatagacaaatcactacttgcagtgcttctcccctacttacatactcatttactcacacagaactcaacacttcctgaagactgcacagatcaatattcatgtttctcaattctgaacattaccgatcgatttgactttcttaccggaaccatcatacagttttgtagaagtgattttagcaggtatagacaagcacgatataagctagcacatcaaatggtttggtctaaaagattttaccatgtcccagcagcggaacagcacctcgccatggttcgtgtggaagcccagtgggcgtaccttgacaccaagcatcactgacagaacagatcaggaacatgtaatgggaaggatgccacgatccctcagcatatcaacgaattaaatcaagattacagcaaaagctcatattaaaagttgttggcctataccccataatacaaatgaaatgtacattcagactttagtaaagtgccacaactccataatttggttaagctatcccatttgcagacatatcaacaaaaagaacgccacaagtctcatctatggcaacccgggcggctaggaaattttgcatgcaacatcaagaatcaggtaaatttgagataaatgtacctgaccttatccgcaaattccactgctgaagcattatgattttgaaattgcaagatcaaattagtggaagagcaagcagcagccgaccagggacgaaatgtggtggggcgttgcgatctattgaccggcgagttgggtagacagagaaccgcttatggcagccgaccggttacggcgatcggtgcagaagggtgcaaacgatttgtgggttgggttggagtctgggcttgggcattgcgcttgaccctcgccccattctctagcaacagatcaatagggaaaggaggcgctatcggctgtatcggtgacggcgaccaacagattttgacggtctctccatggtcatcggcaaaggacttgcacgtggcatggtgggcagagagggaaacgagggtgtcgtcgcttcgagtgagggcgacctaggcgcaaaaattcgcgagacaatgaggaattgaggaggcgcaatctgtagcgtggaagacgggaaggaaaggggaggaagaatcgcgtggaagacgggagtcgggttggggttatggtgcgaggtgggaggtggagatgacatggagcgttggatttcacagggatgatctcaaccgttgagtgatgaatgtaagagtgtaagagtgaaagatgagtaaaacaagttggtgaattatagggtagatcagcaggtagccagttagcaattccttttattttactggtcgagttatatggaaagggttaccgacaaaaatgaaaacggaaacaattttgctgttatattttactgtttctaaatgcgccatcatatatatgatctaattctttactcaacccatagtctatagtatcgtcaattcatcaatcaaacccctaatctattgttgaaagaaagacaaattgtaatttacatagtgtaactttgattttatttcatcagaacatatagctatgcaaattgaattgtgatttttatggtcaatgtttctgatatttcttaccggttttccgttgataatcatccgtagtatcagttgtttttttttatattttcgataccgttttctttccagtatttatgttttgaattccgtcttcgagaaaatatagtgatggatacgattgaaacgttttctggccgttttcatccgtagatacagtgttgcctcgttcacaggtgtacacctagcttggagctctctcgcacttgctgcattcaaaagcaaaagcaaggtattattacgtctccaagttgcgccgttgcggcacatctgcatctgtattttcggtggtatacactagtcctacattggtacagaacgtgccaatcaatcactcgctctgcattccctctacggtctaccactctaccggcatacgtatagtactactgcgacctgtccagctgtgtagctggcaaaagaaagacaagccgagagagtttggctaaagcgaaaactaggctggtcccttcagaacaaagtgagcatgcaaaagagggatcaaggcgaaggcaagagcatcatctcgtgaccatctcagctgtttcagtattctgattctactgacccgtgatgaggaggggcaaggcaaaagcctggtcagtcctagtactagtactgatcgatgccttatctcttcggactctctcgtcctgcaccccaaacagtgagatctgtaatagtaataatgtacgagtcgatcaaatggaccacaggtttattgtacctctcggtacacctcttcttattactcggttgatctctgaattaaagccatcaatacatcagtgatctttcagatggcattcattgatttttcaccgtgaggaggaccaaatgaatgaatgatggcattgggcatttgcatttcgatttgaagttaaaagtgagcatcgtccagatcggaagactgaagaaatgcagcagcagcagaacagcagtggaagccgagtaacaattttttacagatacacccccacagagacacagaattacgatgaactaccatcacctaagttcatctgagataaactacctgccatttgatttgctaaccaagaaagaaaccagcagttccatccatcgatccatcctaaccggcgacgagatcgacggtcaccgtccggcgcactccggcggctggacggggaagcggtcggtgtcgacgcagtagtcgtagacgaggtggtgcgcgcgcgcccacacgagctggtggttctggtgcacggtgagctcctccatgtccttctccttccaccagtacctcccctccttgccccacgagctccccgtgcaccgcgccacctcgccggcgtccgagtccgtggcgttcgccgcccacgcgcaaccctcgacgcggacgtcgcggaacgtggccacgaacggcgcgtgcgaccagtccgtcttcacccgcccgccctgcgtcgcccagtcgtccgcgttccagatggagctgtacaccgacatcggctgcggcgacgggaacggcggcacggacgccgccgccgatgtggcgttgctggtgccattggcggcggcggcgtggcggtggtggcccttgacggcggcggtggcgttcttgttctcgtagacgcggatgggggtgtcgtcgacgaggaagacgacctggctggggttccagagcacggcgtaggtgtggaagtcggcggtggggtcgaaccacaggtcgatgcgctgctcccggttgccgacgccgtcgatgtacaggttggtctgcaccaggtacggctcgccggtgacgttgcccaggaactcgaagtcgaactcgttgtgcttgtccccgccggacgacagctgcaagccaaattcagctaaatttagttttaactccagttaattaagtaatggattaatcgggggtgattagtgaaaagcggccatctttaaagaacgttgtcctattgctgcacgagttcacgtgccgctgttctttgtaaattgattcttggcagcttcccccgacagacatggtcaagcatgtccccaacactgcctcgaaaaacgtttgtactgtatttactacagtagtgcatactactaatggtgtcatttaccccagttaatcttgtttaagctaatgcaggatgaagaatcaataatggcaggttcgaagcagatggaggaaagcgtagcgaagcacagagcacagcctgatgcactcactcacatagaaagcagtgacaactccggcggaatcccccgccacgagcttcaggtcggcggtcgccttgccgtacaggaacttgctcttcgacgcgaacccgccgcctgcatccacaacacaaaacattctggtcatctgtcccccaaatgcagatcgagaacatcttcacccattcaccacaaaaacttcaacggcgaagacgatgaacagttgaacacgtaccggacgagctgtcgaggcggagcttgaggaggtcgccctcgtacacgacgtggtcgttggcccagctcggctccaccacgtcgtcgaacttgcccgccgccgccacaccggcggcgcacaccaccgccaccaccaccaccacgacggccagagacgccattgtcactgctcacttgctgtgctgttcgatcgactcgactgatgggctcaatctcaagctgaagctgggtgcgatgtttatataggcgagacgtttggcttacggtggaagggtggcacgtgacacgagggcgccacgtcggaggccaagctagccgttgggcaacgggggacccacgcgtcaggagatagggaccagtggtcagtctagcgctctactactactacagtctgcgtgcacagctcagctgctgtggatttctccaacttttgcggctttgttcacagcgagctttcagcacgcttgggcctctttagttccccaaatttttttcccaaaaacattatatcgaatctttggatatatgcatgaagcattaaatatagataaaaagaaaaactaattgcacagttatgaaggaaatcgcgagacgaatcttttaagcctaattagtccgtgattagccataagcgctacagtaaccacatgtgctaatgacggcttaattagtctcaaaagattcgtctcgcggtttccaggcgagttctgaaattagttttttcattcgtgtccaaaaaccccttccaacatccggtcaaacgttcaatatgacacccaaaaatttccttttccccatctaaacacaccctttctttctttctttctctcgctgagctacgcggctactggccacagccgctgtgaccagtcggggaaagaattgtttctgcctcgcttgctcttgcttgctcagcacag

SEQ ID NO: 3277 - DNA, 689 bp, Oryza sativa
  unsure (1)..(689): unsure at all n locations
catctcaattgttgctttctccggcatcctgaagaagaattggagccaacaggctcaaacccatcgaggcattggcaacttgggacggccgacggggaaaaagggggggttccgccaagtaaaagggccccccccccggggaaaaaaattttgggnggncncncacacgnnaagccataaaggtatcgcagccaggggcccttgggagttgatttgcgacagtccatgaggacaagctgctgttccaactcatgaacctaaagttgcccatgtagtcaatcatgacgcgcgtgtatggtgaatcatcagagattgtgtacttgaggtaaaactcatccttagtgttcacgactgttttatagacaaaagaggtgctgttgtgcaagtatgttgcaccggacaccgagacactatcaaacagaatgaaacggtaatatgcgccccntctngggttctcggtgcgccagaaatgaagatctgaaagtttgacgtgggatcgccgctgaaggagaaatccccggtggatgggtcatctgggcccttccaagcgatgaaccgcatggcgacttgtccgtaggatctcactaaaaacttcatgttgggcagaatggtatcagttggttgatcaaagctttgccatatggttgtattgttcgatagccgaagaaccaaatttcctgggggtgcag

SEQ ID NO: 3278 - DNA, 681 bp, Oryza sativa
  unsure (1)..(681): unsure at all n locations
attcctgcagccctatcaagaaaaagaacgccacaagtctcatctatggcaacccgggcggctaggaaattttgcatgcaacatcaagaatcaggtaaatttgagataaatgtacctgaccttatccgcaaattccactgctgaagcattatgattttgaaattgcaagatcaaattagtggaagagcaagcagcagccgaccagggacgaaatgtggtgggcgttgcgaatctaatttggnaaccccggcgagttgggtagacagagaaccgcttatggcagccgaccggttacggcgatcggtgcagaagggtgcaaacgatttgtgggttgggttggagtctgggcttgggcattgcgcttgaccctcgccccattctctagcaacagatcaatagggaaaggaggcgctatcggctgtatcggtgacggcgaccaacagattttgacggtctctccatggtcatcggcaaaggacttgcacgtggcatggtgggcagagagggggaaacgaggggggtgttcggttttcccgggccccttttttttttccccgcaaaggttgaagggggccccgaaaacccccccccagcgaaaaattcgcgagacaatgaggaattgaggaggcgcaatctgtagcgtggaagacgggaaggaaaggggaggaagaatcgcgtgga

SEQ ID NO: 3279 - DNA, 681 bp, Oryza sativa
attcctgcaccccaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacacccggctccgcatttggcaaaaaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcatttaattactttttccctttaatttccccctttttttttttccccaaaaggcccctatggtttttttttcccctttttccccctgatgtgagacatctattaacctaagccctaaactctcttttgtaattgccaatcatcatcaacaaaatgaacaactacgctaagataatc

SEQ ID NO: 3280 - DNA, 1068 bp, Oryza sativa
  unsure (1)..(1068): unsure at all n locations
caaagaaggcttaccgtgatgatacgtggccgcgcattatcttctcatccatcagcccttttctcggcttaccgtgatacaggcagagcagcctttttttttcccaaattggggccaatttgggggggtttttaaaaaaaaaaaaaaaangnagaantgcaaatgngcagataaagtgaggataccgtacgttgcccttgaccccaagaaaaggatatcgtaataggatggcatcaccataaatgtcatgctgtttattcttagaaaatgcagttaaaggagaattctatggtttatcattgacaaacgctcgaatctggtttctcattagggaacatgagtcgtacagtgtatatgcaatcctactattgttttcctttccttaaccagatttattgtacctagacagggtgggtcgaccgatccagctacacaatgacgaagccaggatttagagataggggtggtggcacgagacgtaagaactcatcaacgcctcggtagacaatgatgtgaatcttggtggcttaaatcctgcagagtggcagattggcctcacgcccagtcgacttttgttcgctctaatatacgtagtcgcccctcgtataattatattttgaattttgtggttatttgtcgtttgcactaatatatacataaaatgattgttgatatgattttttttatatatttcaacacattcttctagattcatatataaaattgaacttattttaggatggagagtgtatgtccgagtctgaatgtactttaggggctgttcagatttatgccatttttagccataccattttttgggtaaagttgttaaaaaagtgcctacgtttagtttgttgccaaactttggtaaatacataagaaatcctgccaaanaaattttgtgggaaaatatttttttaaaaatttttcccaaaaaaaaaacccttttggcccggcccaaaaaaaatttgggccaaaatttggtaaggtttattttggctacaatcagaacatacccttaatatagcataaaaagaaccaattttaaactatgtcactaaatagcac

SEQ ID NO: 3281 - DNA, 11651 bp, Oryza sativa
  unsure (1)..(11651): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggagatagtaacctggtggtcgtgttcaaaaacaggcatgctaaatttagactaccaccttcactagattcttttttctttctgttgagtttgaagtgtgtcctatcaacacaagtgaacaaaattcaggactgctaatctaagagctattctatcgtcgcaggggaaaaagggtgggcataccagtagaatcggccaaccggaggtacaggttctcagcaatggtgttcctgatgtccctccacgcgtcggcaagctcccctgtccaaagcaaacaccttggctggttggacatggtgccggttgcggtcaagttggtgtaggcgtaggccgtgcacgagcagttgcgggtacactcgtccgtgcactcgtcgaagtttctgttctggacatgcaagaacttgtcaggaaccttcattctagacatgatcacaaaatggtcatctccacatctcaattgttgctttctccggcatcctgaagaagaattggagccaacaggctcaaacccatcgaggcattggcaacttgggacggccgacgtgaggtcgcagtagccgaatgggccacacgagccataggtatcgcagccaggggcccttgggagttgatttgcgacagtccatgaggacaagctgctgttccaactcatgaacctaaagttgcccatgtagtcaatcatgacgcgcgtgtatggtgaatcatcagagattgtgtacttgaggtaaaactcatccttagtgttcacgactgttttatagacaaaagaggtgctgttgtgcaagtatgttgcaccggacaccgagacactatcaaacagaatgaaacggtaatatggccttgtctcgtgccagatgaagatctgaaagtttgacgtgggatcgccgctgaaggagaaatccccggtggatgggtcatctgggcccttccaagcgatgaaccgcatggcgacttgtccgtaggatctcactaaaaacttcatgttgggcagaatggtatcagttggttgatcaaagctttgccatatggttgtattgttcgatagccgaagaaccaaatttcctgagtcgagcagcaccgcgtaaactccgtcgtcttcggtgacaatactgttgggacttgccatcgtcgtccatagggtgcggcctttggaatctgacaatacaagagcagaattgttgctgatggagagcgtcgcggatgaagatgcagcgatcgggtcgtcgcggttggcaacccaaacataggtgcgctcggagatattgtgataccatataccaaggaataagctctggttggaggtggccggggagaagaatccgagcgcaaagtctccacctttggagatgagcatgtcgctaggagagattagtcgcttcgcatgtctcaactggtcatcgcatctgcagaaagagattagtagtagcaagtggatgaaaactgggaggttgtggctcaggcaggccatatttgttctgccttgtttcttcgcttagctgcgagcctgcgaagcacgaagcacacagaaatatacattgttatcattcagtatatatgttactgacgtacgtatacattgtttccagaatcttgagaccgaaggaactaggaagcgacgtgtatgcagatacttttttgtccgtcatatcgggatgaaacacaaaggaaattaggaaaacctgtacgttcaaaaacctactagacagaaaaacccagcacaacaggctgcgttctcaacagattacggattactaacgacggatgaaaatgactttattgactataaatcgagagtacaaacggaaaatattaaaaagttgccgtgcaaactaaaactttagaaataaaatatgaaccaaagtataatttgctctgggcaattaaaaggctgactagcagctgagtccatagacgagcaaggtggtgcaacctgcaaagaaggcttaccgtgatgatacgtggccgcgcattatcttctcatccatcagcccttttctcggcttaccgtgatacagggcagagcatcttcatggccatggtaaaaagagatgcatggcagataagtgaggataccgtacgttgcccttgaccccaagaaaaggatatcgtaataggatggcatcaccataaatgtcatgctgtttattcttagaaaatgcagttaaaggagaattctatggtttatcattgacaaacgctcgaatctggtttctcattagggaacatgagtcgtacagtgtatatgcaatcctactattgttttcctttccttaaccagatttattgtacctagacagggtgggtcgaccgatccagctacacaatgacgaagccaggatttagagataggggtggtggcacgagacgtaagaactcatcaacgcctcggtagacaatgatgtgaatcttggtggcttaaatcctgcagagtggcagattggcctcacgcccagtcgacttttgttcgctctaatatacgtagtcgcccctcgtataattatattttgaattttgtggttatttgtcgtttgcactaatatatacataaaatgattgttgatatgattttttttatatatttcaacacattcttctagattcatatataaaattgaacttattttaggatggagagtgtatgtccgagtctgaatgtactttaggggctgttcagatttatgccatttttagccataccattttttgggtaaagttgttaaaaaagtgcctacgtttagtttgttgccaaactttggtaaatacataagaaatcctgccaaaattttgggaatattatcaacttgccgccaatgccaaaatttggtaaggtttattttggctacaatcagaacatacccttaatatagcataaaaagaaccaattttaaactatgtcactaaatagcaccaactttactcaatacttgaatgacacgacatcatttctattcatcctttttagttttggagacttgcaaccacatcgctttgatatgttaattaactcaggtggacagctagatataggctcaacttgcaactaattaatgagctaattgtatggattagatggataatcacccgaggtttgcatgcagcgcatgcatggggatgggggtgggggtgggggtgccaggtacttcggcactgcagctacgacctgtgtcggcctacatttccaagaccccctacctctttatagtagtcatttttttcaaacctcagttttataaagaggtccatcgcagcgaaatttaaccgtcgatactcgatcgaacggtgggggaggagagaaaggagacacgtggcatattttcagaggcgcaaaacttgatttctgagacgccacgtggcccaatctttggctagggttagaaccctataatcggtattagagattagataggcactgcacctttgagaggtgtgcaagttcaacagagacctgccgcgcttcttcccttgatgccgtctgctccctgcttaaccgccaccgcctgcatcctcgatccggcctccacgtcctggccggcggccgctcgctctcctgcctcgccgcgccttcgcctgcaacatctccgccacctcagtagcggatcgggaattcgggaggaacggcctccacctcggatgggccgccccagtgccggctcggtggcctctactctacggctgggctggctccggcgggcctataattagtccatcaacgatcctgtgatttaatccatgaagcctataaggaaatgaacgagcaccacctccagcatcatcgagatgggccgagtatttacagcccaactctaccattgactacctgctgaggaaataagttcactttaggtccctctatttgtcggtcagtccgattttcgtcccttgaccgcaagaccgggtacgacccgtcccccaacttacgaaaccgggtaaacgaggtccctcggcagtatggagggcggttttggccgacgtggctcctttgactaggtcttcatcccacgtggcgttgacgtggcgcttacgtggtaattttatcccgaaaaaataataaaaaccgtaggacccacatgtcagatacatgtaaaaataatttaaaaaggtagtgcccatgtggtcctacatgtcagcctccctcttctctctatcccctctctccctctcccatacactgcaagcctgcaaggagaagggcgagcggtggcggacggtggccttgctcccggtctccgcgggcgccgccaacgacatcggcgctagggctgtcaacgagccgagctcgagcgagcttgcctgcctatgctcgagctcgatataagctcgaactaagcctgtttgagctcgatcaagctcgagctcgactatcgagctcgatttttaattagaacaatgtatatttcaaaggataatttttaaaaaaatttaatttattgtttatcatattagtataagaggaaaaagaataaaataaacatacgatgctaatacaaggcatacaaataacatatttgatctaccaatttattaaatagcaataaaaaatcatatattactaggctcgttagaagctcgagctcggctcgacaaagctcacgagctttgggacagctcgggctcggctcgtttggagctcgagccgagctcgaatcgagcctaggacgagtcgagctcgagcagctcgcgagtctcgagcttttttgacagccctaatggccgcggtggcggcggcaacgtgtgacgacaccgtcggggagtgcgacgtggacgatgaggaggaggtggaggagatggcgttgatgggggcggccggcgccgccgccggggagaccggttgtcgcacgttgcagcggaggctgctcgattacctcgccgcgcgccccgagtggcggaggtccggcgggagggaccacgtcgtgctcgcgcaccaccccaacgggatgctcgacgcgcgctacaagctctggccatgcgtcttcgtgctctgcgacttcgggaggtacccgcccagcgtcgttggcctcgacaaggacgtcatcgcgccgtaccggcacgtcgtccccaacttcgctggccaacgactccgccggctacgatgaccggccgacgctgctctacttccagggcgccatttacaggaaagatgtgaatgccttgttacttactgtactctttaaaagattcttaggttcaggccaataatataatgcatgctaccactttggcttgtatagatcgagctgagagagaaactgaagattttttttggcagcagtagcagttgctcacgtacgctttggatagagtcgatatgtacatacacatatgagagcagcgtattcactgccgccgccggcaacggcagtgacgccggcgaaggaagagggagatcagttggtgttgcgagcgcatcgggtgatggcggagcagccgcggcggtaggggttgccggccttctgtgaggcgcagttctggtagtaggactgaccgcgcttattgcacgacaccttgttggcgtccagcaccgcgtagctcacctaccagttcgtcggccgccgcatcagcgtctccccggcggcggcggcggcggccgcccccatcaacgccatctcctccacctcctgctcgtcgtccacgtcgcactccctgacggtgccgtcgcacgtctccaccgccgccgccatctgccaccgccccgacgccaccacgcccatgtcgtcggtagcgcccgcggccaggagcaacgtccaccgaccgccgccgctcgtccttctccttcagcgtaagggagagggatagaggggatagagaggaggaggctgacatgtggaaccacatggccccaccttttttaattatttttatatgtagctgacatgtagccatatgggttctacggtttttattattttttgggataaaattgccacgtaagcgccaccttaacactatgtgggatgaagatctagttaaaggagccacgtaggcgccacgtcggcaaaaaccgtcctctatactgccaagggatctcgtttgtccggttttcgtaagttggggaatgggtcgtatccggttttgcggccaagagacgaaaatcggaccaaccgacaaatagagggacctaaagtgaacttattccacctgctgagtgctgagcaagagcatgagattacttcgccatggcaaggacaaaagcatatctgcatatgccgcgaggtttcgctgccgtcgacttttctcgatctctatcgagagttcagttttgtagcgatagtttatcttttcggcttttgacggaagaaaataggtctcggcgacagattgttcttttttttttcttcaccagatttttgtcacatgttatttactcccacgctcgatcttcttttttttcaaatagtttggatcatttattctaagctatttgttctatgtaaaataatctattttaatagcccgtgcaaaaatcatatgtgttgtctcagttttccaaatatgtgtttatagaggtgagtgtgtgaacgttatactgtgttttaaaaaaacatatatattgtaggccagctatttgctctaaactattttgtgttaagctacctgtactaagttattttgtttttttaatgtttcttaacgaaaaatgaggtatgtaactaggacttcccatgaggtctcgtcaactatagacttgttggctgacgggtggttagtacagcgctaccgatgccatgaaatggaatttggttaatcgtggagtgaggtcgatgtcatgacgcagatcatcaacgtgccgcgttcaactctcagatcattttggtcttctggcttatttggaaacaacgttaatgcaaaaatcttccaatctgaatccaatacgcctctggagtctggaggttagaagatcaagaaggaattttgcgtctcgcctgactgctgatttctatttttttttgagcggaacatatattccatttacttattactgatacggccaaatcgccctgattgctgatttctttgtttcataccggtttgataatacttttcgttttggataagggcacggtctctaaaaaacaactttgaccattatttttcattataatatgtataaaattgttaacaaatatacgattatattaaagtactttttaagactaatctatacatatagtcaccatatttaaaagacaaatattttaaaaatgatttataatcaaagattataaagtttgactacacccttatccaaaacgacaagtattatcagcctggagggagtagtaaactttcagaaattaactagagatttctccttttgctgtaaccgtttttaacaggatctattgtacttgttggcagccttgttttattagttacagttgtactgttctggccaggttcttttgccgtcccgggaaaggtaaaaaaggaaaaaggaaaaaaaaataacagtataacggtttcgctctcgttgattttctcgtcgtatccgaacttcgttttcgctttgcgcgtgcatcctgatctggaaggacagaaatgtcttggccgtatgtttgctttcttcggtccaaccatgctctaagactatgggaaatcatctagtatgcatctgataattggatacatatgctctatttcttcacatttacatttttgaaggcaactaggaaacagaagaacaagacctaatgagatttagagccaaagtatggaaggaaaaggaagatgaatgcaagaaccttggtggttggtgtggcaggaacggaacagaagaatttccaacaccaaagccagagggagaagcaaaagtagctgcccaattgtgcaggagttaaatcagatagagcttagcagagcttagcctggtaatttcaagagctacgagagcagttctcctttttatcagatgtacatcttcttttccagttgcctcgcctctcctcgggctcttcttttgtaagactctgtgtctttttaatcgcataatctaattttgattttgcagagctcctgccttgcttgtccaaaaaagaagaacaagggccagatgaatatggcctacctcccagttctcatctacttgctgctcatctctttctgcaaatgcgatgatcagctgacacaggtaaatcgattgatctcccccagcggcaagctcgtctccaagagcggcgtctttgcactcggtttcttctccccagccacttccaaccagagcttattcctcggcatatggtataacaacatcccagagcgaacatacgtttgggttgctaaccgtgacaacccaatcaccacaccttcatcagcgatgctcgccatcagcaatagttctgaccttgtattgtcagattccaaaggtcgcaccgtctggacgacaatggcaaatgtcaccggaggtgacggagcttatgcagtgctgctcgactcaggaaacttggttctccggctgtcaaacaatgtaaccatatggcaaagtttcgatcacccaactgacaccattctgtcgaacatgaagattctgctgaggtacaaggagcaagtaggcatgcggcttgtagcttggaagggccttgatgatccaacaacgggggacttctcatgcagcggagaccccagctcagaccttcaggtcttcgtctggcacgggaccaagccatattaccgctccattgtgcttgacagtgtgtgggtgtccggcaaagcatatggcagcagcacctccttcatgtaccaaacatatgtaaacacacaggatgagttctatgttatctacaccacctctgatggctcaccatacatgcgcatcatgcttgactacacgggcaccttcaggctcctgagttggaacgtcaactcgtcatcatgggcaatctattctcaacgcccagcagccattggcgattgtgatccctacggctcgtgtggcccattcggttactgtgacttcacgtcggtcatcccaagatgccagtgcccggatggatttgagcctaacggctccaactcttcaagtggatgccggagaaagcaacaattaagatgtggagaagggaaccatttcatgaccatgcctggaatgaagctccctgacaagttcttttatgtccaggacagaagctttgaggagtgcgcggctgagtgtagccgaaactgctcatgcacggcctatgcttacaccaacttgaccataaccggctctcccggtaccacagccagccagtcaaggtgcttgctttgggttggtgagcttgttgacatggcgaggaacaatcttggtgacaacttgtacctccggttggccgactctccaggtatgcccaccttttatccctgtggtgacaaatgacaataaagatcttagatagcctgaacatccaattaaaagcaacatccatgcatatacctgcaatctatggttagaaattctgaaagcttcttcatttctcttaataggtcataaaaagagcaggtatgtagtcaaggttgtagtccccattatagcatgcgtgctaatgctcacgtgcatataccttgtctggaaatggatatcaaaaggtacagcaggagccaatactcaacaccgactcatatcatgttttcctcctgtaattgtacttatgatattgatgttcctattaggtgaaaagagaaataatgaaaatcagaatagagcgatgctaggaaactttagagcttctcatgaagtatatgagcaaaatcaggaattcccatgtattaattttgaagatgttgtcactgcaacaaacaattttagtgattcaaatatgcttggagaaggaggtttcggcaaggtttataaggtaacaatttacacagacaaacgcaacagtggagaaacctacaacattttatcatgctaaaatgatgttattatacagggcaagttgggaggtggcaaagaaattgcggttaaaagactcagtacaggttccacacagggattagagcattttacaaatgaagtggtccttattgccaaattgcagcacaaaaatcttgttaggcttcttggttgctgcattcatggagatgaaaagctccttatttatgaatacttaccaaacaaaagcttggatcacttcctttttggtactgttcagaaacttaccacatgatccagatataattggctgaatgcttactaattagcattattcaccattgttgatagatccagcaagtaaatttattcttgattggccaacaaggttcaagataatcaaaggagtagctagaggacttctttatctccaccaagattcaaggttaactataattcatagagatctcaaaacaagcaacatcttgttggatgcggatatgagtcctaagatatcggattttggtatggcaagaatctttggcggaaaccagcaagaagcaaatactaaccgagttgttggaacatagtgagtgatttatgtgttagtgtttagaatgatatttatttcctttcctgaaacaatatttgttacttattgctaaaactgttaagcagcggttacatgtctcctgaatacgcaatggatggggtcttttcagtcaagtctgacatatatagctttggtgttatactcttggagattgtaagcggtttgaagattagcttacctcagctgatggattttcccaacttgttggcctatgtaagtacggtgaaatgatctatcttcatataatgcaaactttttttcttttttttttgccgggtcggccgaaggaaccggcgaccaaatttcattaagattgggaggaatataatgcaaactaactgtactgattttatatggaccctattctattggttcaggcatggagattatggaaggatgataagaccatggatttggtggactcatccattgctgagagttgctcaaaaaacgaggttttactatgtatccacataggcctgttgtgcgtgcaagataatccaaatagtaggccactcatgtcttctgttgttttcatgttggagaacgaacaggcagcacttcccgctccaatacaacctgtgtattttgcacatagggcctctgaaaccaaacaaacaggggaaaataccagcagctctaataataacatgagtctcacggtattagagggacggtagatgtttatgttacctattttctgcatagaaagcatttagattttaccacttctgtaattagtttgttcttttccataaaatattagaaacaaagggcagatgttacattttttttggatgagttttttcttttatcatggcccttgagatggtatttttaatgtgcaggtattacaaaataacagtagataatgtggttctcgatacactgtcctgcaaaagaatcgcaacatatttttaccatcaattcattaaactattctaagttggatgtatacagtttaaaagttgggaagttataaaatactccctccgtttcacaatgtaagttat

SEQ ID NO: 3282 - DNA, 5528 bp, Oryza sativa
ggagcttggcgccacgacttgtaaccccgtgagggccgccgtcttcccccctcagccggctgccgtggcgtccgccgctacttctccaaatgcttcagccgagagcgattccccctaggctggcaaacttcctgtcgatgccgtctgctccctcgcgtggcagcacccgcgttgacgccacccgacgcgggctcgccggccatggccatggccgcagccactcgctctcctcccgccgcgcggcgccgctcccgtgccgccggcggccgccgccgcacgggattgggtcaaatcaggccgcatgtacgggagactcctggtccaatgggctagtgggccgtactgagttattgaggcccataaatacgaggccccagacggctcaaggcctaccaggtcggcacataaaacgagaaagtcattagtttaagattagtcaagttttaattactagtatgaattagaaaattaaatttatttgtggttttagaaaaacctttgtatagaaagttttctcataaaacatatccttaagcagtttcgaaacgtaatagtgaaaatcgagatagaatctacatcttaatcggaaaataacagggttcacgcgggctttttgaatgaggcgagatgttaatcagatgatcactacgctccttgcttttctgcgcgatatgattctgaaccacttaagtacagtagtactagcatttagcacgacttcacggatctttagctaggtcaaacgaagtttaataaagctatcgtcactttaccagcagttttcaacagcacgactatgatagggatgtgttgtggacttatcactttgatgaattatggtttccttttcttggggtcgagggcaacagtatccctcacttatgtttccattcatctctcttttgaccattgccatgaagatgctttaccctggctatcacgacggagagtacaccatgcatgttatatgcagtcacgaatcatccatgattccatggacagccaatcttctttgcagtttgcattaccatgcaactcacccatatggattcatctagctagtcaatcatgggatattactgtactacctccgtctcagaaagatcatagtttcacgttatttatgttcaacgtttcaccgttcgtattatttaaaaaattaaaatttttaaataagatagtcaaacgttagagacgagaatccacggctgcatttaaactggtacggagggacggaggtggcaggaagtaggaacgcacttgcagtcttcctatgcggcggggcactactagttcctagattccgtatatggctatgtttagttcagcgtaaagtttatattttggttaaaattagagatgatatgactgaaaagttatgtgtgtatgacaggttgatgtgatggaaaagtactgaagtttggatccaaaatttagattaagcacagcctatgtatggtgctcgtgagtcgtgagacactgaggccggccggcgtacgtgctccctgcacagcggccgtgaacaattttccaaggagatgcaaggaaaaaaagaatcaacagttatggaagcagcaaccaccaacattttctaccgtcccgtcatcttcttctccgtgctcctttgtttccaataccgtgccgccggcgttgcatcggacacgctcagcaatggccgcaacctcactgatggcgacacgctcgtgtcagccaatggctccttcactctggggttcttctcacccggcttgccaagcaggagatacctcgcgatatggttctccgagtcggcggacgccgtctgggtggccaaccgcgacagcccactgaacgacaccgccggcgtagtggttatcgatggcacgggcgggctcgtcctgctcgacggcgccgccggccaggccgcctggtcgtcgaacacgactggctcgtctccatcggtggcggtgcagctgctcgagtctgggaacctcgtcgtgcgcgaccagggcagcggcgacgtgctgtggcagtcgttcgacaacccgtcgaacaccctgatcgccggcatgaggctcggcaggaacccacggaccggcgccgagtggtccctcacgtcgtggcgcgcgcccgacgacccggcgacggggggctgccgccgcgtgatggacacgagagggctagcggactgcgtctcgtggtgcggcgccggcaagaagtaccgcacggggccatggaacgggctgtggttcagcggtgtcccggagatggcatcgtactcgtccatgttcgcgaaccaggtggtggtcaagcccgacgagatcgcctacgtcttcaccgccgccaccgccgcggcccccttctcccgcctcgtgctgagtgaggccggcgtgatccagcgcctcgtgtgggatcccagcagcaaggggtggaacacgttcgcgcaggcgccgcgcgacgtatgcgacgactacgccaagtgcggcgcgttcgggctgtgcaacgtgaacaccgcgtcgacgctcttctgcagctgcatggcggggttcagcccgatgttcccctcccagtggtccatgagggagacctccggtggttgccggaggaacgcgccgctggagtgcggcaacgggagcaccacggacgggttcgtgccggtgcgcggcgtgaagctccccgacacggacaacgccacggtggacacgggcgccacgcttgacgagtgcagggcgaggtgcttcgccaactgttcctgcgtcgcctacgccgccgcggacatccgaggcgccggcggcggcagcggatgcgtgatgtggacgggtgacgtcattgacgttcggtatgtcgacaaagggcaggatctctatttgaggctggcaaagcctgaactaggtacaacactgaaactaatgtgttcgagctaatgtgttcttgaggaggtaccataaggtaccactttttctattgtaaatttggtaccttttggtaactaggtactataaggtaccaaattttacactaaatttttgatacctcatgataccttcttaaggaccgtagaattgctcaatgtgtttggcaatggttaattacatatatatttccttcgctgtaaaatatcctagtactcggttaaacatcgcctagtactcgattagagtctataatatttgtgatgtctgattgagtactacgttactatattttagcgtggaggaagtactaattattttggtgaaatatttcttttcgcagttaacaataagaagaggactgtgataaaagttctgctcccagttacagcagcatgtttgcttctgctgatgagcatgttccttgtgtggttacgcaagtgcagaggtagataccgagccacctcacttctcagttctcacagcttatctaattaagaataatactactattaatattaaaatacacgatattgatattcctgtcaggcaaacgtcagaataaggttgtccagaaaaggatgctaggatacttgagtgcattaaatgaacttggtgatgaaaatttagaactcccgtttgtcagttttggagacattgctgctgcaacaaataatttttctgacgacaacatgctcggacaaggtggcttcggaaaggtttataaggtagcccacaaaaactgtattgaaaactacagtaggacaaaactatcgcacaatattcttcaattttagagcatattttttaggagtattacagaagaagtgccacaattagtactccctccgtccaaaaatataagagattttgggtgtcacatctacccaaaatcccttataccataggacggagggagtagtttactactgaaaagtgaaaacagtgataccatatgaaaatcccaattatggatgatgaactttatttttaaaaaagggagaaccgacaagaaacatggtgttaaataattaagaagaatgtgtgagcgtgttaagaatcgaataaggaaccttggggtcgaaaccacgtcccttatattgcggtaaaaagtgcatctcgagatgaactttcttaataaaaaaattaattgattaaattgtgtagggcatgctgggtgataacaaagaagtggcaattaaaaggcttagcaagggttctggacaaggagtagaagagttcagaaatgaagttgttctaattgccaaattgcagcacaggaacctcgttaaacttcttggctgttgcatacatggagatgagaagctgctaatttatgaatacttgccaaacaaaagcttggaagctttcattttcggtactgttcaaaaacataccatgcgatccaataaacttcactccatgcttactgatagagaaattttattgttcttgaaaaagtatctcaagatacctaaattttacactaaaatttttggtaccttgagatatttagtatctgaaggtaccaaaatttacaataaacaatgtgatacttaccagtactttctcaaagatgataaaattatccttactataagaacattgtataccattcttgatagatcctgcaagtaagtatgctcttgattggccaacaaggtttaagataatcaaaggagtagctagaggacttctttatctccaccaagactcaaggttgacaataattcatagagatctcaaatcaagcaacatcttgttggatgtggatatgagccctaagatatctgattttggtatggcaagaatcttcggtggcaaccagcaagaagccaatactaaccgagttgttggaacatagtgagtgatccaggaatttgttttttactattacattgatttcctgaaaaatcctttgttacttattactaaaactgttaagcagtggttacatgtctcctgaatatgcaatggatggcgccttttcagtcaagtccgacacatatagctatggtgttatactcttggagattgtaagtggtctgaagattagcttacctcggctgatggactttcccaacctattagcttatgtaagtaccatggaatgctctatgtccataaaaattcaaaataactataccgcttttatatggactgatctatttcactgtttaggcatggagcttatggaaggatgacaaggccatggatttggtggattcatccattgctgagagttgctcaaaaatggaagttttactatgtatccacatagggctgttgtgcgtgcaagataatccaaataataggccacccatgtcttctgttgttttcatgttagagaatgaagctgcagcgcttccagctccaatacaacctgtgtattttgcacatagggcctctggagccaaacaatcaggaggaaataccagcagctctaataataacatgagcctcacggtattagaaggacggtagatttactttttgcacgcaaaggcacaaagcgtttcctttggacaagtcctgtaatcggattgtggatttccataaaattaatagaaacaagagacatatactccctccatcccaaaacatttgacgccgttgacttttttaaaaatgtttgac

SEQ ID NO: 3283 - DNA, 6740 bp, Oryza sativa
aaataactgctagtaagttggatgttttagtgtttcaagaagtcggaagttctacaccaggttatacgtaccaaaaaggaggaatgcacggtgaacatgcataggagtaattaatcttaaggagctagagtaggatcataacatatatgccatataattatattctacaaaatttattattctaagtttctaacaaatcttaacaaattccttagtacacaaactttgatcccattgtactggaaacgagtttccttttttattttcccaaagattatagctgatcttgaaatagaattcgaaatcgaaattagcaatacctggcttggatggggctcgcgacgtcgcgtcgtgtcgaggtggcaccgcgaacttgtgtcaccgccgcacaagcatgtgacacccgtgagcggccggaacagtgcaggttaggctcgccgtgtcttccgcctcatcagccggctgccatggccgctaatccgtccccctccctactgcctcagccgagcgcttcttctgtcctctccctaggcggcaatggcatgatgcaacccctccggcctccatctcgcgcgcgctgcattgggagcggcggacgccgggcgtcggggcacttggacgtgcgggccgagccgccctccgccggttcactgcccctgttcgacggatggctccgcggcacccgcgcccgctcgccggttgacgtggcgcctccgtgccggggcagccgacgtcacttgggtcttccaccggccaccgcctcagccctcatccaagcgcttccctctcctgatctcctccgctacctcgccgagcgggagtgcgggacaatggggttggacgcggcgacccaacgctgggtcaccggctcactgcccgaccctactcagctcggctcaccgctctgccggtctccagcactcacggctcatcgaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgtcaacgaaatttgcaggcggcccccttgccgccctccgcgagggcgattttctactgtgcggggggccgcctgcaaatgggcggcgaggggggcatggaattttgcaggcggcccccttgccgccctccgctagggcgattttgcactgtgcggggggccgcctgcaaatgggcggcgagggggcatggaattttgcaggcggcccccttgccgccctgggggagggcgattttgtactgtgctctatatttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatacatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggaacgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaacgaggtcctgctccgacggtaggaccgcgaggccgtgggtgtaccggaccagcagaaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgcccggaaacacctgcctaagtccgaactgtcgcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactcatccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacagttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattacgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgaacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcaccctctttgttcgatcttcaaccgatgtaaatgtatgtaggtcatagtaagtattattattcctctgggggctgcag

SEQ ID NO: 3284 - DNA, 11709 bp, Oryza sativa
  unsure (1)..(11709): unsure at all n locations
ataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggccccccgcacagtagaaaatcgccctcgcggagggcggcaagggggccgcctgcaaatttcgttgacggccgtcgcccgagagcgaacggccgtctgccacgtcatatttgccgccctctgagagggcgatttttaaaaatcgccctcccagagggcggtaggcgactacttccgtcaattttcaaaatggaaaattatttttgtaaaacttttaataaaaaaaattataaataaaaaaattataaataaaaaaaattcacggctcatcgcgcatggatcggcccatctcgagtacccgtggcctattaagatggctcgggcatcagaggttgttcttgttcagattatagctaaaataaatctttttaaaatttgataacaaatctttcgaaagatgtataggtactcccaatttggtaacattatcaattggtaagattttttttatttaccaaaatatggtaaaaagctaaatggttgctcatgtttggcaactttactttaaaaaaatggtatatcttataatgacgtcaatctaaacaactccttagggcagccacaatgtagcaataggaggggggtcttaagcctctaaagtagtccttatacatttgtcgacgtttgatgtctcgactacggtatttggacagtatggggatcgttggtgctaggatatatgcgagactgaggtaaaagagatggagacagggatttttatacatggttcgggcccctgagttgtcaggtaataaccctacatcctgttggccaaagccggtattgctcttattcaccataatcacaccagtacaatatgtgggcagcctatctaactgttatcaacatgttggtctgaaagtctgactcgtagtcaacaacagggtagtcttcctcctcgaatccgtgcccggcgagatcagagatagcgctttcgtatctcctgacggtatccggagataccgtaggggaatagccatgcctatccctaaagtcgatatctggcagcgtgtcttggcgtatgtaggcttgtatgttgattgtgttgggcgttgatgaggtggtcgtcccgatcgtggtgatcgtgttgatcgtctcatggtgggtgtcccccctgtcctcctagggaggcttgtatttatacccataggtgtccccttgtccaagtagaactagggaaaccaatatggatacaatctgagtagtccttgtcgtttccatgtaaaactctagttgtctttccttattcggaactccctccatatctgaagtcggttttcgtataggacatggtatgtggtgggtcctgccgagatttagtcaactactattaggtatgtggtatccataaccatgacagcagcccccgacttcgatgcaaatgaacgaattcctattctcaaccgcgcgcagacattggagtaactgttatcaagctcatgtgaccgttctcggtgagtttagagataatgttggacttcctttgtcagccccgtgtgggcaccgaaagggtttgtctaagtgaatctctgatgtcgaccgaaaaagtacagagcgtacgactaagtctcccgttttgctgtagtcgagaatttggattgaagtcaagaaattttatctcggcgggtacaccatctcttcagtccgtattccttgtcaagatctagcaaccgttctcgagcaatcgagaaggcgtagagtctgcaaaggagctttgtcaacattggtcgtactcgccttagtcgatcctggtgtagaaccatagagacatggagtcttccacaatgtcgaatagaattttcctaaaatgaatactcagaaaagaatatcaaatagaaatagcccctgagcgaatgcccaaagggtgacatgttataatatgtatggtaaattgaaaatgaattaaatttaccgaccaatgttttgtgtaagagtgtcttctcagttcacgactttggtcagtcgtttgagttgttcactctccctagcccccagccttgtcgtcggagaatcgttctcagaggagtaggctcttggactcttgacctgccttggttgaataagcactgatcctagcccccggccgtgaagttggaaaagtcaatttccgattacacagcttggttaatacgcacggcgagaactcttacacgaccatatcttacatggtctttcgtctctgaaggatccaacaaggccttatcagctctgggcgtccccagccgaagatcccttaggttcctcggaggccttgtcaagacggcgttaagggtcagtaggataggtttcaacgctaggtgtcgtcgtggtaagggatctctgggtaaaacacttggcgatattgtgtacctgctaccaactttgttgaagtaaaggtagtgggagaaatcgctacatcgctggttgagaaccaggcagtagccgtaactcgaccactgaaagtggaagtagtcggaggaacgttacatcgctggtcgaggaccaggcagtagccgtaactcgaccactgaaagtggaagtagtcgaaggatcactacatcgctggtcgaggaccaggcagtagccgtaacttagccgtaactcgaccactgaaagtggaagtagtcggaggaacgctacatcgctggtcgaggaccaggcagtagccgtaactcgaccacttgaagcaaatgtacgagagatcactacgatcaactggttgaggaccggtgagtaggtgtccctcgatcacttggagtcgtggtacgaggaccgctacactgttgtagtcgtaccttgaccatctgaagtaaaggtgcgagagattgctacgtactggtgcaagaaccagtgagcgagcagaattatctctcgaacaccaatggaagttgcggtgtgagagattgctgcgtactggtgcgagaaccagtgagcgagccgaattatctctcgaacaccaatggatgctgcggtgtgagagattgctgcgtactggtgcgagaaccagtgagcgagcggaattatctctcgaacaccaatggacgctgcggtgtgagagtttgctgcgtactggtgcgagaaccagtgagcgagccgaattatctctcaaacaccgatggaagttgaggtgtgagagattgctacgtactggtgtgagaaccagtgagcgagtagaattatgtctcgaacaccgatgaaaggtgcggtgcgagagattgctgcgtactggtgcgagaactagtgagcgagcagaattatctctcgaacaccaatggaaggtgcggtgcgagagattgctgcgtactggtgcgagaaccagtgagcgagcagaattatctctcgaacaccaatggaaggtgcggtgcgagagattgctacgtactggtgcgagaaccagtgagcgagcagaattatctctcgaacaccgatggaagttgaggtgcgagagattgctgtgtactggtgcgagaaccagtgagcgagcagaattatctctcgaacaccgatagaagtgctagagttggtttattgcaagtgtatttcatgtggccagcatgactcacgtacccaacttatagcatatccggatgtccgttcgcaatcatgtcgggtgatcaagccgacgacgttcgcgaggaatcatccgttaacaacctttcttcaagtagtccagcgatggccgatgctatgagacaggtcgtcagtctttgttggtaggttgggtgcgataactccgcatttgtcgagaatgttctcgataatggagtgtactcgaccataacctactcgagtgctcaattgttcctgaaaaatattttctagaaggcaagatatatagcagataatatcgagtatgtactaaaaactgcatggatcttctagcattatcaggttataacgagcagatgtaattatcaggcattatgtaaaccgtaaacaagcatgatttatacagaagaaaacggagtgagcccccagcgttagactgtagttggtttaacgtcggaagcactcgtgcaacggatattgtataagaaacatgctctaggtaaacataataaattatagatctgacaatgctatatgatctgaataggtacgataaattgcatatagaatattgcgtacctttgtagatacatgccggatgtatgtcacaccccaatctggcaccgccgtacaacggcacctgataggagtgtgtcgtaggaaaaacggtgcggaccgcttcctacgaaaccgcgatctcagtaccagtcccaggacatagtgctggtacccacggtgacaaatatgaatcattgcaatccttaaaataaatagaggacttatttaccttaacttaggttgcagctcagaacagcccgagattgcaaccgacgacgcgaacgaggaaacaccaacaacagcggcagcagcggaaccaacggactaacacccaacaccacaggcgacggctgggaaccaggacgaaaccctaatcttcactttacttcatcttcaacttccgggtggaggaactatatatatttatatagagcaagggtgagtaccttcgtactcagcaagtcacgggaacttaggtgtttaatgcaagcttggaagagaggcaaggttgttttgcaaatcttttatttgaagacgttttgaaatcactaagtgatttatctctttctaagtttaggccgaaaagagacttgcgtctcgtttcgtctttaagagatgtttttcaacagctcatttggtaatgtaccgacctcccgggtcagatcattacttctcggctcccagagccattccacttgattaatcggctcccagagcctttttcattttctcggactcctagagtccagctgcccagcagcacaacaatccgcttccactcgggaagcctagactatgatgcccatagacatcccgaatcacacagattcgtttcttgaccactcaggtcatccatctgccacataggctgattctggtaacgattcccacaccacaacaacttttcacaaagcacaggcaaacaaatctacgctacaggaaacacctcacatccgcccatgaccgtgggcacggctgttcgaacagttagttaacctctgcagagggggcacactttacccacacgacattactaacccggatcacccagcccgtgagatcagccacgtcgggagaccttaaggctttcatgacaaggcattttgaaagccgacacaggttcaccatatgccaacaagaggggtcccagaccatactgtgccaggaagcccgagggttctccccgacaccaccccgttgaatccacatgtctcttggcatcatggctcccccgattagctaattactcagccaggggcgtcccattgcacccgtgtggtcgcacttgttatattctcggatgaatttcccacaggaatcggtccttatatgcgaatacgggacagtgccacacaggcacaacccccgcatcgcgagttttcacattccattttattttcaaacacaccgacgccacatgtcgggctttcaaggcttctcaaacccatttcccaagttttcgacaaacaacggtgtatgtgggatatttggtattcgcgctcaaagagcacggataccgaggtaccacaaaggtggagcgacgaggaaatcagggtagtacaacctacaggaattagtgcgactacttggtaggtccgtcggtttggcacgcaaaccgaggccaatcaagttgagtgtgtgattctactaatgcaagttgcaaacaaaataataatgattttccaattataggagcaattggtcaaagggtgacttgccttgctcaaggtcttcacgaatcttcgagaaaacccgcgatcgacgaaaatccggcaaccgcaactgtacgcaaacaattaaaacctaaacaaagaccaagaaaagatcctattttagactaaataatagtgccattaaatagatctcaattttatggaattattggaagttgaacggagtcaatcggaattacggatagggagatatgaattttggaagtttaagtggaatttctgggcgaaggaagatatttgtggaacaaggggaaattgatttatgaaatttatataaataatattctcaagaatattattgacagtcactgacgtgtgggaccaatggaaatgatttatggaacaagggaaaaagatttattaactcatggaataagataaaatgatttttgaatttctagaagagggaaatatttgtggaatattggaaaagatattctcgagaatatctttgactcattgacaagtggggtcaacaagaaggtaagagagagtaaattgagagggagcagatatggacttttggtcactgtgtttggggaagggattaaagatggactttagctcttaggtgtgggtactgggctcgggaggagggattataagtgaactttttctgtttcatcaggccgaagggaaggttggttgatgggccaagcccacgagcgggaggggctgaggaggcggctaaccaggtcgccgctgactcggtcaagcgggcccggccgctgaggtggcggccacaggaaaggattggggaggtcgagggggtcccgaggaaggcaatggcgagcgggcttgaagagagggagaccgacggtggcgcacagccgggtgcggcatcggcgaagctcgccgcggctgctcacgcagcggcgccaagcggcggtggcgagagctacacgatgcggaaaaggaaagggggtgccaacgggagggaggagccgaggagctcactgttgagcggggaacggcgtcgccggacttcagtgatgggaaggggaggaaggccgatggcggcgcatggacgagcagcggcgcacggcgacgaacacgatgccgaggtggcatggtgccgcggcgggcgcgccgggaaaggggtcggaagcgtgtgggaacgacgtccttggtcgcggcgggtgggcgttctttggngncccngncgacgatgaaggaggtggcggtgctctggggttggccgcgcgacggccaccggggtcgagggaggaggcggtagtactccgtttcaaggagcacggggtgaagggcaaaggattgtgggcatggggttgggattttataggtgaagaggcgcttggctggcgacagcggcggtttcgtgggcggtgggaaagcggcgacgacgtggatgcattgggcgacgaaggcggtggaccttgcggtgggaatcgaaccgcgagcgcgggctagcacggtcaaggtgggggcggcgagctggcatggtcgcggtggtggcgtgggcgcggtagggcgcaaaggcggcgtcagcggcaccctgtgtccgctcccgcaccaggacaagggagagagcgaggcggccttgcccgtaagggataaagcgaaaggaggaggaggaaagggagccttgctccttccgttttgggggggaagaaagatgagagcacgagcccagcctcacgtctttggacgcatgcggcatggagtggcgagggccatggatgacgtcggcgatgacggcggcgggcggtttgtcatggagtaggggcaaggcggcagcacgtggcgtcggtggcgcaagggctgatggcggcggcggccagtcggtcggccacctcgcgagcgagcgcgcgcgcgacgcgggggtgcggccggatttcgaacagcggtggcgggaaatcggcgccggggagagggagttcgacgagggagagagtgagagatacagagagagagagagcgagcaccctcgctcagagcggcgcacgagcgaggcacgcgagggaggaaggagcggctgagggagagagatgggccgagaggaggggatgggccgggagagagaggaatcagcccatcgacaagggaggcaaaatagacttttgctgaaagattttgatttggagagatttggagtttgggctttgaatctaaatttgatactttgtacacaagggttcaaggagtcaaggaaggaaacaaaatgggagtttggatattttgggattcggaaatgtatttggcgaggattcaaaggaagggattgactttcggaattagatttcggagacttgaattggtagaggaaatttgaggcgggggattttgatttcgatgagagggaacaacgggatttgaattgagatccacggcacgacttagactcgcactcaaaggacaaaatttttcacaattaggatttgccgaattagtttttaacatctcacgagaagtggagcgttacaatgtatctacgaaattagtagattaattaataagtcaatccactaattaccttttagccaaattgaattgtactccacaattagcacgtctagatggcacctatgtacgcatgcaagcatacctatggctaaaaaagccttcggtacacgccgtgcattactgtacatggttcccaccgcatacatgcttaatacatgtgtagatgcagtcggccagctgattgattggcgggtagacgacgtgtagttgaccctggtccggcggtaattcgtcaaggtcttccgcgacggcgacgtcttgaagcttggtcgatctcgcctgatcgaatagtcgatggtgatgattctgatctcgtcggaagatgtatttggacaggttggatctcccagagccgaagttgtcgagtaacttgttgtcggagaatccatcgtttgaacccatctcgtcgaaatcctagagcaccaaaatccccctacctggcgtgccactgtcgacgtttgatgtctcgactacggtatttggacagtatggggatcgttggtgctaggatatatgcgagactgaggtaaaagagatggagacagggatttttatacaggttcgggcccctgagttgtcaggtaataaccctacatcctgttggccgaagccggtattgctcttattcaccataatcacaccagtacaatatgtgggcagcctatctaactgttatcgacatgttggtctgaaagtctgactcatagtcgacaacaaggtagtcttcctcctcgaatccgtgcccggcgagatcagagatagcgctttcgtatctcctgacggtatccggagataccgtaggggaatagccatgcctatccctgaagtcgatatccggcagcgtgtcttggcgtatataggcttgtatgtggattgtgttgggcgttgatgaggtggtcgtcccgatcgtggtgatcgtgttgatcgtctcatggtgggtgtcccccctgtcctcctaggggggcttgtatttatacccataggtgtcctcttgtccaagtagaactagggaaaccaatatggatacaatccgagtagtccttgtcgtttccatgtagaactctagttgtctttccttatccggaactccctccatatctgaagtcggtttccgtataggacatggtatgtggtgggtcatgccgagatttagtcaactattattaggtatgtggtatccataaccatgacaacattgtgatagtagtccatatagtagtctttaacatgagctacccatatgcataatgcccacccataagaataaaatagcaatactttctcttctctctctcatcttctctctcacatgccatgcaattgagtgggaccagtgggacccaggctaatgtcttctcttatcatatacattgtagcaaacactataactaataccgggtcctaccttattatccaagtagaccttatacattgagcatgcccttactactccatccagattataaatcgttttgactttgatcaaagtcaagctgcttcaagattaaataagtttgtagacaaatatagtataatatttacgacaccaaattcgattcgtcaaatcgataattgaatatcttttcataatatattttgtcttgggttgaaaatgtttctatttttttctatgagcttaattaaatttgaaatagtttaattttgacaacaaatttaaacgacttgtgtaacctaatacggaggaagtactacccaacgctggtaggagaacccgccacgccatgggacagacgcgaggtttggctttcgcctgctctgcccgctccctccaaagtccaacctaaattcgtggtcatggcgttcttttttcgtgcagcgttgtcacaagacttggaagtatcatgaccagtttttttttttaaaaaaagaaaactttatcat

SEQ ID NO: 3285 - DNA, 1398 bp, Oryza sativa
attttgtgagtagtttgaacacccttaaatgtgtgcactatcatagtaacttggctagtacgttatattcagaatcaaattaccatgggcgcactttccaaggcgttaaatagggaaaactgttttaacagctcgaatggatgtttattgcatgtcatctaaatggttatgaaaaaaattaaaaaaatatgaacaagatagatcaatatgtaatatatcaatccacaaacatgcaagataaaattcaacttctacaaattgtaacaaaaataacaaacaaaactcaaattattacatatatatttacaattaaatttgttatttttgttacagcttgtagaagttgaatttaaacttgtatgtttatggagtgatataatacatattgatctatcttgtcaatttttttaaaaatttttcataactatctaactgacatgcaataaactccgctgctttgcaacttatccgtatggactcatgcatctttcttctctacagtttccgctgctttgcaacttatccgtatggactcatgcatctagctagctagtcaatcgtgggatattaattactgtgttggaagttagaacgcgtttgaattcctcctacacgggcactagattccgtgtatgtatgatacttgtgaggccaacctgttcccgtgcactgtagtccgtgaacaattctgggcaaggacgtgcaagaaaaactcacccgttatggaagcagcaaccgccaacattttccaccttagcctcaccttcttcttcatggtcctccttactctcggaacatctgccgccggcgttgcatcggacactctgagcaatggccgcaacctcactgacggcaacacgctcgtgtcggccggtggctccttcactctgggcttcttctcactcggcttgccaaacaggagatacctcgcgatatggttctccgagtccgcggacgccgtctgggtggccaaccgtgacagcccactgaacgacaccgccggcgtactggttaacaatggcgcgggcgggctcgtcctactcgacggctccggcagggccgcctggtcgtcgaacacgactggcaagtcttcatcagcgacggcggcgcagctgctggagtccggaaacctcgtcgtgcgcgagcgcgaccagctgaacaccggtgtcttcatctggcagtcgttcgatcacccgtcgaacacactgatcgccggcatgaggctcggcaacaaccggcagaccggcgacgcgtggttcctctcgtcgtggcgcgcgcacgacgacccggcgacgggagactgccgccgcgtgctggacacgagggggctcccggactgcgtcacgtggtgcggcggcgccaagaagtaccggacggggccatggaacgggcagtggt

SEQ ID NO: 3286 - DNA, 16704 bp, Oryza sativa
  unsure (1)..(16704): unsure at all n locations
aggtgtggatcccgtacatgaaggcaccgcgcggcgtgtgcgacgactacgccaagtgcggcgcgttcgggctgtgcaacgaggacaccgcgtcgacgctcttctgcagctgcatggcggggttcagcccggtgtccccctcgcggtggtccatgagggatacctccggtgggtgccggaggaacgcgccgctggagtgcggcaacgggagcaccacggacgggttcgtgccggtgcgcggcgtgaagctccccgacacggacaacgccacggtggacacgggcgccacgcttgacgagtgcagggcgaggtgcttggccaactgttcctgcgtcgcctacgccgccgcggacatcagcggccgcggctgcgtcatgtggatcggcgacatggttgatgttcgttatgtggacaaagggcaggacttgcatgtgagattggcaaagtctgaactaggtacacatgactatcacaaaattgcacgcatgtgcattcatttgcctgaaactaatgggttcagcaattaattactttatggttttctcggtgaaaattttcttcccattcagttaacaataagaagaggactgtggtaaaaattatgctcccacttacagcagcatgtttgcttctgctgatgagcatattccttgtatggttatacaagtgcagaggtaatactcgcagcttatatcctctactcctactagagctaatattaacacactatatatatttgtagtcctgtcaggcaaacgtcatcagaataaggttgtccagaagagagggattctaggatacttgagtgcatcaaatgaacttggagatgaaaatttagagctcccgtttgttagttttggagaaattgctgctgccacaaacaatttttctgatgacaacatgctcggacaagggggcttcgggaaggtttacaaggtacaaaataagttctatcttgagaattacaatagggacaaaaactaacatatataatactataatttttaactaataatatagttaatataggctaaaacaactagagattgaaattttacctagggtctcgtgaccccgtatagtatgctgtaggaactaggaactaggaagtagcatgtcaaaaaaaaaaggaactaggaagtaggaatgcccctgcagtgtactgataaattagcagagagatttttaccatcccaaatatggaggtacctcaaattaacattaagactgtagtaccttttcagacttcagtctttaggaactgtaaaaccactcatttacaaatgaacagccttcttaataaaaaaaataaagtgattaaattatgcagggaatgctagatgacggcaaagaagtcgcaattaaaaggcttagcaagggttctggccaaggagcagaagagttcagaaatgaagttgttctaattgccaaactgcagcatagaaacctcgttagacttcttggttattgtatatacggagatgagaagctgctaatttacgaatacttgccaaacaaaagcttggatgctttcatttttggtactgttcagatttatatactacagtattgcataaacttatcatatgatccaaagaaacttggctgcatacttaataataacatagtttaccattcttatagatcatgcaaataaatatgttcttgattggccaacaaggttcaagataatcaaaggagtagctagaggacttctttatctccaccaagattcaaggttaactgtaattcatagagatctcaaaccaagcaatatcttattggatgttgatatgagtcctaagatatcagattttggtatggcaagaatctttggaggcaaccagcatgaagcaaatactaacagagttgttggaacatagtgagtcattcatgcattaatgttcacaatgtttatttgctcgaatctttacttactgctaaatcattaagcagcggttacatgtctcctgaatatgcaatggatggcgccttttcagtcaaatccgacacatatagctttggtgttatactcttagagattgtaagttgcctgaagattagcttgcctcggctgacggacttccccaatttgttagcttatgtaagtatggtggaatgctttatctctacaattcagattaattgtactaattttatatggacttgattccactgtttcaggcatggaacttgtggaagaacgacagggcgatggatttgatggactcatccatttctaagagttgctcaccaactgaagttttactatgtatccaaataggtctattgtgcgtgcaagataatccaaataatagaccactcatgtcttcggttgtgtccatgttggagaacgagaccacaacgctttcagctcctatacagcctgtgtattttgcacatagggcctttgaaggcagacaaacaggtgaaaatagcatcagcttattagagggacggtaggtgtttatgttatttttctgcacgctaagtgcttcctttaggagcacatggtgaaacatgtataattgatatttggagaggagtaggaccgtaacatatgtggcatacaattgcattttttgtgatgataaaattgattatttaccatcgattttgttcctcggtacccaaactttgagccatcgcaccggaaacgagttaagaagacacacccgtaacccattgatctcgacttgaaatcgggttcttgtcaacatgggcttggcgtccttgtgggcattagcgggccgtatttgttctggcagaattgaactagatgacacaggaaccattcgaggaaagggctctcatccttcatcctcttcctctcatctcctcacaggaccaagcttggcctccctcccattgaagggaagcccttgccatgcttattggattttgttccaacaaacttggtgttaaataattgagaagaatgtatgattgtgttaagaatcaaatatagaacctcaggggtgaaaccatacatccatgatactgtgtgaacaagtgtatatcccgatgaactttcttaataaaaattaaagtgattaaattgtgcagggcatgctaggcggtaacaaagaagtggccattaaaaggcttagcaagcattctggacaaggagtagaagagttcagaaatgaagtggtccttattgccaaattgcagcacaaaaatctagtcaggcttcttggttgctgcattcacggagaggaaaagcttctcatatatgaatacttgcccaacaaaagcttggattacttcctttttggtatgtcctaatcatatattccttttttaccttttctttttccacgtttggtggaagactgttaccaaaaggccatgtgtgaacaactataagtatcgttttatattgttcacggtagatgattcaaaaaagtctatgcttgactggcaaacacggttcaacataatcaaaggagtagctagaggacttgtttatctccaccaagattcgaggatgacaataattcacagagatctcaaagcgagcaacattttattggatgaggggatgagccccaaaatatcagattttggcatgacaaggatctttggtggcaaccagcatcaagcaaacactagacatgtagtcgggacatagtgagtaactattgcactacttatgattacaatactaacttttatatacttggaaaacacttaaataacttacactcgttggtgacatgattcatatagtggttacatgtctcctgatatgcaatggaaggcatcttctctgtcaagtctgacacctacagctttggtgttttagttttggaacttataagcggctctaagataagctctcctcatcttataatgggttttccaaatcttatagcctgtgtaagtgtgtaagttctaagaaatatcaaaatgcataaagtttcaatagctaggattttgcactaattaggaactttgttcccttggttcaggcatggagcttgtggaagaatggaaaggcagaggatctcgtggactcaattattctgcagatatattcacttaatgagtttttgctctgtatccatgtaggactgttatgcgttcaggaagacccaaatgctagaccactcatgtcatcagttgtggccatgctcgagaatgaagccacaacacttcctactcctaagcaacctgcatattttgtgccaaggaattgcatggcaggaggggcaagagaggatgccaacaagtctgtgaacagtataagtcttaccacactacaaggacgttagatgtttaatttcagatttagctggctgtagaattcaccacttgatcaattgtgcaagaacctaggaatatgattgctttgtgggtgtatggttcattttcaatggtttacaaaaaaaaaaaagaaggaaagtctcttggggtaatccctgtcgtctccttgcgtaacgcaaacaacttccttgatccttcagtagtctccatcaattgttcttgagcataaatcgttgatcctccaaccttcatgttgtcgtctacagaaatagttgtagtaagttttctgttgtgcacaagcgttcaagcgtcgatatttctagttgcgaggttgtcccggtgccaccgagccagccagccagccacaaactgcacaagttagcatcacaacactgagtactaataccagctacgcctatgctctcgtcaggccacttcaccgtagtctccccacagttcagtttgaattcgtagcaaaactttatctcgacggacagaatagtctcggccattcgttattacgctgcttcctttggtccaaccgcgtgctcctcaagagtcaagagtcaagactcaggagaatcatgtatgcatcagataattaaacacccatatgtgtgtgtgctatttctctacgctttgcaggcaactaggcaaagctaagaacaagaccaaatgaatggtatggcttgcttccctcttttcatcttctcattctgcaagtgcgatgatcagctgacacaagcaaagaaactctaccctggcgacgtgctcgtctcccagaacggggttttcgcactcggcttcttctccccagcaacttccaaccagagcttattcctcggcatatggtacaacaacatcccagagcgcacatacgtttggattgccaaccgtgacaagccgatcactgccccttcatctgcgatgctcgccatcagcaatagttctaactttgtattgtcagatttagaaggccacaccttttgaacgacgatggccaacatcaacaccagaggtgaccgagcttatgcagtgctgctagactcaggaaacttggttcttcggctgccggacaatacaaccgcatggcaaagctttgatcacccaactgatacccttctccccaacaagaagtttttcctgagatacaaggcacaagtcgccatgcgacttgtcgcttggaagggaccgaatgacccatccaccggggacttctcctaccacagcgaccccagatcaaaccttcaggccttcatctggcacgggaccaagccatattaccgtttcattgcactttcacttaatagagtgttagtgtccggtgaagcatacgggagcaacattgccactttgatgtacaaatcacttgtgaacactagggatgagttgtacattatgtacacaacctctgatggctccccatacacacgaatcaagcttgactacatgggcaacatgaggttcctgagttggaacgggagctcatcgtcctggacagtcatctctcaacagccagcggccgctggtgactgcaatctctacgcctcatgtggcccattcggctactgcgacttcacattggccatccccagatgccagtgccttgatggattcgagccaagtgatttcaactcttcgagaggatgtcgaagaaagcaacagttgggatgcggaggtaggaaccatttcgtgaccatgtctggaatgaagctccctgacaagttcttgcaagtccagaacagaagcttcgaggagtgcatggccaagtgcagccacaactgctcatgcatggcctacgattatgcttatggcaacttgaccaaagccgacaccatgtccgatcagtcaaggtgcttgctctggactggggatcttgctgacatggcgagggcaagccttggtgacaacctatacctccggttagccgactctcctggtatgctcaccatttcttcccctgcagagacaacaaaatcttagatagtctgcacatcaaattaaaagcaacatccatgcatacttatggtttagaaattctcataattttgtttacttctcttgataggacacacttctgaagataagaaaaagaacagatatctagtggtggttttagtcacaattattccatgcctgctgatgctcacatgcatataccttgtcaggaaatggcaatcaaaaggtatggcaagggccgttacttatgaattcatagtatgatgtcttcctgtaattgtactgacagcatcggtgttattaggcaaacggagaaacaacaaaaatcagaacagaatgctgctaggaaaccttagatctcaagaactaattgagcagaatttagaattttcacatgttaattttgaatacgttgtcgcggcaacaaacaatttcagcgattccaacattcttggaaaaggaggtttcggtaaggtttataaggtaaacaattcaggctgacaatcacaaacactggagaatcctacaatattttataaatttaaaatgattgtattacacaggggaaattggaaggcgggagagaagttgctgtcaaaaggctcaacacaggttgcacacaagggatagagcattttacaaatgaagttgttcttattgacaaattgcagcacaaaaatctagttaggcttcttggctgctgtattcatggagatgaaaagcttcttatttttgaatatttacgcaacaaaagcttggattactttctttttggtacgcctaatcatatattcattttccctttatcacttttggtgggagaggtgcctgaacaactttaagtcttgtttcatactgttcatggtagatgattcaaaaaagcctatacttgattggcaaacaaggttcaacataatcaaaggagtagccagaggtcttgtttatctccaccaagattcaagaatgagagtaattcacagagatctcaaagccagcaatattttattggatgaggagatgagccccaaaatatcagattttggtatggcaaggatctttggtggcaaccagcatcaagcaaacactaaacatgtagtcgggacatagtgagtaactcttgcactacttatgattaaaatactaaattttatatacttggatactttcaaattacccacacttcttgttattggtggcacgattcaaacagtggttacatgtctcctgaatatgcaatggaaggcatcttctctgtcaagtctgacacatatagctttggtgttttagtcttggaacttataagtggttgtaagatcagctcaactcatcttataatggattttccaaaccttatagcctgtgtaagttctatgaaatattgagatgaacaaaatttcaacagctaggatttagcactgattaggatatctcctctctttgttcaggcatggagcttgtggaaagatggaaaggcagagaaatttgtggactcaattattctggagtgctattcgcttaatgagtttttgctctgtatccatgtaggactgttatgcgttcaggaagacccaaatgctagaccactcatgtcatcagttgtggccatgttcgagaatgaagccacaacacttcctacttctaagcaacctgcatattttgtgccaaggaattgcatggcagaaggggcaagagaggatgccaacaagtctgtgaacagtacaagtcttaccacactacaaggacgttagatgtttaaatttcagatatagctggctgtagaattcaccacttgatcaattgtgcaagaacctaggaatatgattgctttgtgggtgtatggttcatcttcaatggtttacaaaaaaaaaaaaaaggaaattcttccataagcaatttcgctcaattattggtgagttggaagtttctgcactaggcgattaagaaaaaagagagtggagaattgaaaccactgtgctcaaaactaggtaagctaaaagagagcagtaaagactacgattacttgcctttccttcaaaaaaatatatatataacttgggataaaaatcataattggttttaatacctattgtacttcttcaaatggagagtggcagcatcaagggcctgtgacaccacgtggagccatggaacgcacgtgaggtttcgcttttgcctgcactagcctatcactccaaagtccatggcagcagcattctttcgttttcgtgcagcattgtcacacgacttggagtatcatgaccaggtgacctggtcatcagaattcagacagggtcctttactgtctctgtccatgagtctgaatcaggacttagccatctcacatttctcctgatcttcagatgaggtgacagcaagggaattgaactccaactacaccagtccatatctgcattatgaatgaaagatataacttgacccatgacaagcaaacgaagcagaaagtctaacaggcaatatggtctattttctcatgttcctcctgctgctctcgattcctctatgcaaaaccgatgaccagctgacactgggaaagccaatctttcccagcgagatgctcatctccaagggcggcatctttgccctcggcttcttccccccggccaacttcagcaatagcctctatgttggagtctggttccacaacatcccccagcgcaccgttgtgtgggttgccaaccgcgacaacccaatcaccaccccttcgtcagcgacccttgccatcaccaacagctcaggcatggtgctgtcggactcccaaggccacattctttggacaaccaagatcagcgtcaccggagcctccgccgtgctgctcgacacggggaacttcgttctccggttgccaaacggcaccgacatatggcaaagcttcgatcacccgactgataccatcctcgcaggcatgatgttcttgatgagctacaagtccgagatcatcggacgcctcactgcgtggaggagccatgatgacccatccactggagatttctccttcagcctcgaccccagctcggacctccagggcatgacctggaacgggaccaagccatactgccgtaacggcgtcagaaccagcgtgacggtgtccggcgcccagtatccgagtaacagcagcttattcatgtatcaaacactcatcgactcagggaacaagctctactactcatacactgtctccgacagctccatctacacacgcctcacacttgacagcacgggcacgatgatgttcctgagctgggacaacagctcgtcgtcatggatgttgatcttccagcgccccgccgccggcagctgcgaggtctatggctcgtgcggcccgtttggctactgcgacttcacgggggccgtcccggcgtgccggtgcctcgatgggttcgagcctgtagatcccagcatctcgcaatcaggatgccggagaaaggaagagctgagatgcggagagggcggtcaccgcttcgtgtcattgcctgacatgaaggtccccgacaagttcttgcagatccggaacaggagcttcgaccagtgcgcggccgagtgcagcagcaactgctcttgcaaggcatatgcttacgccaacttgagcagtggcggcaccatggctgacccgtcaagatgcttggtttggacaggggagcttgtcgactcagagaagaaggccagccttggtgagaacctgtacctccgccttgctgagcctcctggtaagcaaaatttcacactgtcgcctcgttttcagatagtggcaatgctcatgatattatatgagagttcctataaaaaaatgtagttatatgaacacttaactttccaagttatgctccatgccataacactaacatctgaggtgtacatttctgcagttggaaagaaaaacaggttactgaagattgttgttccgataacagtatgcatgctgctactcacatgcatagtccttacctggatatgcaagcacagaggtagatgatataaggccttgtcttccaaatgtaaagctacttcgtaatttgaaagataaatgcattgacaatgacttacggttcttgagatagcactggtgcctcgacactatagagataccgggaatttacactaaaattgtatagtgcctccagatggtaccttcttaagtatattgtaaaaatctcatgtgttgaactttatcagggaaacaaaacaaggaaatccaaaagagactgatgctagaatatccgggcacctccaatgaacttggaggtgaaaatgtgaaatttccatttattagctttggagatattgtggctgcaacagataatttctgtgagtccaatctacttggaaggggaggctttggcaaagtttacaaggtaagaaagagtactaaatttatctacatcataacacgttttgaaactatataaaatattactgccccagcgtttccctatttatattgatgacaacatgaagggaatattggagggaggcacggaagttgctgtcaaaaggcttaatgagggttctggacaaggcattgaagagtttaggaatgaagtggttctaattgcaaaactgcagcacaggaacctagttagacttcttggttgctgcattcatgaagatgagaagttactgatctatgaatacttgcctaacaaaagcttggacgccttcctttttggtgtgttatgactttctatcccattgcaaaaaggttcttacattgactaaaatatatttatgatgactaacattagattttgtacatactgatcttgttgaaagatgctacaagaaaatatgtgcttgattggccaacaaggttcaaaataatcaaagggatagcaaaagggcttctttatcttcaccaagattcaagactgacaataattcatagagatctcaaagcaagcaacatcttgttggacacagaaatgaaccccaaaatatcagactttggtattgcaaggatttttcatggtaatcagcagcaagcaaacaccactcgagttgttggaacatagtaagtaataactagtaattagcccactagatagttttcaacactctaggttttattgactagttaaattcaaactgtgaattaatccttgccaacgattgtgcattcattgctaatgaaatggtttatacagtggttacatgtctcctgaatatgtgttgggtggtgccttttcggtcaagtcagatacatacagctttggtgttcttcttttggagattgtcagtggcctgaaaatcagttcatctaaactcacaccaaactttttcagccttacagcctatgtaagtactctaaaatgccgataattttgataccaaattaaactttagcagtcagcagtattttggagcaacaggcattagtaactttggtcagaacttcattctacaggcatggagattatggaaagatggaaatgcaacagaattgttggacaagttttttgttgacagttatccacttcatgaagctttcaggtgtattcacgttgggctcttgtgtgttcaagatcatccgaatgatagaccatcgatgtcatctgttgtttttatgttagaaaatgaaagcacgctgcttcctgcaccaaagcagcctgtgtattttgaaatgaagaaccacggaacacaagaagcgacagaagaaagtgtgtactctgtgaatacaatgagtaccacaacactggagggacgctagactaagaggtcaagctttactatacatgatttcagcatagataattctatgtttttacaatttaatgcttatgataatgaatttcagtgatgtgatatatgactttaaatctttaatggaaaacagtggagtttgctgcgtggtgaagaatgcttgtgaatattaatcttattgattggtatttatatataaaaaatgttacattgcagacaaggtattgcttacaaatttgcaaacactgtatttctattccacatgtggttgcttttatctgaagttaatcataaacctaaaagaatgtgacatgtttacaaatacacaaattataatggcatttttaaaaaccaattaaaccatttgttttagccaaaaggtcataagccggcttttaatagaagataataaccaaagactatggttggtattgaaatagatatccaaattagcaatgcctggccatgatttccattccatagagcgccggatttctatccatttacctctaaaaaaaaaaagaagaagctgtacctggcctcaagtagcagggatgttgctgccggcgtggaagtggcaagggccaaggggaaccagcttggcgtcaatggcttgtgaccgcgtaaggggacgggacagtagcaggttaggcccgccgtctcttccgcctaagccggctgcggtggcggtggcgccggcacctgcccccacggccgccgctactccgccgtccaccgcctcaaccgagcgcttcctctcntaggctgcaacgcctccgccacctcgccgagctccaccgggagcggcagaccgcggacgccgggcgcttcgacgtgcggtgccgaccgtcgccggctcaccgccccccaccgccgccaaccaccactccgccggcgaagtaaccgaagcacgttcgtcttcgtccacagatcaatcgacctaggcccaatagcccatcacgagcactttcacggcccacgaatctcacagttccggtcgcggactggtgggccgaatttgttctggtattccctcgccgcggcccatgccaatgcctctccgccgctgcccggtgaagcacctccaccgtctcactctcatcactggctcggaagtcaggacgctgggaagaatcaccgggaaatatttgtggagatgcacagcaaaacacttgcctgtaaatctgtgattagttgtgctggtaaaatagcttgcctgccgtactgccgttgcaagtggttctcctgaagactagcaaatgccctgtgcgtgctgacttgcttcatcaagcactgaaaataaaagtcattgagcaataaatcgggtcttcaatcttaacggtgacatacaactactagcgtgtcgttctgatcatctggccactctcaacgagaaaattgggattatactatcgtaaaagagtggtttcgctggaatgctatctcttcaaactaattcactaaaatgctatcttaaactggaggtgttcaccaaagtgctattttcactcttttgggtaaatagaaatttttttcctcaattttaacttttttctggaccaaaatacccctgctacgggcccacatgtcatactctccactctctccttctccccctcccctctatcgagggagcgccggtggcgggaggcgagcagtggccggcgccgcgtcgccgtcgctggcgtgccggctcgacctcgagaagctgatggcggcgcagctcggctagcccgtgctcgacgacctcctcatcccgtcctcctcgcccgacgccgccgccacaacggcctacgacattgacgccgtgcagaggatcctggccggctacctcgaccatgagggcgacgcggcggcggcgccgccacggctggactgcaccaccgacgacgacttcagctcagcggtgtcgccgccgcacaacgacgtcgcccaggtcggcaggctcatggagagctacctcgccgagatcgcctccgacgagaacctgtccattgactagttcaccgccctcgccgagctcatcccggagcacgccaggttcaacgaggacggcatgtaccacgccatcgacatctacttgaaggttagaagctgccattcacatcgatcactaaaaaatggctaaatccttcgttaatcactccactaaatgcttatgtggccggtgcagacggtggtgcaggtgctgtaccacgagcagcggcgcctccgcgcgccatcgcagccgccgagcaccgcgccgtcgtacgccggtggcgagtcgccggcgctgtcgtacaggccgacaccgagcttcaacggcgctgtcggccactgctcgcttccaaccaccggcgctccctcgagagagatgaagaggaggagagagtagagggagtatgacaggtgggcccgcatcaggggtattttggtccggaaaaaagttataattgagaaaaaacatttctatttacctaaaaaaacgaaaatagcattttggtgaacaccttcaatttagaatagcattttaatgaatcagtttgaagggatagcattccagcgaaaccactcttttacggtagtataatcccaattttctcactctccacacaggaatacagaatatctattgcgctatttcagggcctgggaaatataacaattacgatagtgtaatcctactcttttacgaagctagctgcactatgtactctatactgccgacaagaaggttggcccaataatctcacaactctgttctatcgtctctatgtaggattgtagtgctttccaaggaatttacaagagaatatgaccagactgcatgtagtcatcttcatgttcttgattagtttctgccaatccgatgaccgcctaacaccggcaaagccactcatcttccccggcggcgacaagctcatctcggatggcggcgtctttgctgtcggcttcttctccctgaccaccaccaactcaaccccaagcctgctctaccttggcatatggtacaacaacatcccggagcgcacctatgtctgggtcgccaaccgcgacaacccaatcaccacccatacggcgaggctggctgttaccaacacctccgggcttgtgctatccgactccaaggggaccacggcgaacacggtcaccatcggaggtggtggagccaccgcggtgctgcagaacacgggcaacttcgtgctccggttgcccgatcaccccacggacacgatcctccctggcctccctggcttcaagctatggacgaacatacaagaaccatgaggcggtgcgcgtagttgcttggaggggtcgtcgcgacccgtccacctgcgagttctccctcagcggtgaccctgaccagtgggggctccatatcgtcatctggcatggggcgagcccgtcgtggcgcagcggtgtctggaacggcgcgacggccaccggcctcaccaggtacatatggtcccagatcgttgacaatggcgaggagatctacgcgatatacaacgcagctgatggcattttgacacactggaagctggactacaccgggaacgtgagcttccgggcatggaacaacgtatcatcgacttggacgagcccattcgagcgaccaggccatggctgtctccactacggcgcctgcgggccgttcggctactgcgacatcaccggcagcttccaggagtgcaagtgccttgatggcttcgagccggccgatggatttagcctcaactcttccagaggatgccgaagaaaggaggagctgagatgcggtggccaagaccatttcttcaccttaccagggatgaaggtgccggacaagttcttgtacatcaggaacagaacctttgaggagtgtgccgatgagtgcgaccgcaactgctcgtgcacggcatacgcttatgccaacttgagaactatcctcacgacgggtgacccctcaaggtgcttggtatggatgggggagcttctcgactcggagaaagccagtgccgttggtgagaacctgtaccttcgactcgccggctctcctgcaggtatgcgccgtctcatgatgttttctctagcaattgccccacattctccatgaacatgacgataaatgtcattctgcagtaaacaacaagaacattgtaaagattgtactcccagctatagcatgcctgctgatactgacagcatgctcatgcgttgtactctgtaaatgcgagtcaagaggtaaagcaagagataacagctacttgcaatatgcagctgctaaatgtaatattgttgtgttgacatgttttgatatttatattaggcatacgacgaaacaaggaagtacttaaaaaaacggagcttaggaaatacttgntagnnagnttgccttttttcatgactcatgggatcaaaatctagagttccctgatattagctatgaagacctcacctctgcaacaaacggtttccatgaaactaacatgcttggaaaaggtggttttggcaaagtatataaggtggtataaaattttaccttgtaaattacacaatgtgagtgtagcattcatgtcactttattcttgtttaacaccatgtctccatggtaatgaaataccacagggaacattggaagatggcatggaagttgcttgttaaaaatggcttttaaccaaaaaggggggggtaaatttttttttccacctttgggaagcaaaggggggggggttttccaacgcatttagaatgaagagttcttattgcaaaactgcagcataagaacctagttagacttct

SEQ ID NO: 3287 - DNA, 680 bp, Oryza sativa
  unsure (1)..(680): unsure at all n locations
tgtactgacagcatcggtgttattaggcaaacggagaaacaacaaaaatcagaacagaatgctgctaggaaaccttagatctcaagaactaattttttggaaaaagggccaagaatttttttaaaggggggaaaaaaaattttnttttttnttncnancatagttntaatttttggaaatacgttgtcgcggcaacaaacaatttcagcgattccaacattcttggaaaaggaggtttcggtaaggtttataaggtaaacaattcaggctgacaatcacaaacactggagaatcctacaatattttataaatttaaaatgattgtattacacaggggaaattggaaggcgggagagaagttgctgtcaaaaggctcaacacaggttgcacacaagggatagagcattttacaaatgaagttgttcttattgacaaattntngnncnaaggcaccanaaaaattctaaagttaggcttcttggctgctgtattcatggagatgaaaagcttcttatttttgaatatttacgcaacaaaagcttggattactttctttttggtacgcctaatcatatattcattttccctttatcacttttggtgggagaggtgcctgaacaactttaagtcttgtttcacactgttcatggtagatgattcaaaaaagcctatactgaggg

SEQ ID NO: 3288 - DNA, 679 bp, Oryza sativa
  unsure (1)..(679): unsure at all n locations
ttcctgcaccccgttttttactattacattgatttcctgaaaaatcctttggtacttattactaaaactgttaagcagtggttacatgtctcctgaatatgcaatggatggcgccttttcagtcaagtccgacacatatagctatggtgttatactcttggagattgtaagtggtctgaagattagcttacctcggctgatggactttcccaacctattagcttatnngtaagtaccncnattnngggcgaatgctctatgtccataaaaattcaaaataactataccgcttttatatggactgatctatttcactgtttaggcatggagcttatggaaggatgacaaggccatggatttggtggattcatccattgctgagagttgctcaaaaatggaagttttactatgtatccacatagggctgttgtgcgtgcaagataatccaaataataggccacccatgtcttctgttgttttcatgttagagaatgaagctgcagcgctttccagcctttccaattacaaaccccccctttggggttttggggtttttaaattttttttgccaaccaaattttaaggggggcctctggagcaaacaatcaggaggaaataccagcagctctaataataacatgagcctcacggtattagaaggacggtagatttacttttt

SEQ ID NO: 3289 - DNA, 678 bp, Oryza sativa
  unsure (1)..(678): unsure at all n locations
cctgcaccccagccgcccgggttgccatagatgagacttgtggcgttctgtttgttgatatgtctgcaaatgggatggcttaaccaaattatggagttgtggcactttactaaagtctgaatgtacatttcatttgtattatggggtataggccaacaacttttaatatgagcttttgctgtaatcttgatttaattcgttgatatgctgagggatcgtggcattccttttcccattntnaanccctgttcctgatctgttctgtcagtgatgcttggtgtcaaggtacgcccactgggcttccacacgaaccatggcgaggtgctgttccgctgctgggacatggtaaaatcttttagaccaaaccatttgatgtgctagcttatatcgtgcttgtctatacctgctaaaatcacttctacaaaactgtatgatggttccggtaagaaagtcaaatcgatcggtaatgttcagaattgagaaacatgaatattgatctgtgcaagtcttcagggaaaggttggtttttttgggacaaaggattttttttttcccctttgtggtggaagggttttaaaaaaaaaacgagtatgtaagtaggggagaagcactgcaagtagtgatttgtctatggcatatatcatcatgatctgctccttgtataaagagcttcagaat

SEQ ID NO: 3290 - DNA, 697 bp, Oryza sativa
  unsure (1)..(697): unsure at all n locations
aattcctgcaccccctctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattgnggttgtgtcattttattngnccnnccctaccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagaaagccttcttttaaagaagaaatncccccccaatttttaaaaaaaagggggaaaaaatttggggcttgttttttccttttttttgggaaaattgcttgtagaaatttgcacccatgtgacgcatgcaccaccgactccgaacatcaggccacttagctggaagtcccttctcatcccaaccgtt

SEQ ID NO: 3291 - DNA, 693 bp, Oryza sativa
  unsure (1)..(693): unsure at all n locations
ttcctgcaccccagtggcagcatcaagggcctgtgacaccacgtggagccatggaacgcacgtgaggtttcgcttttgcctgcactagcctatcactccaaagtccatggcagcagcattctttcgttttcgtgcagcattgtcacacgacttggagtatcatgaccaggtgacctggtcatcagaattcagacagggtcctttactgtctctgtccatggagtgtctgaaatttcagggaaaccttttcagccatctcacatttctcctgatcttcagatgaggtgacagcaagggaattgaactccaactacaccagtccatatctgcattatgaatgaaagatataacttgacccatgacaagcaaacgaagcagaaagtctaacaggcaatatggtctattttctcatgttcctcctgctgctctcgattcctctatgcaaaaccgatgaccagctgacactgggaaagccaatctttcccagcgagatgctcatctccaaggggccggcatcctttttgcccccttccggggccccttttttttccccttttttttttccccccccccccggggccnccccaaaaaaacccttttagcaatagcctctatgttggagtctggttccacaacatcccccagcgcaccgttgtgtgggttgccaaccgcgacaacccaatcaccacccct

SEQ ID NO: 3292 - DNA, 397 bp, Oryza sativa
cgcgggccaacatcatcagcgtgctgatcgcccgtggctacatcgtgaagaaagggcgctccattcgcgcatcggatgcggcgttcacgctgatcgacgccgtgcccgcagcgattgcagaccccggcacgacggcagtgtgggagcaggcgctcgacatgatcgaggcgggacagctcaccctggacgtattcctcagcaagcaggccgcctggatttcgcagttgatcgcgcagtacggcagcatgtccctgtccatcaagcttccccatgggccagcatgtccgcagtgcggcgcagcgacgcgccagcgcaccggcaagagcggcccattctggtcgtgcagtcgctaccccgactgcaaaggcacgctgccggtcgaatccggtacgcccaa

SEQ ID NO: 3293 - DNA, 8701 bp, Oryza sativa
  unsure (1)..(8701): unsure at all n locations
nnnnnnnnnnnnnnnnnnnnnnnnnnnnnnnnnnnnnnnnnnnnnnnnnnnnnnnnnnnnnnnnnnnctctgaagtctagtaatataaagactaaaaaagaggcaacaatggcctataaattgacattatgattggagatagcatgcatgtccatgttggatggataaatccagtgactgtgagtaatgacaataagcaaaaaaaaaaagttaaaaagttatcgagctgaggtcaagagttcagttaacctgctaccacatcacaaattaccacagactccactatatttaattacatcaaagctaaagatgaagtgatataatgctatacaactatcgattaaaagtgcttagttacttacatgatcagtccactaatggtggccactaaattcaccaatgtcagtgtgtgtgtgcgcgccactagtaacactccagctgccatggactgactcaactccaatgtgtctgcaactcaacgttgctatcaaactaaagaggttttgtacatatatgtttgcatacataatgcgttgtgatctcatggacatgatgcaattcgccaaattcagccaactcataaggccatgacacaagttggacattgttaaaccaaaataagcaaaaggtgatgggggccatagcctctgattgatcaattcgatactcaattaattaatcaattatgctgacaaaaacaactaaaaaaggactcatcaccacaaaatcctagcaaataatagtcactttcatcgatatatttgagtacacattttgagaggatggttcagttaggccctatttagatcccacacaaaaatttacaccatatcacattaaacgtctgaacacctacatgaaatattaaatatagtaaaaaaataactacttgcacatattataactaatttgcgagacgaatcttttgagcctaattgcttcatatgatttgacaatgtggtgctataataaacatttgctaatgacagattaattaggcttaataaattcatcttacggtttactgaaggattatgtaattagtttttttttgttagtgcccgaacatccaatgcgacaccctatataatatccgatgtgacacactaaaactttaccatgtatctaaacaccctcttagtgtgctccaatgattcaggtacagtgctagtttcttgtgctggttattgagcaattactctttcggttacaaaagaatgtctttatatatcttttctaattaagtaaaaagggcacaactttggttgctcaattaccctgcataaattctgaaataattatatgtgtaatattatgaaaacatctattataacaagcttggttacatattttttaatggctcaaactctaaaacaatatatagatcaaaattcacaccgattttggcctactatatctttgaaaaaacatcttttggttgaataaatatacattacaaaccttcatttggacaacctagaaggacaccttgacttgtaccaccatctgatgtgactatgaccaatcaaactatctaatgtttgtatattatgtttaagaattaagtgaagtattggtcttttcctcatcatcctaatctttgaggtaaatggaaattgctatgatgagactgatacaattttattactctctccgggttgataatacttatcacttttgacacgagcacggtcttcaaaaactaactttgaccattatttatcattataatatgtataaaagtgttaacaaatatatgattttattaaagtacttatatatatatatacataaaatgattatgaatcattttaaaatattcatctttcaaatacagtgactatatatatatagtcactgtatttgaaagatgaatactttaaaatgattcataattaaagattctaaagtttgacctcactcttgtctaaaacgacaagtattatcatcctggtgggagtacgacactaccttccatgattgtcgattgggttgaaacatcccgagccccatatttgccgcacacacaagagaataagtatcatacgctctgaccataagaaattttatcgtatgtatagcagtatttttggtaaattggctgatgcacacgtaactcagaatattaattggccttgtgcttctttttttttaataatgaagatgaagttttcgcagaggctttctctagatacttgacagtgctttaaatataagaaatgcaccattgttttaaggtttgggagttttcaccacggctgctataaaacacacctatgcatcatgcttgatagactctccggtatatgaaagttcaccattttttgaagttttgggtgacagcatcaccctgaagtgtaattaagaatattccaccttttatcactcaaaccactttaactttgatgggttggttaagatttaacttgcataagtcacccttgactatcaagtactaaccactactaccttttaatttggacacttatgggaaaaacataacaaagctggaaggttttatttgtttggatgaaaggcatttgaaggcattggcatacgtgagcaacgattttaatttcacgagtacaattggatgcaatttatctttctgtagaagcgatatcatttcttacagtttacgattctagctacatatataaaatttaatttttgtaatttctatcaatgtcatattgaagtcgtcactgaatagttaaattgataataaatataaaatttctaacctaccaagaaacattttttcacccctagatgcacatcgcatatcacctatccatcaggctggatcatctctgtttgtacagcggcaacaaggcgtccagattgcaattatttatttttttacgtgcacgtgtgtagattgcaacagattgcaactccctgttcagcaagctgcaaaatttttgactctactgttgatgttgataccgctgttgatctgagcaacgggtgttacgttgtcgaccaccggcgtcgaacttgaccgtgcactgcgaaaatacaatatacagtaacgaaacgatctttcggtgcaattaaagtaaaccgggtgacttttaatgttacaaaaattaaggtcccgttctaatcttgcttacagggagctacttttttatttattgtaaacatgatttttaaactgttaaacggtatacttttatttataaaaaaaatcaaagctttcttaattgttcggctaagccaaacacctaaaacgaacgcagcctaaaaacaaaatctaaaccaattttatctaaatacatccctaatgaaaagagatgtaaattaacttaatccaattaggagcaggtacattgtgtggctatataagcgaggtggctatgcagtgtgattttaggtgattactactccattcttgcttagctcaagagtgtcgcaacagcttgtggacacaaacatgccaaccatgccggccgtcgtgtccgccgccggcgccgccgcgccgtgctccaacgtcgtcgaggacctcgtcggcttcctccgcgtcctcagcgacggcaccatcctccggtcgccggggccggtgttctgcccttccaccttccccgacgagcacccctccgtggaatggaaggaggccgtctacgacaagcccaagaacctccatgtccgcatgtacaagccgtcgccggcgagcggcggcgtcggcgccggcggtggcgggaagctaccggtgctcgtctacttccacggcggcgggttctgcctcggctcgtgcacgtgggccaacgtccactccttctgcctccgcctcgccgcggacgccggcgccgtcgtgctctccgccgggtaccgcctcgcccccgagcaccgcctccccgccgcggtcgacgacgcggcgggcttcctccactggctccgggaacgcgccgtcgacggcgacggcgacggcgacggatggtggctcgccgaggccgccgacttcggccgcgtgttcgtcaccggggactcggccggcggcaccatagcgcaccacctcgccgtgcgcgccggctcggcggcggcggcggcgcccgacgacccggtcgcgatccgaggctacgtcctgctaatgccgttcttcggcggcgtcagccggacgccgtcggaggcggggtgcccggcggaggtgttcctcaacctggacctgttcgaccggttctggcggctgtcgctgccgccgggcgccacgagggaccacccgatggcgaacccgttcggcccggacagccccgccatggacggcgtcgagctccccccggtcctcgtcgtcgccggcggcctcgacatgctgcgcgaccgcgccgtcgactacgccgagcggctgtccgccatgggcaagccggtggagctcgccgagttcgccggcgagcaccacgggttcttcacgctcggccccggctccgacgccgccggcgagctgatcgccgccgtggcgcgcttcgtcgacgtggcagcgccgccaccgaagtagggtagtgcatcgagattcgtgcagtccatgtttttttttcactctccttttggtcgagggcgacatgtgcaggagagacgggtgtttgtcacgtgtcaatgatgtgatgtgatgtgtgttgtcatgagacatcagcggagtaaaatgaaccggatgtccaagtgtgatttgcatgcagtatctttgcttttagccagtcctgtaaaatatcggtgatttatatctttgccaaaaaaaattttgggtaaatttggatgtttgggtttttaagtacagtactgtacgtagaatgtaaaatactagggtgccagattgtaagggtattatgtaaggcagtagaaccaaagatgttgtgaactctattgatgttaccatctgataaggataaggataacaaaccaaacacattttacaaaacttttcggctttgttgaaattagcagcatcaccacattaaacccaaagggcaaaggctaatgggcaaatgcgcgtgctctctctttcaccaagcaaacggcatgcattttgtttttttatattgtatttctctttctgatttctggtaattttatatatggaaatgactccagcttggacgcccgatgggaggggttaaaatcgggcgttgatgtcagcatgacgtcagcgccacgtatacgtgtaaaaccattttaaattgatttttctcttaaattacttatctaaatcatgattcgattgcaccattaaattcgttgcaattaaatcttcaaaacaagaccacacatggatatatttcgacgaaaaaaaattagcttattattgaatttatttttaaatgttgcacgatgttccactaggtatatcggaattgtttcactaagtagatcgaaaatgtttcactcgtttaaatagggtgttgtttcaccttatataaaaacaatatttcagcaaatagcgaaagaatgtttcagttcactacaacattagatctatatatagtgaaacattgtgagtacaataggtgaaacattttttgtggaacaaaagataaaacgaattcccttaatagagggtttttaaaatatgtaggtgatttgttgcaatagagtatttctgttcactataacattagatctatacatagtgaaacatttgattgcactagatgaaacatttttggtggaacaaaaaataaaccaaattcccttaatagagggtttccaaaatatgtgggtaatttgttgcaatggagtatatggtggagataagtggcaggtgagggcagagacgtggtggggcccagaggcaggcagcgcgcgtcgtgggggggggggggagggagcgcccgatacttctccctccccgagcgaccgatccggggcattcccttatatatcaatggtttatactttatattccttgtcctatttagtattattcttttattcctatttagaatcaaagtttctatctagaaactttctataccagaaagttttgtattcttaaaatttatagacatgtgtctcttggtaggctggcatgtggcctaggcatgtgaatgttcgcccattaaacctacctcgctaagccaacaagaacatttgaaaaagaaaattaaattgcagcaaatgaataactcttggacctcggatttctacggaactttatgaatttatatgaagttcaggtgtcaaaagtgaccttagggagaagaaaaaaatataaccggaggggaaaaaagaagtagtaaataaaaacaagagatagaaaagcaaacaagttaaggcacatgaaagaaagctactcaaaaggcctgtgctccactgaagcttcttcctttttggatttgatagaacacctaccggactaaaagttttaactttccccagtaaaataacatttctttcttgtaagaaagtgtaattaaatgaaatatgcttctgatctccccacatttttaatgatgtgaacagtggaacttttagtagtccttatctagtccatagacttcgacaagatgggggcaaaaggatcgaagccatttagcgactggcatttaggaaaaaaaaagcatatatttaaataatcgcagttattacctgaaattaattacaggtaagagtgatgacctcaaccatgtaaggcacagttacacatgttaagaactcaaatcctctacagcactgctcctgtatcagggtcatttacatgtactccatctgtcctaaaatataataaattttgattggatagaatacatcataataatgtaaatctagatatgctttttatctagattagtagtactaaaatatgtcacacccaatcaaagttctttatattttgagataaaaggagtaggtccttgaataagtagggctcatatgtacatattgaccttgtttactcctgtaatttgtggtgctgagtgcaacatactttgacatttccatgcaactcacttggaaggaattaaattggttaatgccaagagtgttgcagtaagggcgaatctttgcaagtggctctgcagtgagttgaatctttgcaatccatgccatatccaatgggaccatgcaccttcatgtcatgttgctaagaaaaaagatcaacaagacaagatacaagatcatcatgggagctagattacaaattctttggagaagatgtgtatccatatatgaaaccataataatccggcctgctgctagatctaccttatctgggcatgtgatgtgtgcatatctaccagtgcccgaatgtttatagtcctgagggacatatttatcatatataatctaatttatgtttactattttgatgaatgtatttacagttgcagcttaatttagagttttagtagtttagtcatactttaggattgattcaatataaaggttagggctgagcttatcaactgcacgtaaaataagacaagtgattatcttgagtattacttttgaaataatagatttatttgaatttttaaagagacttttataaagaaagtttatgtaaataacacattgtttaatagattgggagttactatattctaatatgctcatgataaataagaatgcagtaactctaaatagaagcaaattgcatgtacaaaggtagagtctaatatgagctctttatattaattaatatcactagagattatccttctacaatgatagtaaagacaataagatttctaaaccattaatgtactaaatatctttttttattatacttctttccttttctacaccctcatgcaacaaacttttcgttaataaatgctaagagtcgactctaagctgttatcatgcgtagcaacgatgtttctcattcattccatctctttcttccacgtcaccaaatttacttgcatgataacgaagagagcctgttattagacaccattgtatactcttaacacacactctcctctctctctctctgataatctgattgttggatcattatcacacaagaccaaaaactgacaactcatatctgttaggtactatagccgaatacaatgtctctcctcctcatttgatctggtccaagaaaatcacaagtgattagcatgatgatgtgtacagtaacagtacatcgtaccttcgtacaataacagctacatgcacaaactgtcaaactgtatacctgcacacgtgaaactgtaaatttcggctttatatgcaggtcgacctactgtgctactgttttttttttctcctgatacattatccgaagcctatcaattagtctgcattagaacagactgaataacagactatagccgactataaacatattttaaatagataaaaaagaagatataaaagtagcggggcaacaggctacagatttatagccagctgcagtataaactttaagatacatgtgtgtatgataggtgggaccaaacattaattatgtagtacatgtttatagataactattgtacgaattagctattaaattaactatatatgatttgaagccaataggacatagccatggtttgaatcaatattgtcaagctagccaatcaatcaggtgaagagaagtaatctaactttattattattgttattttcataagagacaaagtcatgatcttcttcctcgctgtagcggcgccccctatttgaccatttcgagtcgcttccacgatggtcaatatggtgaaggatattgccttatgcatcgtgcaaaacctct

SEQ ID NO: 3294 - DNA, 34664 bp, Oryza sativa
tcttgtcaaacatgctgcggagtgcatgggcaatggaccgatggttgcatgaagggaggaactctattatgttgttcacttgatgaatggaggaactcattgtatccagccattttccctttactttgattgttactactagtgcatgctggcttggtcaaaacactgaatagttcagccttatcttctcatcctaatgttcaacttcagcagcaaagcagggcaatttggcacgtgaagaagctgacgtggcacaaccatgcacacacgatagtcaactatacttgccacgtggctagatatctgcccccaaagtcaatggacaaatggatcactgccacttgggcccggatatcgagacaatgggtcactgactcgtgggcccggatatctagttctattgataccgcacgtctcaactgcgcttagctttagtactatttatagacgtcacccgtacagttgtgctgagacaactaagctaagtgggcagtgggcaccaccatgtcgtcgtcgtcttcctcgccggcgccgccgcacgtcgtcgaggactgcctcggcatcgtgcagctactcagcgacggcacggtgacgcgttccggcgactactccagcatctcgctcatgcgcgacgtcccgatcgacctgcccgtccagtggaaagacgtcgtctacgacgccggccgcggcctccgcctccgcatgtacgcgccggcgaaccacggcggcgaggaggggaagcttccggtgctcgtctacttccacggcggcggcttctgcatcgccagcttcgagctgcccaacttccacgccggtgcgctccgcctcgccggcgagctcccggccgtcgtgctctccgccgactaccgcctcgcccccgagcaccgcctccccgccgcgtacgaggacgccgtggccgtcctctcgtggctccgcggccaggccgccgccgccgccgacccgtggctcgccgcgtcggccgacttcgagagggtgttcgtctgcggcgactcgtgcggcggcaacatcgcgcaccacctcaccgtcggctgcggctccggcgacatcgcgctcgacgcggcgaggctcgccgggtgcgtgatgctctggccatacttcggcggcgaggagaggatgccatccgaggcgccgccgccgccgccggagggcgacgcgtcgccgtcggcgatgggcatcacgctgttcgaccagatgtggcggctggcgctgccggcgggggcgacgagggaccacccggcggcgaacccgttcgggccggagagcccgccgctcgacggcgtcgcgttcccgccggtgctcatcgtggaccccgagctggacgtgctccgcgaccgcgtcgccgactacgcggagaggctgcagcccatggggaagcgcgtcgagctcgtcaagttcgaagggcagggccatggcttcttcgtgctcgaccccatgagcgaggcctccggcgagctcgtccgcgtcgtcaggcgcttcgtgcacgccggctaggtgatcgtccgaagtaaaccaagatatggaactcggatgacttgtgtactactccagtgttctagcgcgggagatttgcagcttgatcctttcgtcttcatcttgtcatccgtagccaatatttcaattttataaattgtttttatagttgattttgatgttttcttatcgtagtttattttttaaaatattggttttaagtcgttaaaaacacgtgtacacaaattttgatccttaattagtttttaatatcgctaataaatgttatggtataatcctcattttagatgttaggatctaccaactacttttcacttttaagcgctgtttgggttaaaaaaaataattaaagcgaaatggtttgtagcctaatggttacaatagcctccctaacaccttaggtttttggttcgactctccatgggagctgtattttgatctgtgttctctacaagtttgcaactctacttgctaacagttatgcatttgaaaatataaatgaaatcgtgcagagacaagcgacgatatatattggacacaattgttcttttcatttatttattttcttgttgatttatactcgtgatatgatatacacggttggaaaatccgagttttttctctctttttttttttttgctctctacaagtttgcaactccacttgctaacagttatgcatttgaaaatataaatgaaatcgtgcagagacaagcgacgatatatattggatacaattgttcttttcatttatttattttcttgttgatttatactggtgatatgatatacactgttggaaaatccgagtttttttttttggtgaaagatagatcagtcgacaactcgacataaatacaagtccttttcgtattgagacgtatactggcccagcaatcagcaaatgggttgttgatggtccgtggcccgtggtcctcccttcccttacatcggccgcaccgacagcccagaataagttaagcccatttaaacattttctcgcccaaaaatttaattaaacttcggtggcatgtcatcatcttcaaactcatcttttttttgacacagtaatattctcgaattatctccccggatttattaaattaaaaataaaagtaatccattttttgagaagaaagtgaaataatttttttttcaatgatatgctcgaattacctccaccgattttttaaataaaaaataaaagtaatcacatttttttccgacgaaagtgaaataacatttttttttcaaagtgcatgccgtcctacgacaactacaagacaaccaatggcggagctagaaaattttcattgtccgggcaaatctaactacaagtatttactataaaaattttgtgttcaattctatattatatcaaattttggaataagatttcaaaattttacttatatcaaccccctcaatacggtattatttcggccaaattttttaattttttcatgaattttagtaatatttatttaaattagactaaattttgttcaaaattttgaaaataccgtcatatcagcccacttgatacaaatactgaaaacgaaagattgaacccctgaccggaccactgctactttggtatagggatgaaaacggtcgaaaatggtctgaaacgatattattattttattattttttcgaaaacaaatggaaatggccagaaaattttcatatttatgaattcatctatttaatgtaaacttcaatgccacgctaatagaaattaaaaaaaagtaaattttaaaaacagtaaccatcggtaaaaatattattgttatattagttttacgaaaacggtacagatgcggttctactttggtcgccgggcggtggctccgcgaccgaaggctacaacgaaacgttttggtttttagcttttagcctcatcaatcggatcgtggatgcgctcagctagttagataagcatattgagcttcgttcgcagccaagcaaacgctcgcgcgcgcagccggcaatggcgtcgttgtctgacccgaactcgccgccgccgcacgtcgtcgaggactgccgcggcgcgctgcagctgctcagcgacggcacggttgtccgcgccgccgcgccgccgccgccgttctacgtacgcttggacatcgacgacggccgcgtcgagtggaaggacgtcgtgtacgacgccgcccacggcctcggcgtccgcatgtacaggccggcggcgacggggggagcggaggagaagctgccggtggtggtgtacttccatggcggcggcttctgcatcggctcctgcacctggcccaacttccacgccggctgcctccgcctcgccgccgagctccccgccgtggtgctctccttcgactaccgcctcgcgccggagcaccgcctgcccgccgcgcacgaggacgcggcggcggcgctcatctggctccgcgaccagctcctctccgacccgtggctcgccgacgcggccgacgcgcgcaaggtgttcgtctcgggggaatccgccggcggcaacttcgcgcaccacctcgccgtgcggttcggcgcggcggggctggacccggtgagggtcgccgggtacgtcctcctcatgccggcgttcatctcggagaggccgacgccgtcggagctggcggcgccggccaccgcgttcctgacgcgcgacatgtgcgaccgctactgccgcctcgcgctgcccgccggcgccgacaaggaccacccgctcgtcaacccgttcgggccggcgagccggagcctggaggcggtggacgtcggccgcgtgctggtggtcgccgccgacggcgacctcctcagggacaagaacgtcgagtacgcggagcggatgaaggcgatggggaaggacgtggagctggtggtgttcgccggcgaggagcacgcgttcttcggcgtgaagccaatgtcggcggccaccggcgagctcgtcgaggtcatcaggcggttcatcgccggcgccgccgcgtaagtgatcgtgatcgagcgaacgccggcgacggcgaggtggtttgcctcgtgcgccacgtgttcgtaggcttattccacagatgcgacatggtggcaggcactgtgtccttgcaacaataattgagacaagcttaattacttcgtactacatttgtgttttttttttttgtggttacaaattgggcacaatggcaagcaacaaaggtcgacaaatttatgtcattgttgtgaaatagtggtcgcagtttatatggctgcgaaggaagtgtgacagtgaccgtaagcagaggtaataaagtcagcgtgcatttattattattttctgaggaacaaaaggaatatagtgtttccattcaaaaatataaaaatttagaccaaataagatattttctaagactacgaatctgacttgggacagattgagtacatttttttttcttccctgtggtatgtccttattcagtgcgaacatttaggatgagggagtcaaatagaaattagagtgaaatgagctcgaaagaaaatgaaaaaattggcaagcttccctctccaacacagtactatataggcttttcacgttacttgtgattaatcctagacaaatcttcctgtttcgtttattacccaaacgaaacgaatcacaccaaagagaacagtgatcgtaattttttttagataatagaaatggattacatcttcggcttctgtcataagacacacaactataaatttaatagtaataaaaatgtaagataaaagtaaatcaaaatgagaaataaagtgatgggacaaatccccaactcccctttattattgactagcgttaaaccacataaaatattttagctagcaattcttatggaattacgccacccatagtggaataagagacccttagctaccgattccaagagtgtagcaacattgtgcatagtatcctgctactcctgtggtagcattgtagactaaaagtggagccagtagaaagacatgaagataacctgcatagggttagatagttgtttaccattaaaaactttatcattgcgacaacgccaaattgaccaacatacagcactaacttcaattagaatcatcttcttaatggacctagatacccttctaagccaattaccgaaaatgtttttggcgttacggggtgggggatattaaaagcaaaaaacacatatctccaaacaaactgagcgacatgacacaaagaaaagatgttggattgtctcttgtgcatagcagaaagaacaatgtttgtctcccccattttcttttagctaggttatctttcgttagaattactttcttgtaaagaaattacataaagaccttgatctttagtggaatttttaagtcccagagaattctctttttatccgaacattacagtttatgatcgtggcatacagtgatcgtaatgtgatcatacaattactgaattgatgccaaaagcttggcaatgctctctaaaagaatactactccagcttagtagtgctaatatgttgatggaaaggccaaataagagattgtggtaaccgtggtaaaattttgacggcaaactagacattaaaatttttcgattttttttttgcaacacctgtatttgagttcatcaacaggttagtaaggtttacatcgattacaatacacacccccttcaactttgatcatcctgacaaaaaaaattacatctatatcctcgctttcttttttttttctgcatctatagatatatgcattattctgcttagtttgcagaccagtgatccactcatttgacctaaacttggtccgagtgaattttagggaatattattttcttcctttagcgtgcatgctcttttataacattttgaatgattatacattatattaacatactttttttttgaagataacatgaacaactttattcaacaagacagaatttaggggatataccccagtacatcgcacaaggatacaacttaagccaagaaaccatctctaacaaggtagagagtaaccactctaaggaagcaaactttctgatgaaacaaaacaacagtagggaattagatcgacagagttctgcggcaaagccacgacgattgaatcctttggcctccattgacatgcacaccgcttgacagactggaaggctactacagctgtcaccacggaaacggcacagatcagaggtttgttgtcgagccgtagattttggtgtaggtatcaccggactcagcagattggttccatagagtctttcattagatatgaggagcagagattgctcaacccgaatgatagaccctgcatggatactgctgttttgaagcaaaaggaagcaagattcaggagaacaggtagtccacatgacatgagaaatcagatggttgcgataaaacttctgtctttgtagaaggccgaggattgctgcaggattgtagaactgaagcggaccacaacaaatgaaaaggagcaagctcccaacgaagaagtaaccttcagattggagaaataagatgccacacccacacaatgttttcaccgttgcagaaaagcagcagctcaaggtatcaccagcgcacggagcagtagtacgaagagctccaaggctatcacaagaagcaacagcacctggagtttgaagactaccacacagagcagcaacacttgggctgccaaggttgtcgctcggagcaacatcgccagaaatttcaagaccgttgccaccacacagagcaccggcacccagagatccagggccgccaccgccgctgtacgaagcagcgccatccagagatccaaggcaaccgccgtctgcacacggcgcagaccaacgagttcagcaccagcataagaagaagattctgtccttcaagtcgcagctccaactccggcaatcatcaccaccagcaaccagggctcttcgcttgaacgtaaccaaatgagacatagccacaggaacaggaaaaacctgacaaagaaactacaacctagctacactgtactaataggagaggtggccggacccctcctccaaccctcaccggcggtgaaccaccggaatttggggggcaagaggggccggagaagaagaaggagctactgtagcaaaggggaaagttgggaggagaggagatggggaaagttgaccatccaaccagagctattaacatacttttaaaataagttaatcggtaactgatgttgacaatatccttttgacagtaggtttctctgttcgactagctttcggtgggggccaatttcttcctgattcacatatgttctcatggttacctcttacaccatttctaagttgcaatctacaaaacacatatactccatgccatagacgaatatatatactccataacatggatgacaggttgaactgcatgccttggtgagcacctcacaagtcacaaccatgctcagctactccctccgtctcaaaaaaaaaagacaaaccctgatttccgtgtccaacgtttgaccgtccgtcttatttgaaagaattatgaaaaaattaaaaagataagttacgcataaaatattaatcatgttttatcatctaacaacaatgaaaatactacctataaaaaaatttcatataaaacggacattcaaacgttggcacgaaaattcatggattgcctttttttttaaatggagggagtacttgtcatgtgatgtgacttcattttttccatagaaccgttgactcctctaccctaatgggtaataaaataaatcactttagtggctataggtacttgattattaactctaattcaataaagtcaactaaaacatatttcctgatttaatattaaacaggacgcgtgataaccccaacgggcccacaaattaactcttttgcatttcagtcctttgatcgtgattaagcccctacactacattttaatttgtacttctgtccaaactttacaataaggaccacgttataggaaaatatatctcataatacccgttgacccactcggcaacctaaataaatgctacaaactgcatctctttactctgaaaaacaaatattcatctctttcctccttaacatagagatggtgtcgtcgctatgaaagcccgaattcgatggcgtctccataggaatgtcgtattctgtattcaacacctatctttagggaagctcagattcgaggttgtcttccttatgtaatgcggtttagatcgaggcggagtgggccaattaaagttggccaaaaggcccgcagcccaacagcctggtccatggcacgaagttttggcccggcctaggcacggcccgacccgaccgttgggccatgcctagacctccttctcgacaggacgtgccagcccggcacgacacgaccagcgctcccgtaggccatagcccggaggtggcccacccaaatagatgagggaggcaaaatagacttattgtagccatataaggcacaaccgaaggaaatgagggagagaaaaaagacttatttcagctatataacgcgtgactcaaagagatgagggaggcaaaatatacttattccaaggacaagcacgataggttgctttggaccgacatggcacaacccgagttttattgggacgtgcctgagccgtaggtacagcccatgggcgggcatggcacaacacaactagtcgtgcccaggtgcgggccgtgccgaatggagctacatggtgacagggctacaatggctaaaggatgaacttgggatggcttttcctgatcgctagcaaaggcgtttcgctaaccttatttcgggtgtgtttagttcacatcaaaattggaagtttgattgaaattggaacgatgtgacggaaaagtttgaagtttatatgtgtaggaaagttttgatgtgatggaaaagttagaagtttgaagaaaaagttgagaactaaaccaggccttcttcttttctcacgacaggcgtggagctaactagtactccctccgtcgcataatataagggattttgagtttttgcttgcaacgtttgaccactcgtcttattcaaaaaattctgaaattattaattattttatttgtgacttactctattatctacagtactttaagcacaactttttcgttttttatatttgcaaaaaaaattaaataagatgagtggtcaaacgttgcaagaaaaaaaactaaaaatcgcttatattatagcctgtgggacggagggagtacgtgaacagaggcagcatcgaggagacgggggatggtgatggccgccgccgccgtagcttggcgcgttgggtgctgacatcaagatggagagggcaaacaagcagtgcacgtgaggtgcttctcgtagtacttggatttgccatatgcttcctggagcatcgccatttcttgttgtccggctgccagcatcaccctggcttaaggtcatccaccctccgcttatactgcgtcgtagcacccccactactctctcgctaacctctatcttttcttcccaagctaccgggccctctgcaggtagtgctaacaccctacaagggcactccttcccttcatagtggattccaaggctatgtggatgtttgagcatagaactgaggccacgcattgtacattacaagggcacttctttccttcacgagagtggttagttggaaactctctcaaaagaactcagttctaatgacccattagggccgctgggcttatcccatttttcttatttttgtcttatttcaactaggggcgattctacattatgtttttttttggggcctacgacacctaataaaatctagaacttcaatattactacctccatattttaatgtatgacgtcattgactttttatctagtgtttgatcattcattttattcaaaaaatttatatagttatcatttattttattttgacttgattcatcatcaaatgttctttaagcatgacataaatattttcatatttgcacaagagatttgaataaaacgaatggtcaaatgttaattaaaaagtcaacggcgtcatacattaaaattaaaatacggagggagtaattcataataataagagtataagaatatgatactagtacatgttttaataagtatgcacgggacactggataattatttttttagattctcactgattttaaccccaaagggcaaaggcccagacctaggggtgaaaacggtacggaaatttccgaaaattccggctaccgtttctagtttgcaccgaccgtttcagtcggtattggtaattgtcggtatcggaaatggaaacggtaatctcttccgaaaatggtagcggaaatgatatagggtgttttccgaccgttttgtcggtaaccgtttttttatcggtaatttccgtcaaatttccgacaaaattccgaagaaggaagccggctgggccttgctagcaggagcagcccattaggcatttaggtcggaaagaaaaaccctagggcgtcagccggcgtgtcgcttctccttctcatcctctccctgtcttatgactctcgcgctatcgcacagctcttcgccacgccgccgccgccacaaccacatgtccatgccgccacaccgccgcttgctagtcctagccgtcgcatcctcgcgcctcgccgcgtcccttgccggagaagcaagatggcacctgccggaggaaaacgccgcatcctagcttctggatctatccgacggcaacaacagagaaatgagcattgagttcgccaccgttgcgtttgccaggtccactaggtataggcgtatagcttgaatgcttgagcatgatttttttacatgtacagatgaatgcctgagccttaatgttttttagcacgattttctgttgatgtgcgagcgtgatttttgcagatgtacagcttaatccttgagcatgtttttttaagatgtatagcttgagccttgtgttaatcgttaatcacttcctctttttttaaatctcaatctgctgcatctggaagtgcaagtggaagtcatcatgtgggtgtgactgcatcatcatcctattgtatgctatagccacattgatgttgaagtatcgttgaactttgtttatattgtttgtcgaccttattgtcaacttattaatcatcatataacggtgttgtgtggcagcgtgatcatgcaagggtgaaattataaggtcatcttcatacatagttaaatgtgggatgataccacggttcgctgtttccgacatgaattttcgacttccgaccgataacagtagattcccgttccgatggttccgtttccgatataccgacattaccgatatcgttaccgtttccgagtataccgttccgattccattttcgaaaaaacaaaataaaaatggaaatggtagagggtttttccgaccgtttcctagcgttttcatccctacccagacctaccacgtggaaaaatatgagtgcttctagaagacaagaaaacgcctttgcttaccgcaagcgcagcagaaccacgcgacgtcatcgaatgcgtctcccacgggcagtacggccacggccacaccctgcacgagcccaacaaaagccagggccctgggtctacgtccattcgtcagtcaagttaattatcagctgaccgtccagaaggacaataacagtgttgacatattcagaatattctgaacaaagtgaaaataccatgataatccatgcttacaactctagtttaattcaattataaattcgcataatatatagttgccatcacgtttctgtttgtttcagctatgatttataagccgcatccaatttataatttagaattaatttatgtgtttttcttgagaacaccctacaaatgtaaatactcataaagcatgcagactcacctctataaacacatatgcacactctacctacgtcattacgagtagttgttgagattgatgaagtcaccataaacgtctcgctttcaagggtatgtcgtctaccactaaataattagcagtaaatgggagtaccagtgtcaagtctaagggttgattttggatgggctagttccaccacaaataacctaaacaattgagctacgctcatttcacgtgtgttttttcattgttttttttaatataatttggtctctaaacctttaaaccggtaataagaatagaaatgtaaaagctttatcctaagactacttttctatttttgcaagttgcaacgtttatgtttgccattggattataagccgtggtccgtggaaaagaagaagaatcttctaaacttatttgccatttttctcacgtctctgcttttggactagaagagtaaaagcttccctattctagaaggcatctcgttctcttccaagttccctatataatgggctccacgtctcgctctcacaccgcaccgacgcatcagctaccttctacgcattaacgcaaacatctgcacgacacgacacaagcaatggcgccggcggcggagccgtacgtggtggaggactgccgcggcgcggtgcagctgatgagcgacggcacggtgcggcgcagcgccgagccggcgttccacgtcgacctgcccgacgacgccgacgccgccgtcgagtggaaggacgtgacgtacgacgccgaacacgacctgaacgcgcggctgtaccggccgcgccacctcggtgccgccaacgacgcgcgcgtccccgtcgtcgcctacttccacggcggcggcttctgcatcggctccggccggtggcccaacttccacgcctggtgcctccgcctcgccgcggagctccccgccgtcgtgctgtcgttcgactaccgcctcgccccggagcaccgcctccccgccgcgcaggaggacggcgccacggccatggcgtgggtgcgcgacagcgccgcgcgcgacccgtggctcgccgacgccgccgacttctcccgggtgttcgtcgccggcgactcggcgggcgggaacatcacccaccacatggcggtgcggttcgggaaggccgggctcggcccgcaggtccggctgcgcgggcacgttctcctcatgccggccatggcgggggagacgcggacgcgcgccgagctggagtgccgccccggcgcgttcctcaccgccgagatgagcgacaggtacgcgcgcctcatcctgccgggcggcgcgacgagggactacccggtgctgaaccccgccgggccggaggcgccggggctggaggcggtggcgatggcgccgtcgctcgtcgtggcggcggagcacgacatcctcagggaccggaacgagcactacgcgcggcggatgagggaggagtgggggaaggaggtggcgttcgtcgagttcgccggcgagcagcacggcttcttcgaggtggatccgtggtcggagcgcgccgacgagctcgtccgcctcatccgcagcttcgtcgtcgagcacatggactcggagtagcaaagcactagctagctacatgatcaaagattagtcaattattaaaagtgatttagactttttctacataattgatgagttgagagcgatttgtatttgttaggtgtgttttgatcttatcttagttattattgatatgtttcttggtaatttgagaatgaatcaataatggaatgccacatggatggcaatgcttcttgatcaaatttattcgagtgaagacagaagaacaatatttctttttcttttaaagaaaaactgagcatccggctttgtggagtggtaattgttttgtcggggcactaactagtggacttatacataaagttgttcaaacatgatttcaccgaggcatgtaattaaacaataaggggatgccgattaggtattagcaatgggtagtcctaggtcgtgcccctagcgatggccgttcgcttttccatcggcgccgtcccgtccccctgcgatggaacgcgtccctctgctgggggacgcggctctctctggtcctcgccagcttttcgtggggagacgcagccaggcgtcgcgttgagtgtgtgtggagctcgtgggcacggcatcgtccccccaaatttctctttgcacactcgcctcactctcgctctcctctcggtctcgtcgcgccgcgcctaccacggttccacgccttagagggagagagagagaagagagaggcgacgaagacgacggatccgcgacggcaacaaccggatccggccaccgcgcgtcgtggcagccgtcggccgccagccggcgacgggcggagaaggcttggcgcgcccatgctcgccgccgaggagcacgaggacgacgtcgtggtggtggtcgttgcactcgggaacgacggcgacgcgacccggccaccgcgcgccttgcccgccaccgccggcgccgcggggggccagatccgcccactacggcgccggatttggcacccccgactggccacggcgcgaggcggaggatgccagggaggacgccgatgggagagaggggcggcggtggacgccggaaatattcctccatatttgacgatttattgcaaatatccctcccccctcctacttcatcttggtttgagattcccccaattgctattacttgcccattttcattgccgcaaaccccacatgataacacgactatggagacgtggtcaccactcatatcggccaggcatggtaacatgattgtgaaatctcggctcaatcgctcatgatgtttagcatttccttggacgggtcataagttttcgctcttagacatcgaggttgttgaaagatgaactgttatgcttgtcttatagggttcagcagtggcttgtttctttaacagatttaaagatgagctcggtatgacactgtatccttgagaaaaaaaaatgtgtatatccatcaaggaatgtgctaagtcatataacacaagcaaaaaacaggcaaaaaaaaaagaacagcagcaattgctaattggggaggaacagcggcaaacacacagaaagaggtaaattagagggggtatttgcaacaaacattttatagggggtaatcttaaaggtgacatttggagtggtttttgtaatttttcctaaatagaatggcctgccacattcaattttcttgagttcctctgtttgtttagaaaaaccagtagtagcctgtctgaagccggtagtaattagttgtcggaacaaacggccggaatactttaaaagtttatttaaatttcaaatttataataattttgataatttctcatagaagcattttggcaaccggtagtcttcttgttctatgtcatgtaacaagtttttgaaagaggtacacataaatgaccagtgtggcatgatctgattagaacattgaacccaaaaaaaatccaagcagaagcaggctgggattacctctttctgtgtcattatccttattttttttagataattgtcattatccttatactgccatcgatcgttgagaaacttcccaaaaaaacaccggagcatcagtttccagagatgacatagcagcataatacgtgtaatgatagtatactactgaacataaggaattctttttctatatataatttaacttaaccattggtacatgagggcaaagaagcttcaaagaaaaaaaatcgtataggagctcaagaaatcatgaaaatttccagtattaatagtgatggcgccattgctctctctccctgccattctttattttatttttcttactagtactagcaaattagctggccaaaccaacaagcccaaccgagtcaacacgctcatgcatcttttactccggtgaaattaacatctggagtcattttcatcagatgatgatgcattcatgcatactagtactaagatctacaacctacgaaggataaattaagacataacatcacgacttaggccgtgtttagattcaaaattttttattcaaacttccaacttttccattgcatcaaatgtttggatatatgcatggagcattaaatgtggataaaaaaatcaattgtacactttgcatgtaaatcgcgagacgaatcttttgagcctaattacgccatgatttgacaatatgatgctacagtaagcatttcctaatgacggattaattaagcttaataaatccgtctcgcggtttatagacgaaatctataatttattttgttattagtctacgtttaatacttcaaatgtgtgtccgtatacttaaaaaagaaatttgacacacgaactaaacatagccttatatagagttatactatctcatattgcatcaattgcacagtttatatatgcatgcaaagttgcgaatgcatcttcttactccaagttctgacgttattcaaatacaaggtactagtatgaactactcaacatgggctacagaatgtcaagatgctcaatacctgatttgcctgattcagaattgatccttacccccaaaaaaaaaatcagtgatgcataaacaacctttgttgctgatgctagagagcaaaatagccggctcttattactgaaaccagaatacaggaaacagctcgtctggcgtggtaagcgtaaaggcatagctaaagacaaatttcagtgagcacagaactgaggacgtacaaaaacagtacacaagagttccatgctgcaagggattatactcaatttaaaaatcatcttccaattgcattacattcataaaggccatctcacatttgtaatctactgaaaagtatatgataactttagtagatttttatagctaatttagctttgatgatattgaccattgttggtgcgacacacagattgactaccgcttgcacttggcttttgccattttcttcctcttcttcttctcagcctttgggatcttatctttgcgagcttctctcttttctgcttttactttcttcttgttttccttccgagcagccttcctttcctcaggtcccaccttcaaaatctcatgccatgaaccgtcttcatcggaactagtgcaagattcactatgttccgaggagcacttattttgcagatccaaaggttcttctgattgtacttgctgggttttggtaggctcgtttttattccgcacaaatcctagcaatggttggttgtaaagcttatccgctgttggttcattcgcgaaggatgggcgttgcatcaatgacatgttgacaatatctgcttcgcattgcttcacataatccagcgtctatgaaatagaattaacaatcaagcatcagtaattcaaacatacgccatcatacagcatgcagcacaaacattacaaacgaaacaaaatgaacacaacgtaattacaaaatagtgtaagtcatagatctagcaaagatcacggcctatatatactgtagagcaaaagcatgtagaaccaacaaaataaatgtagagttaaatattgaattatccatgattgatgagtaacataatgtttagtaaatagagattttttggcaaactgtgcaaacaatgatattaacttattcattatcttacctgaaccaagactgttggggtgatttcatcgtcgtttgcaaccatatctccattttccaacatcttttgctgaatctaacatcacaacaaaattgttaatccatcagacattctgcccatcataaagcaacatgatcagggcacatctagaactcagtggctatagaaagactgaaaggtgacattgagaaaataccttttccaggtaatgatcaacatcttcatcagcaatattttgatcaatcacaaaattaaatagttctgttactgacatgacagcaacaccacgttttttaaagaagtcctgcaaatagcatcacacacatttgaatatcacaacctacgaatgtctatgcagtgtcaattcaacttctactcacagtaacatgcaagcaatcttccttcaagaattccaacgctgaaggatgatcaaggtcaacggactgcgaaacatcaatgatatacaagtgtccctgcacaaggagaataaatggtgggaatcagagccattgatctgaaaaaaaaaatgatgttaaaaaatataataaacagagttcaactacctcgaaataaagaatgttgtattcactcagatcaccatggaccagtttgcatttttggtagagtgtccgcattgtcgtaattaactgaaaaagaagttgcatatgggaaaactgaaggtgttatacacataaaaaatacactaaacagttcccttacgaaaaaacaataagtgcatattgcaggagtacttatgctcccattgttctagaggcaacaccttaatctgccgaactttctgaatacttgacagtaaagatacaatagtgtccatgggcatgagcaaatgaaggatatatgctactgcttggatatcaggggaaaaactatgcaaaagagttttcatgcatgaacattatcaccacacattttgcatgatagcacatcaaaatgaagtgggcatttaattaggttcaaacccaaaaaacaatgctgaacatgttgctaatagagactctcctagatccacggccctactacccacttaaacctttccagatttctaggaactgaggaaaatacggccttgtcttcagctgtcacattgcattcacattagtgcgtatttattatctgtaaatagatacaaacaatcctttctacatgacattatgataggatgtgaagaattcaatgtcaatgcgtcatcagacacaattgatgacagccactgcgtgttgtacatggatacagcaagttttctatcctgggtaagaagcaatgtaatatagagcagatggatctattacagatttacaattaatatgaactacaatattatctttatcttcacaagatacgtcatgtacctcaaaataactttcacgcaacttatcatcagataaagcagcatccttgagacgaggagcagcccaacctccttttcctgaaggaaaaccaaatcgaattacaagatgtactgaattattgataattccatagaattgacaaatgttaacaagcatccaaattttaccctttttatagatagagaagttgacaagcatccaattgacaaatgttaaaacacaagttttacctataaattccatcaccagtacatgaagcctcaggagcaatggttttgggcatcggattccagctgctccaactctgaaacaatggtaacaataagcatatgaaattcaaataatcaactattgtatttgcataggattgttcctgttgaacaattgaaaacatttggctaaaccaaaacagaaataagtttgtctctaattgcatccctttataacacaaaaaataattcaggcaacagaagaatcccgttgaaagaagaaaatttactgagtaaagcatgaatgatgcaaaaatgagaagaatctcaccgtaaaagatttctcatttccttttcagcccaggtcttcaccattttccgaggattatgcttgcagtaaccatgtctaaagcggtaatctccatggacatatcggtctctatccctgcaagaagagaataatgtagtttgttcacatgcaagttatttttagaacaagttgttttagtaaaactagaaaacacagaacatatccataatcaacatatctgcagtagctgtcaaaaagtaccctgttacaaaagaatacgtagatagatctatgccttacttaaaaacaaggacagatgttttatagactttgatcgctaactcctggccatcagcctttgatgcatgatagacatttgcctgcatagagaaaagaaaattgcacttgcagtccaggccagattctgtatcttttgtatacagctaaagtgctctatactatgtatatattctcaacatgctttcttatccacatacgaaagtaaattgcaaatagcagaaagcaatgtcaataagatatgcagttgaactaaaaaaatacctctttccctgtagaaatgcacccatttatggtattaaaaaccccccggtttaacatcttgaacagaaccatgcgtgttcttggatcaatagcctgcatgtgaacaaacaaaatcccgtctagttgtcaaaaatcatttcacaaaaatatcatcaatcatataagtcaaaacatgttatcacttttctagaagatcataactttctctagataggatacaagagatagatgctgcagctataaccactgaaaatttcattgaatcataacctcaaaaataagaaaatcacatggctaagagagcattcttatggatatcaagcacacaaagattataagtattaatggatgacatataaaggagaaatgaaaatatgagataatatgctagttaacaacattatagcaaatgcactaggcattaagtcagtgttgttcaagcttatattaaaaactactgcctaccaaccttgtgaacacaacaggccataaaaaaaatacatcttaggaacttcctaccaaagcagtcaattgcactagagcgattttcttgaatgatacagtccaaattattgtccatgcggtacagctaaacaaggcattatataatatataacacacggagttggtgtacacataataagagcaaactcggatgaacagagatggatgcttttttagtttgctattaaacacaaaagggggcagaagtgcaggcagcacatagtaaatttaagaagcacaagagtgaaatggatacaacctactaagaaaatgtgtatacctgttctactgtagcacgatcagccttctctgtgttccttgttttcccaattgccgtctcccttatgctgtcccttatcgcagtcgtcactgaatttgacatccccacgttcattctaccttcccattcctggacaattcaaaattcaccacattgcatttcagcacaacttcacaaagtaccacaacacacaggtgaacaagcattcctcacactcgcacaacgcgcacacgcacacaggtaagcactccgatttgctacagggctaagcaccgcagttttttttttactgcaaagttacatgaaatcaagttgaacaatacggggttctaggatgaatggattgtctaaattccaaaacaaaacaatatactccaaaatttataacgtaattgcatacactaatcgcttgcaaagtgaaattacgcaaacatgggatcatcacataagcaggcccagtgaaaaattggagtgtgcaaccaacacaaagcacgaggcaccgactactacgaggcgagagagagaggagttggaagctgcatacctccaggggtgtggcgcggatgtgcgaggcgagcttctgcgtgcggttggagatcggctggaacgggcgggacagcaccccgccgtgcgcgttcggcctccgcgccgcggcggcgcctcctgccgccgtgaaggcggccgctggccggccggagccgtcggggccctccgcggcgtcgagccagtcgagcgcatcggccacgtcggagtccgaccactcctcttcatcctcctcctcctccacctcctcctgatccttactctcggccacctcgactggcctcaccgtcgcttcctcctcctcctcctcgtcggcgtcggcgaagcggctatccacctcgggaaggtacacggcggcggcggcggcggcggtcgccatggttgaagcaaaaccctggaacggtcgtggcaacacgcgggggattacgcatatgggcttactactacttatcgtggccgtatggtgggccctaatgggctacggcctttctcttgtgggccttaatatcggcccttctatatagattttgggcttaatttttccagcctgtacacatgagttacaccgaaaattcgtggaaaataaattatatcaccgaaattttgacgagtttcggagaaagttagagaaagtaactggtctctttctcttctgctattatatatcaccagtggcgggcccaggtttttgaacttgtgtattcgaaatgagaaggggtaaaaaaaattgttcatacacctaaaagcctaaacatatcaaagtgccaacataataacatatgaaatacaaaaatgaaagaaaatgataaattaggaagaaatcttacaatttagagattaacttttcgacgcttgatattttgaaaataatcgatgatgtccttgtccttagcttgcaaattgaattttttttaatgaagccccatcttgtttctccaaaaaagagtttaaatcaacagctggcccttcttcgtcttcatgtttcagttctgaaaattaaacaaatttgataatatggtatgaactatgaactaccgtccagtgtccactagaccactacaaactaagcaagcaagtacactctcactaaatcagtgaattgcagctcccaatcctaaaattttcactacatttattcaaatttgtgtactcactaaatcagtgaattgcagctcccaatcctaaaatcttcactacatttattcaaattttgtgcatgtacagatttagtcactcactgtgttgtcactgttgtgctgctcctgtcctgcgcggcttgctgttgctgtcctgctcctgcttctgcggtcctgccctgcgcggctgagccggtcagccggccaggccaggtgccggcagccctcagtggcgcagccgcctaccgccctgcgcccggcgcggcgccccacatcccacgaccacgagcacgagggcacgagtcgcgcggccgggccggcgccacaagccccgcctgctcggcggcgcgccgccagccgcacgcctgcgcaactgtcgggatggatggggaggcgaattagggttagatgggaggggaattggggatatgtcgaaatgggctgagatgcaaggttgacaacggcccaattagaccgcgggctgagaggaaagggggaggggagtgggaagttttggcccaatagagaagaaatggtgaaataaggtccaatatgagcagtttaaggtttcttttttaattttttaaatacatatacgaactatagagtatatatacctattttttgtccaaaaatcttgcgtatacatctgaatacccttgaatatacactgggcccgcccctgtatatcaccacgtgccaactaccaaacatttttcattgaggaggagacctttttctttttttttctctatcttagatttgttaatcgtgtttgaattacaaaattgtttgctaagttttttttttttgaggtagctagccgggtacgtctatactctatatgccgtacgttatctcagcctgagtgacagagtgagagtggcgatacaggacaagacagtcatactctacgaaaatccgcaagacaaaagacagcgtttgcttggctcgtattctaccactgaattgcaccgagtttacacatttggccgaatactaataaattctacctttcttgaaaaattgaaattaaaccaaatcaatttaccaccttatgtctgtggactgtggctgccgtaagcccgtaacgcgacgtggaaagcacaaacataacacagctaacatagctgcattaaccattaaccaattgatgattaacttttctttttggtttaatacggagtacaccaaatcatccaattttaggctgagtttgtttctgcaaactgggcaagcaactctctcatattctattagcatattttccctaactgctaaacattgtattttacataatagaatttctacataaaagttttagaaaacaaaataattttttttaagcttatagtaattaatatttaattaatagtatgtgctaatgatatagtagtatctcattttagtgctagtgagtgatagagtttaatcttgtcattaattagaatatatgcatggttctattttgtttacatgtagtataggtcactgcatatttagtttggctccagctcattggcgagatgccgacgtgccgtgcgatgcggtggtgcgagaatggagcaaacaacgttcatgaagaccaagctcaactgcatgtggagtgctgcgagaagtagccgaattgcaagaaaggcaaggtcagtattagccgagtgaatcggtcctagctgtgcatgagatttagttgttgctagtgattagctgcatgtgctgcgattagtggtaatcatgtaaagggatttcttggcaaataagtaggattagttagttacttagtgcatgggcatcccacgtttgtgtgcatggcgtgagttgtggcttagtgggtttggccattgttatctctttgcatgtactgagtctatataaacaagaaaacgatgtgagctagttggctgcgtcaaccaaaagcttgagtgtgttctttcagttcttctgtgagtgtgtccacgagaaagaaaatttgagtgtttgtgattaacacctagagagtgaggagagattcctaacagtgagctcgcacaaatagttctaatcaaatccaagctatccaaacggcacattccaaagcttaacccgcgtaattccattagcttcccgagcgcgcgcgcgcgcgtcgaccggcttcacctgcacgctcccatggatcctatcgccaccgcctcttggccgtcgacgtcggcgtcgtcgtggccgcggtcggtgaggcgccgcgtgccggaggcggaggaggagagggagctcgggcggcgggtggaggagatggaggaggcggtggagcggctgcgggcggagaaggaggcggccgaggcggaggagcgggacctccgcgccgagctggacgcggagcgcgccgcggcggagacggcggcgagcgaggcgatgctgatgatcgagcggctgcagcgggagaaggccgccgcgctcttggaggcccgcacttccgccgcctcgccgacggccgcgccgaccgcgacggggagctccaggacgagctcgcctccctctccgcgctcgccgcctcctacctctccctcctccacgcccacggcatcgaccccgacgacgacgacggaagcaaccagcaagagcagctgcagcctcccgtcgaacacctggacgcggaggcagacagggagagccgctcggtggttgcgtcgccgcctccgtcggagaaggtgttcgcgtacgcggccgcgacggcgccggccgcggattgcggcgccgaggtgacggagaatctgtacgcgagggtggaggcgctcgaggtggactggtcggcgatgcggagggaggtggcggcgctgcgggcggagcgcgcgcaggcggtgctggcgagggaggtggcgcggaggctgtgccgggaggcggcggtggccggcgagaggggcgccgtcgccgtggcggcggagaggccgaggttctcggtgctcgccgtttgcaaggtagaatttcagctctgtgcatttgtattggatgatcaatcttgtcttgcttaattaatgttctgaacaaagcacttctggctcttaaatggataaaacttgttcaaattttgcctgatttcactgagctgttattcgccatgttgtacacttttaaaatgttggccttaaatcccttaaaaaaaatgttggccttaaataaaagttccctttcatgctcaaatcaaaatggtgttttaagtagtattggaggataaatgttatgggtttgtaggaacattttggttgcaaccgaacaccgtcaaaatactattcaaaatgtcaactgccaacaatttatagggcacattttggcttcaaatcaaaatggtccttaattctcctgccttgcaataacttcgaaattttggtttcggctagttgatgtaggccgtgtttagattcaaacttttttcttcaaactttcaacttttttcaacttttctatcacatcaaatgtttaaacacatgtatggagcattaaatgtggatgacaaaaaaagcaattacatagtttgcatgtaaatcgcgagacgaatcttttgagcctaattacgtcatgatttaacaatgtggtgctacagtaaacatttgctaatgacggattaattaggcttaataggttcgtctcgcagtttacaaacggaatctgtaatttgttttgttattagtttacgtttaatattttaaatgtgtgtccataaacttaaaaaaaattagcacacgaactaaacatagccgtaattattaaacatggagtggttaactgtagtcgttattgtgtcagcaattgcatagtagacgtgttgactgtcaagatcatttcctcgaaccatttttggttgacttgttccaaaaggcatagagcctcgcagggattattcctgttgtttaatccactttgtgtgtcctcctaatgccaagtcagagcttttgacataatctgaataggatcactaaacaggatgctgtgtgcatgttggctagcatattttctccaagattatttcatttttgtttggtgcaatacgtcatgtattttctgaacaagtctgtcatagcgttacgcaagtacggttcattttacagtggatttcgccttaaggccttgaatttcgttgttgctctgctaatgttgaaatgttcaatatacttggtggattattatgctatgtattgctctgcaaaccaatggtttctgaacttttcatttcacttccatgctacagcttttacagcttcgttagttcaaattataaattgatcattccaatgaagggtgtgtttagttcacgccaaaattgaaagtttagctgaaattgaaacgatgtgatgaaaaagttaaaagtttgtgtgcataggaaagttttgatgtggtggaaaagttagaagtttgaagaaaaattttagaactaaactcggtctaagtatcctgctatgctattctaaattctagtactatatatgcaatagttcaatgccacatccgcttccaacctgaaattatcactcgagaaatgataaggaaaatgttctttgctgctgtagtcttttctgcattagaaatgtgctcttgaattaaacttaattttctactgcctccagaaaccggcaagtctggcaacatttacgattccatctctctaatagtaatatcaccccttaaatcattttcacttttacagtggatttccttcataatcttcaggagaaagagatgtcatactgccaggtacgtaagaggcttttatgacttctgtttcgcctgtttctttgtatacttcaggagaaagagtctgactgtcagtagcagtgtcggatgaacatcgtgagcttattatgcaaagcaaattttgtcaaatctcaggtttacgttcagcttgtcgactacgcttctctgcctgcttctactcgtcgacaaatccgtcccgctgcatcgacgacgacggccacaaatgtgacatgtattcctttaaaaaaaaacatatgtgacatgtacaactaatacacgacgcagttcaaacgaccaagttcagaaatcagaacatagcagttttctcaattgtaaagccaaactgatgaactcctgtaaaatttgataacttttacggtgcaattaactagactgataaattatagcgtaaaagttctcgtaccgtttctgtcttctagccaataatttactgctacctccacttcatgttataagttgttttacctttttctaagttaatgttttttactttggtaaaatttttaaaaatacaatattttttaacataaaataaagaaactattaaaatatattcaatgttaaatttaacaaaactatttgtgctataaatattactatttttttataaaattgatcaacctcaaaagtttaatttttataaaattgattaaccttaaagtttaattttaaaaagttaaagtgatttataatataaaatggatgaagtaataataggcctagtggcggaaacaggggtagggtagctagggctactgccctactcctaaacctaaatttccactaaaatttatattttaaaatctcaaaacatataagatgaagataaattatgtaaattatactagttgacttgagccttatgtttaagaaaattatctgaattaggcccgaacatagactcggtggatttgaaatgctagtacgtttgtacttactactgtcatagaaagatgagttaaaacttgcaaacccaaaaaaggattgaacagtactacccaccaaaattggcatttggctcggatggcgccacgtagcatttgcaggcacctgaaactgttcctactgttcgtgcggctgtgccgcggcgcaccacgacgcggcggacatcgtgacacgtgaagaacgctcacgctcacgtaaccaaatacaccaacgcgaaaagcacggatcaaacacaacacagagcaaattcctcgtcgcattgcgtcaggacgggataggatgtggtggtggccggcgttcctgtacccgccgccggcgccggcgttcgtggcggcggcgtcggtggcgcagttcgcgttgctggcgaacgccgggctcggggagctccgcggcgagcacatggcctactccaagttctggcaggtcgtcgccgggaagaagaagaacggcggcggcggcggcggcggcgcgctgctgcccagccggcaggggatgctggtggcgtacgtgccggcgttcgtcgccgcggcggcgtcgttcgccgtgcccggcgccgtggtgggcgtgcgcgcccaggtcctcagcgccgcgctcaccgtccactttctcaaacgaattctcgaggtaattcatggccttgccagttgccaccggtttttgcaatcaactatgctcatagccttatagcgatagagtttacttgcgtacgtttatatgggtgagtgtgcgtgtgttatgagtttctacgttatactgtgtaattcttagaaaaaaatccatggaatgatgaaaattaaaagatgattgtttagccacaattcttttcatcttttctttaaggtggcaatgcacagtagcaaagttttttcggtctgctttgtatcccccataccccataaccacctcagcgtgttatcgatatatgctacttttttttctaatatattaatggataaggtttttacatgttcacgagaaaaaaaaagaacaattcaagatccttgctgaatgctagtggaaaatacatttgatttaagaacaaaactttaaatgcaaatgaaaacatttggcctgtacaccaccactaggtatgcaaagctaacgaaatcaaagcataaatatgcatttttttatttttctgcaaaattatataagtccagttagattgctcaaattttgaagttaataaaacattgaggtgtgaaaaagtgttgaattacagacggtggtgtatatcagtaccaatttgctaaatttgagttcattttgcttacttttccaactcatctctcgttttccgtacacagttatttaaactactaaacggtgttttttttaaatattttatatacgaaagttgctttaaaaataatattaatctattttttaaaaaatcaactaatatttaattaattatgtgctaattagatgcccaacacaggcttaaatattcaatgcattaaattgttttttaggtactgttcatccatcagtacagtggaagcatgccactcaacacggcggccaccatctcctccagctacctcgtcatcaccgccaccatgatctacgcgcagcacctcgccgccggcctcccggacccgccggtcgacctcctctaccccggcgtggccgccttcgccgtcggcatcgccggcaacttctaccaccactacctcctctcgcagctgaggaacgcagccggcggcagcggcggcggcgagaggcagtacaggatccccaccggcggcctcttcgggctcgccgcctgcccgcactacctgttcgagatcgtcggcttcttcggcttcgccatgatcgcgcagacggcgcacgcgctcgccgtggcctccggcacggtggcgtacctcgccgggaggagctgcgccaccaggaggtggtacgagtccaagttcgaggatttccctgatagcatcaaggcgttggttccatatattctgtaaatctttttcattttgatgaaaatttatgtaaaatgaataaatactgtacaagaaatatcttaggcttttcgtcgcttcgttttgaatttagactagctgtgacttgtgactatgcatgcaatgaaacaaataattatacgtgaggacaaataattatacgtgaggaaataataaatcccaacaaaaatgtggtgaaatttgattgttttttatctggtttttgatgtgccaaaacatccaacatctgatccgaaattttaaaccctgtgtcaattgcactagaagaatttctatttccttttgaaatgaaattaagcgcgagaagacctgttagccttgcccttaggttaagtctaggtcgttttccatttcaaacaatttcagcagacgatgcgactttctgtcattaaacatttttttcaagagaaaaacaggggtaatggcccagtaccatagatagatgacaaagattgaaattgaccctcatgaaacatataatgttccattgtgcgtaccataaccgttcttcaaaataatatggtaatttaaaattttcagttgattgtgatttcttagtttcctcaactatgactgactgaataaggattcgatcggatgtgtcagattcatgaatagtaactgatgggttggttttgaatgttcgaacatgttgaccttttaagcttgatagtgtcatctcataagcactgtaattaagaggcatgtcaagttgcagataattcaattgacatggtctagaatcctgcctatatgtattattggtcacggaaatcatgagatcaatcgacgtcaaagttgtcatagactgaagaagtacgcaaattagttgagacttgagaggtatagtattttacaaaaatgtaaattctcgttaagatctttcttcagaagttcagagatcatgattgggattcgggcagtcaaggatgaaaatctactctatttcaagttgtgcagattaatttactaagtaggtcatcattatctaaaaaaaatttactaagtaggtcatatgcttcttgcagggattagctgaaacttcactggatgttttaaatttgttctgaatgtttcttcagatatagcattttcttagtatcacatgaaaatggtcaaaagaaccttcttggatgaggataaaatatgaatgttttatgaaaaaaataaaacacctccaaatcaagtctagaacacacttcatagaacatccctggactcagtgagtttatttgactctgtcagaccgtcacacggcttaattaatacatgccgtgttaatttcctacatttcctaccaaatgtatcgaggttgacatgagcaggatggacagtagaaagcttgcttggaccttgtcatgtccgagtgaataattggcatttggtaaaattagtcattgtcatgagtcgtttgcagtcaggtgaagaaatctactcttgatagcgtgttatcgtcttaattatctgatgctgacaagttgaaatgttgttttgcctgatcaagtaccatgaatgaatgactctgcaaatgcagtcttatcatgtgttcacgagaagagaacatgcttttgtaaaccagttcacagatgaattttcacaccttcagtccaaatcgacctataaattgatagagaaatataaaaacagagtacgctgtgaattctcagatattattagagggatctgttctttttattttgacatgtatagattgaattcatcttaactacgcagtaatttattttcggtttgtttaacacaaatttgttttcaggatttgctttcagaattgtgcatgatcatttaatttagatggcgttcaaaagacggtgatacatgccctggtgtaaaatgaatttccctgatctcaagttcagataatgcctggagcttaattttcagaaagaaaaagaagaggaagttcataatctttcagtagaagaagcagttgaagatctgcaaagtaaaatgcaagtgctttttcacatggaatttgccttagttatccaacgtgcaaaaagcaaccatacttccaaaagatccaacaatggctagacaatttgtaatcaaacctatgtaaatattagatttatatttataaatatatatacacgctgtagaatccttttctacagtttttaacttcaaaacaagagaggaagttcagataatgcaaagtgagaaggctgatgtatattggttaaataaaatcaacaaattaattgcacttaatgtgttaactattaaaatgatcaagaaatgtacagtgccgaataacaaaagtaaaataacatccgaaggagcaatataaactgaaacaagctacacacatactacagaagtacagatcggttagcacttcgagtgcgactgttcgtgctaaattttcccctaatcgagaaaaattttgcacgaacactgtatgatctgatacaaacattgattagaaatttagaactctaagacataattagaacaaaacgcccagctcttgcaaggcctgcatcgtggtcggcgagaagaagaggctactcggcgacagaagagaagcagccgccggagatggaagaagaaatggatgcgccgaatggtcgtcgtcgtcgtcgtcgttgtcgtcaatcgccggcggagcaggctgacgctgctgcccaagcgcgagcaccagtgggtcggcggcggcggcggccctgcctccggccaccaggtccggcaatgtcgcggttggatccgacggcgccgtcgccgtcgccgtcgacggcttgccggtgagcttctgcacgatggccctgaactcctccggctgcgcgtggacgaccctgggcgtgagctcgtacacgatcaccggtcccatgtcgccgccgccggcgacgacacggggtttcttggtcggccgactcgcctccgccgccgccggcgacacgatcagcgactgcggccgcgggccctggatgctaccgccgcctggcctcttcgccttcgacggcgaagacgacgacgacgacatggctcgctctcgctgcagtggccgcgacgtttgttctcgtcagaagttgctgctgctgctgctgctagaaaacaacacccgcgaatgcttatataatggcgccaagcaaaaaaagatgacgtcaaaagcgcgcgaaatggtcagacagagttttttatgtgattaaattgaatattgctccaagcagcctgcagcgtatttaactaaactatgcagaccaaatcattatacacacctaatcatgcaccttaacacaaagatccgtcattagatatggttggtgttagtttaatgataatctaattacttgttaattagtagccgcatacttcctggacagtgcaaaatgctgtcgacagtgcactagacggtcccaaatatatatacttctctgacagctgcacgcgggtgcttcgtttcaggtggtcaggaactcagattgatcatcagcagctgcatctgcatccagtgcatatgaacttaattagcttgcttgtttaacatgaggttcaaaatgagacgcttgattaaaattaaccagagcgattaatcagagagagagagagagagagagagagagagagagagagagagagagcgactgagcgagctttgcgtagcggatgatgcacgcacgaacgtagtgcataatggccgcctggccggccggatcgaaggaggcagacagtagcttaattaaggtactagtagttatatttgactatgctaattaattcccatgcaaatctatctatctatccatccatccatataggcaggagtccttaaaaaatctatccaagcaggtcaaacaacgcaccactggtagagaaaccatctttcgttggtcggcctaattccacaatagtcccggttgcaacaaaaaccgggactaaagatgatatttagtcccggttaaaaagggtaacgggcatatttaacaccaatcgggactaaagatcatcttttatcccggtttaaatgctgtcagggcttgtcaaggccccccccgggatcttagtcccggttggtggagatcgtactttagtcccggttggtgttaccaaccggggctaaagatcccggtgatctttcgccccggtt

SEQ ID NO: 3295 - DNA, 3073 bp, Oryza sativa
gggactaaagtcccacccctatatatatatatatatatatatatatatgtctttttcctcctccagcccgagcaagcttcaaaatttcttcaaaaaagaggggaggtcatgccaaaatttctagtgaatttattttggtgattatatacaaatcggaggtgcctaaaaggttagcaacttcatcctccaatgttttttttgtcatattacatttggagctatgttttgcacacttttttgtctccaaaattttgttgtaagttgatgagagagaaaatttgtgtggggaagaaagaatatatagaaatttagtttatttgctaaaaaaggttttataaaatagttgagaaggaaaatatagtgaaagttaatcttgaataatagaaaacaaactaaaatgaaaattaaaagaagtacaacacattaatattagtttaaaactttagaaatagtaaataagaattatttggtgcaatatttcataatttttgtatgaataatgatatgtcactattgtgtgactgttgaaagagtttgtaattattttataattattgtatgaataatgatatgtcactattgtgtgactgttgaaagagtttgtaattattttataattattgtatgactgtcattattgtacgaataattatttgtgtacgattttttttcatgtcatgtagatggatcggcaatggatgtacgctgaccggcggtccaaagagtttattgacagcatgcattattttttgagagtggccgaagctaacaggcaaaagggttttatttgttgtccatgcaataagtgtaagaatcagaaggagtattctgcatccaggactattcatttccacttgtttgagtcggggtttatgccaagctataattgttggacatcccacggagagcaaggtgttgaaatggaagaaaatgaagtggaagacgacaatattctggactttgctcagtacgctagatttgaaagaaatcaaacgggcgaggaggaaagggatgctgatggtaacgacgttgtggatgatcttggtcagatgttgcaggacgccaaggaggactgcgaaagtgaaaagggggcccataatttggacaagatgttagaggaccacagaacatcgttgtacccaggttgcgagcaggggcacaaaaagttggataccactctggaattcttgcaatggaaggcaaaaaatggtgttagtgagaaggcatttggcgatttattgaaactcatcgagaacattcttccggagggaaacaaattgcccgagacaacgtacgaggctaagaagatagtctgccctctaggactggaagtttagaagattcatgcatgtccgaatgattgtatcctatatcgcggtgaggagtacgagaacctagaagcatgccctgtttgcaaagcactacgatacaagattagacgagatgatccaggagaagttgacgggcagctaacgaagaagagaattcctgctaaggtgatgtggtatttccctatattaccacggctaaggcgtttgttcaggaacaaggggaatgctagaatgatgcgatggcacgctgaagagcgtcaacaggacgggatgctgagacaccccgccgatggttcgcagtggcgaaacatcgacagaaaatttaaagacattggaaagaacgcacgaaacatacggtttggtttaagtacggatggcatgaatccttttggagagatgagcagcggccatagcacttggcccgttacgatgtgtatctacaacctcccccctcggctatgcatgaagaggaagtacataatgataccgattattattcaaggccccaagcaacctggtaacgacatcgatgtgtaccgaagaccactggtcgaagatcttaaactgttgtggaagaagaaaggtgtccccgtgtgggacgaggacaaacaggaggagtttaacctacaagtgctactgttcgtaaccatcaacgattggcctgcacttagcaacctatccgggcagtccaacaaggggtacaaggcttgcactcactgtatggatgaaacagaaagtacgtatcttaagcactgtaggaaggttgtgtacatgggtcatcgtcgattccttgcagcaaaccactcggtacagaagaaaggcaagcactttgaacataaggtggaccactgtacaaagcctaaacatcgcagcgggaaaacagtgtttgtatggttaaagatcttaaagtagtgtttgaaaggggcctggcagccagcctatagagagcgaagatggtcacgccgcgatgtggaaaaagaactctatattttgggagtactctattgggaattcttggacgtccgccacgcaatcgacgtgatgtacctcactaagaacctttgcgtaaacctttttggcttcctaggtgtatatggaaagttgaaagatacactggaagcacgtaatgatctaaagcatatggaacaacgcggtgaccttcacccggaaccaaaggagaaaggaagccattacttgagtccagccagctacactcttagcaaggcagagaaggaaagtatgtttgaatgcttgtaaagcatcaaggtaccgtctagatactccacgaatataaagcgaataataagcatgaaggagaaaaagttcacaaatctaaagtctcatgactgtcacgtgttgatgacacagctgctaccaattgtaaaaaggggtatcctcccaaacaatgtccgggcaacaataacaaagctatgtgctttcatgaacgcaatttcgcagaaggtcatcgatccgaatagattagaagccctgcagaatgatgtggtgcaatgtcttgtcagttttgagttgatatttccaccttcatttttcaatataatgacgcatctgctttgtcaccttgtcaaagagatcggtattctcgatcctgtgtaccaacacaacatgtttcctttcgagaggtacatgggcgttctgaagaagtatgttcgtaaccgtgctcgtccagaggcaagcatcgccaaggggtatggaacagaggaggtcattgaattctgcgtaga

SEQ ID NO: 3296 - DNA, 3055 bp, Oryza sativa
aggtgagcactatgaacactattagcatgctagttcatagcaaaaatatgtattgtgtcattacatggctgtaactggtaatatttttaaaagacataatggacaagtactagcattcaaaacacacattgtgttgcagagtttgccatttaggaagaacaagcattaggatggagggttgatcactggtgagctgctgaactgggagatctcgggatggtgctgagtgattaagttgtgctcgctgaataccatatgatgaaggatgcttgagcggagaatcgttgagtcgctctgtgggaaaaacaaggataatgttaatgctgaaagtacgacaaactatagatgcgatgcaatatgttggaggtttcatacaggtatttgcagtgcctcaatgggctcccgtttaccgtcgtagacctccatgaacttcattatgtataatgcacattaattcatactcaggatagaaataaaaaaacatgtccggaataacagtggtcgaatacttaagaaatgaaagtgttgaccggtgaaaagagagagaatgtgcttaccaccaagcataccacacaagatgctattgacgaccccggattttgtcgccaacatctgagactgtgacttagtgcttggaacactgccttcgaccagtcgatggaagcaacccggtccagatcggcggcaacccaaacgtcgctcttggggatatagaagtcagttgttgggagtaaaagcttggacatgataaccatgacaaagaaacaaactgcagtagggtcgtcctccctgttcttgatcacttcaataagcattttagaagataactgagcattccgttgaatccccaattcttcggtgatcctatcgtgggtgtttcgcaccaccttgttaggtgggataacaatatccttgccgcccaatgggttccccatgacaagatggacagtgcggggggtgatctggatcttcctgtcatcatcaatcaaaatgcacatagagttcggacctgtcctgtccattagccactgtatgagatctggcttctcaaggctctcaagtttcatgcatgccacggcatctaatccaatttcttctaacttttcgtggtgcgtctttgacaacgcacgacaagcctccgacgccaacgcggcgctacaacgtgtcaggttgggtcccttgaccataggatcctgcgaaaaaattgaaaaatgcatgcaaaggtaagcaaaaaatgaacatccaatagttagaacaccatgatttatgtttgaactcacaaaaacatatggaatgaccacacagttgcacaccccggtattatttgcaaaagatagtcatcaatggtacatacataggaaaaacactataacccatcggtggatcgttgggagagcaaaacgcaaacgatagatactaacgtacacaccatagtcaaaaatccgacagaaaaaagagatgccaccaatttgcctgtaaaatatcaacacattcgcattcccatgttgagatatgctctataaaaaacatcctcatacagagaaaataatgtggcaaatcccaaaataggaaaaatttaacttatactgtaatactcaacagtgacatcactcacaatgttctacaccaggattagtgctgactaaaagccccaatagtgacagagtgagcaaaacctcactccccaaattagttggggttgtaccctagaaaggcaataaaagattgtagccaaaaattaactggcaaaaacgtatgaggaaagtgacaaaaaaaatatgcagaaaagggtgttctcacaatgtcggttgttgcgcccctgcttgctgactaagcccgcctcctcattttggcctcgtctgtgctgtttcatccacggctagtgatgaggaggttgcgccgttggtcatggtctggggcaggacaacctcgcaccctgtttgagaatcggcgaacctgatcctcttcaccttggccgacattttcacagtgatctccatgtgtgcactaatcgaaacaaaaaagatttcgctgagagcaaaccctatgttggggatgatttgggatacagaaacaaaatgagggaaaaataaagaaaaagaaaaggggtagacatttggggggagtgttgcatagcaaaatacctcacacccgctggggagcaacttgcggcggcgccggcgacctccgtttcacaagcgacgatagaagggaagacgaatcaaaatatttaaataaggaagaaaccctaggttgtgggtggtttgggatgtggaatcagaatgagcagcgaagaaagaaataaaaggggaaatggatttgggatgggatgtggaatcagtatagcacgttacctcacagccggtgtgagaggacccccgccaagaagcgccgtgcggcagcgccggcgatctctctttcacgagcagcgagatgagagagggtgctccctgacgatggtgagaaaaaaagaaactaaccggaaaatatgggggagacgatagcgtcgacggtttgaaatgactagtccctaaagattcgctgctgcaaagactgtgactgataaaaaataataaaaaagggttcataattatcaattcatcgtttctcatagttgaaaaataactcagtattattgaagagttggagaatagataggcggagttaaagtttaactactacaattgggtggtgcgttacggtaacagagttaaaacattacttgcaggggttgaatcctgtccaagatgtgttgagtctggacttcgatgacagttaaaaagtaactgagtactcattgtgtgtttgttgacgaaaaaatcgaacacgccggcctgggagatctgcttagctcctgtgtaggtccaaaggttgatgagatgcgggcgtgccagtcagtttgatcctgcaactgacaagatatgcaaatagtagatcaaaacagccgatcggctgataagccgatggagtagttccagccgatagcagataatagccgatgccgataccagccgatagcgatagggtttaagcaatcggctatatgtccaatgta

SEQ ID NO: 3297 - DNA, 3877 bp, Oryza sativa
tgaaacctttgttgtcatcggctaaattcaacttatatgtatgtgcaatccttatgagccgatgcaacgtctagataactcaccggctgaaaccccgatgaaacccttattagcggtcaagcacgacttagtagatcaaacttaactgatgcagcactaagtatgaaaagaaacataatatctagacaatcaagccgttgactgagttttcagggtggtagatgcctaggctaatctaatctagcaccgcgatttagccgataccggcagaaaccctaaaacgaaaagcagccgatagagctaaattgatatgctaagactagattaacagagacatataataaataggtaggcaaatatatcatccaaaccagagcaatcaaagaggtcaaatgtactaatgcagccttgaacgatgccgatgtagatgagacaattgcctgggccgacggaacattggacttatccctttgccggagatcgaagacgatgcagccccgcgtcgggtgccaagtcccgccggacgataaaataaagtagaaaaggtaaaaggtggcgatgcgccgaattgtattgatgatgaagatagattacatagaccccgagtgtacatatttatacccattggttgatacaagtccttgtcggacaagaaagaaactaacctaaagataaaaggaaaacataaagtccttatcggacactaaacacactttcctaaaaataaaaggaaactaacaaactattcctaattaatagataaattgccatgccgcatcctctttaaactcggtcacttagggataagcttcctttagtagattgatttccttaaccgaatatagcaagaatccgactattggcgacttgataactcccatcggctgattccgagatgctgcagtcgataatgattctaagccgataatgtctttgccgattaccaaatttcactgttaacagtgttgaaaaaaaggaacatttgattcgtaacaaacattgcagatgagaacatttaattcaaataaaaaatgacgtattagcgatatatagacgacagttaaaaaaataattgtattgtcctaaaaataaattaaaatggttttttttttgctaaacttgaaccaagaaataagaaataataaaaaaaataaggtatgattaaaagaaaaatacttgtagataaaaaaatgctctaattgactatattccctgcaaatgggatatgtaagctccatacactaaatcgtattcccgagtggtgaacataaaaaaatgttcagctaaaaatttacaacgtacattctgtctatatgtggtgggctatcatgtggatatatagaagtaaaaatttaactaccggtaagatcgttggtggtacgggaagggggatgggggtgggacgcgcaggcggtgggtgtggagactgtgtcacgtgccatttaattcgtggcaccttaaggtgccatatatatatatatatatataatcaaccatacagcaaacagggccatgcaaataaaaaaaatggtgcaccgatctttagtcccggttggtaagccggccacgtggctgaccgatctttagtcccggttggtaacacgaaccgggactaaagatcgatctttagtcctggttatttcacccgggactaaagatagctatctttagtcccggattcatagtcccggttagacaatcgagactaaaggagggttaccaaccgggactgtaaacggtttctccaccagtgcatacacatgcgtctttatacgcggagcaaaattgacagacaaaaggaacaacaacatatacttgtattgtcacatacaccgatgatatgatctctaaaatatatctttaattatatttgtttattataacatatataatacataaatatgttttttttacttccattatactaagtaagataactatatatatatttctagtgtctttaaactaaatattttttaaagctattgataaccaaaagatataaagggttgatcttgaattatactcctaggagtataaagagtataaccagaggagtatacttttagtcgtgtaattcctaggaaagtgtttacatagaatatacataattgggagagacacgaagctcaagaaaaaaattagtatatgttagcaagtcgtggagcccatcggttagtctaataaaccaaatcaaaagtcaaaatttgaattttcaaatttgattttcgagttgattttaagatattttcagcgtaatttctttttagcgttggcttttaaatctctacgaacaaatatataaaagttttacatataaattaatttgtgcaacttgagttacatataagccaaaacggcttattaggaaatatgtgcaaccgatgagacccatggatcgatatgggccggcacgtcgattgcatcacacatgaggtccacatgtgcaattgcatcatctgtgtgacgaggagtttccaactccaacttcaccgacgctgtcaaggatgtgagccgcaacattgcagcaagaggggatcgaaaagcgcggctcgacaccgacgcgacgccatgaatactgtgagtaaggcaacgtgcatatgacgaagacgacatgaactttgaataagttaatatttttctttggttgacgtagttatggttgcgtcatcttttcatctatgtttgatttttttttcgaggatctatgtttgattatttttgtcgtgtttgggctttgaaccaaaaaaaatgtaataaatagtggtagcttcaattgaagtaaacaccaaatttaatatccattatcttaaaaaaaaagagtcgccggtggtgattagagattgaaatttcggaaatttcgccccccccccctccggcaagcaattatttcgagggaaatttttggatttttttttcaaatatttgtgaatttggtcataatttctttaaattgagtaaaactatgttaaattttaaaaaaagttcttccgaaatttcggtgcttaccgaaattttcatgcattccaaaatggaaaacactggccgtgatgcacgaagcggaggttgagctcgagggcgacacggcgaagtcttctccaccgtcaccacccgcccgccgtcatcaacgacgatataaacagagagacgatacgagggagggaagctgcaacgcccaaatgcaagcgaaatatcggctcgatgaattaatataatcgtgcctttctttgggttattagtctgtcacttaaccatatatgtaccgatcaacaaaaatgcaaacttggagggtcgattggataaaactaattcatcaacaaatgaattttactttgctcaagatcaataggaaaatatctgaaggaccgaactgaaacaagctattaattacatatacaacatcagcatagctgtgtgcatctgttcttcgtgttaaatgtatgagtatgatctgaccccaaaattgcaatcctagatcgagctaattaattagaacaaattagaagccagctcttgtaaggcctgcatcgtggtcggtgacaagaagaagctacccggcgacggaagattcgccgaattgtcatcatcaatctccggtggtggtgcaggccaatgctgctgctgcccaaacgcgagcgccagttggtcgtcggcgaccgtcgccgcggcggtgtcagtgatctcagctccgcctccggcggtcatctgatcatctgcagatctcacggttgaatccaccggcgccgccgccgccgccgtcgccgtcgacagcttgcgattgccggtgagcttctgcacgacggccatgaactcctccggctcgacgtggacgaccctgggcgtgagctcgtacacgatcaccggtccggcgtcgccg

SEQ ID NO: 3298 - DNA, 11741 bp, Oryza sativa
  unsure (1)..(11741): unsure at all n locations
ggcgacacgatcagcggctgcggcctcgggccccggatgatgccgcctggcctcctcttccccttcgacgacggcggcggcgacgacgatgacgtggacgacatggttcgctcgctgcgtgtggcagaagccagcaggaaggcagatgcttatataatggcgccaagcaaaaggatgatgtcaaaagcgcgcgaaaaggtttgaatatattgctccaattaatctgcctgctgcgcatttgactatacgcagaccaaattaattatcaaacttgtgcaatataataatgcaccaactacgtatactaaccttaacattaacaaagatccgtcacttagatgtggttggtgttagtttagtgatttaattacttaggagtactactccgtcataaaaaaagataaatcttagttatgaatctagataaatatatgtcaatgtttgtagctatgattgaatttatttggaatgaagggggcatttgtatagactagctatccgcctatccgtattacttttctggatggttgcttccttccaggataaacgctaccacgtctacgctagctgctgcctgctgcctgctgcctgcattgctgcttcgtttcaggtgatcagaaagtcagtttaatttgatcgtcaacagctgcatctaggagtactactagtaactgagtttgcttgtttaaaatgagtttcaaaatgagacgcttgattaaaattaaccagcgattaatcaacgagagagagagagagactgagcgggctatgcgtattggatgatgcacgcacggacgtacatagacgggccggaggccggaggaaggaggcagataatatctgcaaggtgttactcctatttgactatgctaatacgctggtaaatatatgtaggcaggtcaaacaacgcatgcagatatgtgtttatacgctgcaaaagagagaaacaaaggcaataaacatatgtacttgtcgtatggtaaatttgtgtttacactttatatgtatacgaatgctaaggcattgtagccaaaataaattttattaaattttagcaatgctaaaattttgacaatttgataatattatcaagttttagcaaaatttcttatgtatttaccagagtttggtaaaaaaaactaaattgatatgtatatttaatagctttaaaaaatggtatatatgatttgaaatgacattaacctaaacaatccctaaatatataatgtaaggcatgcatgcaggattgcaggaggcacatttgtttttactgatactaataaaattggatataatttggaaaatctggatgcaattagtggataataaggagcaagaagaaaatcaggatccttggcggctttgcctctcatcccgttgctccatctctctgtcgttgccaagtgggcactgctccttgatcgtgcatttccctttcccttaaaaaccacgaattacggttttttcactcatgatatttttcaaaaaaacaattcgcacaaacagcacaaagtttcatattgatgtagtagggaaaaaagattatagcatcagaggttgtacagccgtacatgaaaaaaaaaacaagccaccatacatcaacaaaatgccaaactgtacacatcgtcgaaggaactagcacccggctgacggccatgaggcaaaactggacgacgcaagacctacaaaggagccacaaccgaactgccttacgctaactccaaacaactacatacccgccactcctagtaatataaagggaaaagtccattttacaccctcaaactcttatgcttgtctaaaatacacccccgaactacaaaaccggatataatacaccctcgaactgtcaataccggacacttaaccccccgggctgttttcaccgtggtttttgccacatcggctgccacgtcggatgccacgtcagccctcgccacgtcagcgcacaacataacatgggccaagcccatattctctcccccctctctctccctctctctccttgccgtgtttgttctcctctctcccacgactggtggcggtggctgcatcggcggcgtcggcgcggagttgcgagggcaacggctacggtggctgcgtcgagctgcgagggccacggctgctgtgtcgagctgccagggccgcggcggctgcggcgttggcatcggcgtggagctgcgaggcggcggtggtggcggggagaagtccttatcactctcctcttatcgatgtcaagcaaaaagagaagagcaaaatgttagtatgcacaaattcaggtatcagattcagatgatgtaattaacctacattgactgtatcttgtgaagacttcccagattgtacaccaagaccagtgctcgtcgttgcttccaccacgcgtcgagctgcttcttccctgctaagccaaatccaaaggcgcatgcggcgacgacgacgcccgaaccttccgctgacgactacgcgcagaggcttcaaccggcgaccgtccgcgcaatcgggacagcgccgccgccctcgcagtagctccccgccgccgccgcctcgcagctccacaccgacgcggcagccgcagccctcgcagctccacgccgtcgtcgacgccgccgccgccgcggccctcgcagtttgacgccgccgccgtagccgtcacccttgcagctccgtgccgccgccgccgccaacggtcgtgagagacaggagagcgaacagggcagggagagaaagagagagggggagagaatatgggcttggcccatattatgttgtgcgctgtcgtggcgagggttgacgtggcatccgacgtggcagccgacgtgtcaaaaaccacggtaaaaacagcccgggggcgttaagtgtccggtattgccagtttgagagtgtattatatccggttttgtagttcgggggtgtactttagacaagcataagagttcaagggtgtaaaatggacttttccctaatataaatagcaacaatgttggctcggttccgaagaagaagaagaagaagaagaagaacaaaaacaacaaaaagaagcgttggcgctagcggcgtgggcgccacgatggtgtgtgacaataagctatggagccttcgcgcatggctgcaggcgtcaacatgtcatgaggcacacctagtgtgcaacatgctccaactgttcatcgctgggttgctttcgccgccagtcacattccttgtcgttgtccgcgacgaagtgattatggctatgtcgattacataacatgtccaacacaactacttggtcagtgtctatttcagttggaccagtatgacaatgtggtcaatatagcccatacactatttgatcggaaccatatatagcgtagagtacgtacgacctacatagcagtgggccgggatagtactgtagaacacatgtcgctagctagggtggtaatgaaccatagtccacatgccctttcacagcctaattaagtcattttttgttttatcctaaagtacatttacaagatttaggtcaaccttttagctctaactctcagaatttccaggctaaagtttgggcccatatatttgctcgatgaaagctaacagtgaaaacttctccattgtatatcaccgtccgctgttgttgacagtaatatatagtacgaaatgatataatttaggaggcgatttggaatgctttgataaggaaaaaacatgaatagttttcagaggcagtttgagaaacactatatttacttgcgtcaggaaaaagtgatgcacgactctttttaaaaacgcctaaaaagatgtttatcaaaatcgccttagggaggaatattttgaggttgttttggaaaagatgccttcaacaaaaaccccttcaaatgccgtccatcctgtattgacaaacatggagcagcaatagggagacgatctagagtgaaggatcgtgcctctctttgcgcatgaggttgtgtgcttgggttaattatttgattgcactacttagcaatacagtagtaacgactaattaacgagcaaagctgattggttaatcaaacaaaatcaacaaataaattgtattggttttgttaattatcagaatgagatcaagaaatgtacagatgctgaagaacggaaggaatgcatacagtcggcgagctgagcgcagagcacctgttcgtgctaatttttccctaattacaggaaaattttttgcacaaactgttgtgattctgatccaaaaattagaagttcagagctaattagaacaaagcagccaactcttgtaacgcatgcatcgtggttggcgacaagaagaaactactgggcgacagaagaaaagcatccgccggtggagaatgaggcggcgccgccggatggtcgccgtcgatcgccggcgccggagcaggctgacgctgctgcccaagcgtgagcaccagtgggtcggcggcggccgccgctgcagcggcgtgatcacctccggccacctgatcagccgccggcaatgtcgtcaaggttgaagccgccgccggctgctgcttgccgccggtgagcttctgcacgacggccatgaactcctcctgctcgacgtggacgaccctgggcgtgagctcgtacacgatcaccggccccgtgtcgccgccgccgccgctgacacggggtttcttggacggccggctcgcctccgccggcgccgacgacacgatcagcggctgcggccttgcgccatggatgcagcctcgcctctttgccttcgacggcggcggcggcgacgatgacgtggacgacatggttcgatcgatcgctgcgtgcccgagacgttgttcttgtcagatgtttttgctgcgtggagtagtagaaaccaacacacgaagatacgcttatataatgtcaaaaggcgcgcgaaaaggtcagacatggagttttcttttctgactaaatttaaatattgttccaagcagccttctcctaattaatctgctgcgtatttattatgcagatcaaatcatcatacatatcacatgtattcctgcacaactaattattacctccattccaaattagatatcgttttgattttttcttataacgtttgatcatttgtcttattaaaaaaattagtataaatatataaaaaagataagtcacacttgaagtactttttataatagagcaagtcacaaacaaaataaataataattctataattttttaaataagacaaataatcaaacgttaaaaaaaactgacaagtattttgggacggagggagtaagcactactgctaaccttaacaagatctatcgttagatatagttagtattagtttaatgatctaaatacttgttaattacagtgcatacatgcatgcttcccggacacacgcagctgcatgggtgcttcgtttcaggtggtcacaaatctcaaattgatcagttgcagccgcaattctctgcttcggtatgcatgcgtgtttaaacacacgaattcacaacgacaaactttgaattaatttgcgatagatgctaataaaaataggaagtcgtcaagccacgtgagctnnnnnnnnnnnnnnnnnnnntatacgtccatgcatcggccggccggaggaaggagatagccaggtagctcaagatagttatatttgaccatactattgtggatttgtggtgagaaaaatctaatatatagcagcagttcataaaagataatgcatacacgtgtgtatatatgtatatatgttgtaaaaggagacaaaagaaaaaggcaagaacatcgatcctgattggattattcgcgtagaattttctttttaccaattgaagtattatatattgatatagtagagaaaaaaactgtaagattatagtcctacaaggagtatatgaagtatggcagatatgcaagtaccagaagacattttttttaaaacatattttgatagaattggacatataatatactttatctatttcacattataagtcgtgtgatattctcttctagtcaaacttttttaagtttgatcaacttcatataaaaatttaacaccatctaaaatatgaaaatagtttttattaatctaacattgaatataatttgataatatgtttgttttgtgttgcaaacactacttaaatatgagatggagggagtagaaaatttggacacagtttataaattaacggcaggaatcctcgttggtttggtgcctagtgtaaaaaaccggaccggaccggctgttcaaccggaactagaggttggcacggttcggtcaaatagaaagaccggacatgcaactgttcaacctgaagtccggctgttcaaccggaactagaggttggcacggtttggtcaaatagaaagaccggacatgcaactgttcaacctgaaccggctggttttgtgttgaatcgggcaataaactgctttcggtcggaccggacttgtgttagacttgtccgcgggcttgatatttttagcacaaattgaaggaaatgcgcgcgcttgtggggagtcgacccctggtcgattgtttgcaagccaattcccgtagccatcctaccatacagatctttgtgcttgtatgcaaacacatatgctacatgtagttagtgaaccgtggttcgaccagccggttcacggttggaccgtcaaaccggtgaaccagcagggtgaccgggtcgtctaccggtccggttttggtgtgcatggccttttcttcgatttctctatgactggcaagtgggccccgctccttacttgaaagccatttcagttgggccggaccagtatcgcggagcacgtgccaacatgggctgtaacgtcgctgcggaacacgcgcagcccataaactagttgggccatcagcccataagtgcggaacggtaacaatggcgtgcgcgcggcccagattcaattgcgttttaatgtgattctgtcaattattagcagtataatttttttcgcaaacacataaaaggattagccgtagaaataatccttaccccattagcattggcgttctgcgatacaattctcacctcaacgaatgacgagcgagctttgcttaacgtaggaactagtttacaaaattaagttaatgcacgtagtaaaattgatacgaccacgtccaagatttacacccacagacccacttgaatcatcacattcacgatgatacgcaaaatacaaaaacccagtcaaaaatgtcaaatcatgaagcagattgcatgtcaagtggcttaaaaattaagagagatcggacaaaggatcgcctcagtagagaagaaaattctgcacaaaattatagacttgttgtagccgtcagtatcgtacatatcttggtagtatggcaccgatgtcagcatgctcataatcttttcttaaaaattgtttgtatggataactcttcctcctaatctcattttttcgtacgtaccatttttctcaaacaaaaaaaatattcacgaaactcttacttactaataaaaatcttaactactttttccgtccaaattataagaaacctttgttttaaggaaaaactagtaattttttttactaatcattatactaacaataactatgctaagtattatgagtgttatatcactattttagtactttaaaatactttcacttatgttaactttatagttattgataacacaatataaaataaattagttatcaaagtatattattgaagaccgtgtaaaaaaaattataaaccttataatttacgatagagtgagtaataggtactcttgttatgaaaaatcatatcaatttctaaaatattttaaataattctgttaggtgtattagtatttttcaataaggaattgtccaatcacttacgtttcacgtaagcgtccgatctggcacgcatcgcatcgcctgtcccgcggccgcatcgcatcgcaaattgcatgccaagtggcttaaaaatgaagagagatcggacaagggagatcgcttcggtagagaagaaaattctgcacaaaattatagacgagatgacttgttgcggacatcagtatcgtacgtgtcatttttttttgcaaaaaaaaaatcttcactaaactcttaccaataaaaatcttaaccgttggatttaattactaataggtactgttgttatgaaaaatcatactatcagtttctaaaactgtttgtaaatatttttttgtaggtgtattatttttcaaaaagaaattatccaatcacttaccgtttcacgtaagcgtccgatctggcgcgcatcgcatcgcctctcccgcgggcgccgctgctcccactgacaagtgggccagcaaggctgaggtggcccacatgtcagtgggacgtggcccagctcacctcgtccccctccggccatctcccctctcctccaccaaaatcctcctccgatccaaatccaccaaccctcgccgccgccgccaccgccgcctatgccgccgccgccgtcgccggctgcctagggttacggcggccgcagctcccccccacttcgccggcgcgatggggaacacctgcgtcggccccagctccgcggcggaccgccacggcttcttccactccgtctccctcgccgtgctctggcgccccggtggccgcgccgagccgtcgcagccgccgggttacccgctcgggagtcgagccactcctccgtcacctcgtccacggcgcccgagcgcgtcaccatcgccgactccgacctctcctcctccacccccaacaagggcgggaataagcccaaggtgaggcgcgtccagagcgcggggctcctcgccgactccgtcctcaagcgcgactccgagcggctcaaggacctctacaccctggggaagaagctcgggcaggggcagttcgggaccacgtaccagtgcgtggagaaggccacggggaaggtgctcgcctgcaagtccatcgccaagcggaagctggtcagcgaggaggacgtggaggacgtgcgccgggagatccagatcatgcaccacctcgccggccacccgagcgtggtctccatcgtcggcgcgtacgaggacgccgtcgccgtgcacctcgtcatggagctctgcgctggcggggagctgtttgataggatcgtgcagcgcgggcactactccgagaaggcggccgcgcagctggcgcgggtgatcatcggtgtcgtcgaggcgtgccattcgctcggggtgatgcacagagacctcaagccggagaacttcttgtttgtcaaccataaggaggactcgccactcaagacgatcgattttgggctttccattttcttcaagccaggtccggtctcgatccttgctgctgtgttgtcttgtaagatgcaagattttgttggcaattgcggattttacccccaccataggcaatgctagttaagttgattttgcaagcttagcgaggtaatggtggtgcattgcgaccccctatagctttgatttctcgattgagttctagttacaactagatggacttcttgcataactgcacatatgttgcaatggatacgtttgtttttcagatagatgtgtatttgactatctgttaaacccttttttggtcccagtagtattgtgaaactgttttttttatttcctggattacaaagaaagagactgattttttttatcacaaattgccaaaatctgcaatcaaactcttgtgcacataactttcatatccattcactatgatatatgcttcttaattgaatgcatgctgtacttgcggtgatcctgaaattcatgttgcttaaaatgccaagggaatgggatgtcattccatctttccttttcattttgtttgtcaattaatgcattgatgtgacagagccttaatgtacttaactagtactgtaatatgaactctaatacactgctgtccccttcttttagaacactgaaatactactgattgtgcatcttttccaaactctaatgcattaagattgactttacaggcgaaaattattcggatgttgttggaagtccttactatgttgcacctgaggttctgatgaagcattatggccgcgaggtggatgtatggagtgctggtgtaatcatttatatcttgcttagtggagttcctccattttgggatggtgggatatgtctaccctttatgctgccttttcaaacccatgcttctgcttgatgctgacagttttcctctgttttttgttcttttggatgctggcctgcttgcacagaatctgaacaagggatatttgaaaaagttttgaaaggagatcttgatttttcatctgatccctggcctgctatctcagacagtgcaaaggatttggtgaggaaaatgttaaaccgtgatcccagaaagagattgactgcacatgaagctctatgtaagcataaatatcacattgcagagcatcatgtcagagccttctctagtgacccatctttatgttggcaggtcatccttgggtttgtgttgatggagttgctcctgataaacctcttgattctgctgtcttaactagattgaagcaattttcagcaatgaacaagctaaagaagatggcccttagggtgaatattgagtatatttttgcttgattttctaccaaagtacaagttacgttccatactgatgcacttctgtgtggcatctgtaggtcattgctgaaaatttatcggaagatgaaattgcgggattgagagaaatgttcaaaatgttggacactgataatagtggtcagatcacattggaggaactaaaaactggcttgcggagagttggtgctaatttgaaggattcggaaattacaaccctaatggaagcggtgaattttctaacatgactatgccccttctatttccagttcaatatatgctaaaacaaacctttgttttttgtttctgagtccactatcttgaaacactctgttaagctagtgtattcaaataccaaacttgacgatagttgttaaaatatgtgtatttgacatccttttttagcagcttgcaaagatttctgacgttggtagtggttatttgtaaatctattgtatctcatccaaattttgtggttctgataagtttaacagtacgtgagaatggaccttttatgttctaagaaagtattgttgtgaggcacgttagctgtaatatatgatatatttttgggccaagatataataaatgcatatgttcttcgacttgcaggctgatattgataatagtggttcaatagattatggggagttcattgctgcaactatgcatctgaacaaagttgagagannnnnnnnnnnnnnnnnnnnnttttcatactttgataaagacagcagtggttacattactcaagatgagctacaaaaagcctgtgaggaatttggcatagaagatgcacatctggaggatatcatcaaagatattgatcaggacaatgtaagtggacatttcattcattatgagatctgaaagcctagaagactaagaatcacatcaaatgtctgcttctctcttgtttcgtctctgcaggatggccggatcgactacaatgaatttgtaacaatgatgcagaaagggaataattcactagggaaaaaggggcaaggccaggtaagttttggtttaaagaagcattgaagcttggttaatggtaactgctcaaatcttgcattttcttttcagttgataaagtgaacagccggaaggccctaaactttgggatccacgtattagcatgaattagactaattagaggacctatatttt

SEQ ID NO: 3299 - DNA, 6722 bp, Oryza sativa
gcaaaaaaaaaattatatgttcaggcaatggccatatcaaatgcctactcattaatgcctgtatatgttcacatcatagccatgagccatagtcctaatgagttgcttatgattaccatcaaggagctgaagaaaattagtccgttctagaaaaatgggtaaagggggaagagcaaaagtgcaaaactcatttaaaatagaatgagaggtttttaaacatgttggaatgcattagaacttattaagatacacattagaattgattaaaatatgaaaaaaaattgaggccctaatcctccatgtctctggtccaactgatacacccaaggcgaacatgtgacatcacctgtcaatctccaagtatctgtttagacaatggccatgtccaattcaagagaacacacattttttccctatttcatgcagaattaaacctttttgtttcaaagagaacaaaccttttcttttcaccaaaaatttaagagtaaatttcacaaaactacacgttttgtagtccaagttgcagaaaaccacacacacttcgacacttggcacttaagtacatatattttggtagtgtagtttcacaaaaccacactatcaatgaatagattcacccacgagatgacgtgactgtttcatctaggacaaggacatgccatcctattaccagccatcgcacgaaattaataggatgccacgtcctcatcctagatggaacgacacgtcgtctcatggatgaatccattcatcgatagtgtggttttgtgaaactaaactaccaaaatatatatacttaagtgccaagtgtcaaaatgtttgtggttttctgcaacttgaactataaaacatgtagttctgtgaaatttactcaaaatttaaatacatatatatattttttaatcgactccatcttatatgatgctcatacaacttcgacgacgtttcgatggtcagctttgcaaacaaactccatagcggcgtcacgaccatccacaaaattgtgtgcccctctttttggcggtcgataagcatcgtgaggcactattgcaatttctggatttatcaccatgttcttgagcacggttgagctgcaaaggatatgaagtgccagctctacctgatctttctgaccgaaaattccagtgatctgaacctgtttgagattattgtgatggtgtaatggaaggcttcttagatcaccatcctcttcactgtatggtttgtgaggagcgtctatccacatctataaatatgagaaaaccagaatattagtgagtgcccctggaatgaaaaacaaaatactccatctatttttctaataaatgatgtcgttgactgtaggcattacgtctacccatttgccttattaaaaaaattaatacaaatatgcaaaaatttaaataaattaacaaaacaaatgatatttacatatttttttaaataaggtgaacattagacatgaatagcttaaatggaggaagtgatcaatgacgacatttattgaaaatggaggaagtctataagatgtgcacccaattgttttaattaagaatgaaaaattcatttcattttagctgttatacttcaatatagcaaagtatgacgtgcgttcgggcacaatgcaggatcaggttttgtgttttaattaagttcaaaaacacaaattactactactgcacaatagacatcacatcgcatttaatcaatcggccaagcaaacagaaccaaaatttggctaaaactaattcatgagtatatacttttatttgtcagttggaagtgaaaaacttacatgtagttccagtttttccataaaaggagcaatttctaaaagatatgcatagtcaaggatatcagtcttcctgccatatccaaaaacaatcgtttccaacttcaaatgtcgaagataaattaatttgggaagcctctgaggagaaatagctttctggcgtgcatcagaacaaaaaaaaaaagctaatgagaaagttgacaataatttatatgcatgaaaaaaaaaatgaactgctacagaaacaaactaagtggtcatatcacaaaccttatattcaacaacatgaaattcgagcattcgaacaaccggcaaattactgatgaatcctgtgacaatatagtcaagaccagtacaaaaaggcatcgtttttaaacccacatttgtcaggctggaagttgtagcaaaaatcaaaggtgtcattgatgaaccagtgaaatcaagtgttgccagatcacagttcatctctatcttctcaagtacagggcaacaatccacttgcagatgcttcagccggttcagaaaatgaggtgcatgaatctttgtgagcattctgcagaaggagatctcaaggaactccaggacattgggattgcacagcaaattctgaaccccttcatctgtgatatttacacctatcaggttaagccttttaaggttcagaaatccagtgaaatcagcagccggtttcagatacatagaggtaagctgcagacactgcaaatgagatccaccattgttggcatcaagaagctgacaaggaaactcataaaatccttctctgtctagatatgggtgaaataccataactggcaacatgaagaacctagtaagatctgatagatcaagaatgagttctttcgtcttggatgcgacggcaaatttcacccatctatctatgtcccgccgcgcattgcgcaataagaacttgatctccatgcgctcaacgcctacaccactatgttgctgcaggattgaatcaactctccttatgaaattttgctggttaagcattctgcaactaggaaatgtggcgcgactgaatgttagcatagtatgatcacgccaaagatccttccattgccttgatataagtccagtccttatagcatctccaattggcagccgcgatatgatcaagcccaaaacatcctgcatcataatttggagtcagagaatgcaaagcatcacactagcaaactacacaattattcagcatcatgctgaagcacaaggagtatatgtatatatatgtaacttgatttcagtttgacagcacgatcacgtactatgggaagatcgttaagttggaggcctgatcttctcccttgtctgttcttagctgcgcaatccaaggattcctctggttttctcgtcatgttcaaatcaaatctcagggtaggctggatttactgaggttaagggcaaagaaaaaagatcccagatcaggaagaaacgctagggtttaacataaattcgacaaaaaaagattgtcggtaatggatggatgctcaccagaagaacggcggaagcagcaaggggacaccggcgacgctgctcgcacgatggagatcggctcaggcggcgggcgaggagacgggagtcggcggccgagaagacggggagattgaatgaatttaagtaaattgggactctaggtccagaagataaattttaggaatctagtttgaaagcctcatcttttggcttatacttatgcttatataagtcaaaatttaaatttttaaccttaaatttaaagttgattttagtgtttttcaccgtagtttatttttcagcttttgcttcgcttctagattgctaagaaaacgtatataaaagttttaagttgcaaatatatcgttttacttattatgccaataagtggaacgatagagtcctaaaatcatgtctccaagagatgcctaaagctgatcccaatatttacccacacccagaaccatactctatttgaaccaattttgggcatctccacacactcccaattgatgaaatcgcgggaggtttttgccgctcatgccttttcttccccctgtcgtgccctgccgtgagatggccatgccctacctgccccctcgacgtgccttgcaaacttgccgacaccctcgccgtccactgctgcagctgccaagaactcgaaagatcaccctgctgcacaacttagctgggctgctagtgcgccattggttggcagcgcccagcgccgatctctctcttatcggaaaaatggaaagacataaacagttgaagcaagatttacttgagatgatgtggcatagtttaaagttattggaaatcaaaattaggggcactctttaagtatgaggtgatttttgggcccaatttcctatgggatggtcccaatccaagatttttaggagttaaattttaggatgctctaagggtgtgtcctttggtgtggaaactattaaatctcatgcacggaaaacgaagcaatagattagcatacaattaattaagtacttcttccgtttcattaacatctatatgaatatggacaatgctagaaagtcttacaatatgaaacggaggaactattaggttaaaaaacttaaaagatgagttaatatattttttttaaagaaactttcatatataaattttgtaaaaaagtataccttttaacagtttggaaacacatgcacgagagaaaacgagggagggaaggttgagaacccctgcaaacgaactcaacctaagggtggagtttgaatcgcgtcactcaatcgtaaaaccagtgcaacatattcctcgtctcaatgaaaccaatttaaacgaggtatgaagacggtttgaacggcggttttagatgatatgactagtttaatttggtccttattccatgtgacgttgaggtcacaaaataaaactaaaacaaaactagttgggtgcccgtgcgttgcaacggcaaaaaatgtatgcattaaagcatctcgcctgttatttatgactggcaaatgaagaggatagaatgtggctaatgttcctctctaaacaaaggaatatggttaatgtatcagactatcaggtatacttgaaaagaattttctctaaccattaggcattggcatagaagaatatggtttcattttctaagatcacaagttctgaatattaccctcttaggtgatacatagttagttgatgttttcctcaaaacaaaattggttggtgcttcgggaagcagtcacggacgtcacacacatgagtaaatttatcaagggtcatgcacttgataaatcaaaattggagtgtgacctttttggggtctactgataataatctatcttctggtacatgctaaatttcaagttatataccttgaacagactatatatatatatatatatatatatatatatatatatatatatatatatatatatatatataaaggattacaactgaatttacatggaatccaatccattaaagacataaatgaatctgagtaattctctggacagtacactatgtgttcacggtaatctttaaaagcttatagaatcctcagtacatcgagttgcaattttgcatagataaatacaattctctaagaaataggaatgaataataagaaatgttagtggtagcatatgaggcagctgtggaggcacaaatggacgcgccaagaaaatgtaaaaatgtgctatcaattgcaacttagtgaacaaatcttggagaagaacaatagtttattagttcagacaaaaatgagagttttaacttctatactgagaaatggaattttatacaaaaaccatatacctttgaagcatgaaaaaaagggtcactcctatgatcaccaggaaaaaggcaacatcaaatgagattgtaattttatagtgatcaataggattttagtacttacctgattatttgacagtctctgttcacttggtaaaagagttcacaattcaaattaatctgctttagtcactactcatattggaacactattccatgtatataccttgagacaaattccaggcctgatgatcgattatgaattgaccagcacatttggactgcagtgaaaacagaagaaaaatgatatctcaatcaataaaaaagccaacgtgtgagaatagccagtaaattagaactaaactgcacatagatattatactgctcttccttcctaatatctgaccatgtactgatttggctactcccaagaatcagatgggaatgattagaacaaaccactgtgtacaactatgatatgaagtatatgaaccgttcatatctaaaactctgcattgcaacaagactacctgaccaaactgatccgtggaagcaaatctgaaaaatgcatcaaacttaaccaatgtaaacaaagaaaaaaaaccgaatgggatgctcatcagccgggataacaccagataaaatatgacatgctcacagccatcaagaaagaatgttgatggcagtggcatgcatgccaggagatacttaacgatcttctccaccaagaaacaacacaacccatgtcataattaacatgcagcatggatctggctaggccattgaatgaagagtaccctgagctaaatcttagcaagagggaaatatattaggtacgaataaaggttttatcctaatgaaattatgttgctaggctatcgagaaaaataaattgtatttaccattagcttccaggtgttgataatccatcaatatatgcatatttccatccaaatagttcctttttgaatatcttctgttgttttttgatatcttccactaaattgatgcaaaaggaaatactaatagtgattctcataggtaaattaaaaacatcttattacattgcactaactttacttgacaactcatgttatagttttaatatgcagagctagctgacgatgatgccgacgacacc

SEQ ID NO: 3300 - DNA, 1380 bp, Oryza sativa
gacggctgcgcagatgatcgggatttgagggaggttatggtttatggagggggcggtggcgtgatggagagggagggggcggagcgagggacggcacaatacagagggaggacaaccggagaagaaggcgcgggttgggcgggatgggaaggcggcgcgtcggtggggtgaggaggtggcgccccgaggaggaaggatggggggctggggagtgcgatgcgaaattacggatcggagagagagggagcgcaatgcggatcagggagatgagaagtggtgcgacgggtggatcgtgggagaaaatctcatccgctgatgcctgtgagaggatcctctgatgaatgttaaccattcgatcgttcaggactcaccaccacccctacgaattttttaagtagtatataaagatatatagagctacatgtcggtgggtccaaccctcttgatctccttcccctttatcggcagcccacgtgcgcgcgtgccatctcaccatggtggcccatcaaaaggcccatctcacatgctgcgttttcactttttctccgtagtactaagtagtcagttaataaaactttaactgtattttttttactcaaaccagaataaaaataatctctactacttaaaaagttcgtagtggtggtcttgattcctgacacagcagacgcatctgacagacacgcctaatctcaaccatccgtttgccgtatccaacgatcgatctcctccccacgctcgctcctctctcgatccaagagatcgctccccacgcccactccttctcccacgccgccttctcgccgccttcttcgccctcctccctgcatcgcggcagcgccgcatcgcctcctcatctcgcggctgcgtcgcctcctcacctcgccggcgccgccgccgtcgactccgcatcaaatccccgcgacctcgccccatccgccccagccggcggcggccgactgccagatccccgcgtcgcctcctcacctcgccgccaacgccgccgccgtcgacgttgccgctgcccacccgccccagccggcgacgctgccgctgcccacccacaactcatctcgcggctgcgtcgcctcctcacctcgccgccaacgccgctgccgtcgactccgctccagatccccgcgttgcctcctcacctcgccaccaacgccgccgccgtcgactccgcatcaaatccccacgacctcgccccatccgccccagccggcggcggccgactgccagatattttcttgtcaatcaatatagttgatgtgtgtgagtctgacacacacaagcacaccatccagatcgacctgaaggtaacctcggtttcttttgctcaattttttcatcgaggggattgtgcatttctgttcatga

SEQ ID NO: 3301 - DNA, 5635 bp, Oryza sativa
  unsure (1)..(5635): unsure at all n locations
tatcgctgtagaggaaatagggctcaatgtatgtgtccgcttgccaattccaccatttccccacttttggtgtaggttctatgtatgtaacactaccgacaaatttatggggatttcctttcctattgcagcttatatgggaatgtgggataagtccggtgagcccgacacggtgagggataggatactgctggagctcgagcatgagttccttgaggtctacacgacannaattgacaaggtgaaccagagccgggtgcagctgaggcaggccattgccaggccgaccaaagcttgctgacatctgttcgtccatgggtgaaaccgcccatgcacgttaaactggtttgtttctacctccaccaggtaaaggaggtactgtacgattagatcaaacaatgtaagttgagttcttgtggaacaatgctgataggcgaaggaagaaaaggagatttagtagagaactagaacctacaatttctgttgtaagatgatagtaataatgcgtgcatagttgttcttatggagccaaaccgtttggaactccattagcagttaatatttttacaaactgtttgtttattaccattgtgtcaatatattaagggagagtgttggtataccaatatattaccattgtaaacttactgcaattttgagtcgagtggctgcaatgatgtcaagtatagtgtagtctcttctgttaatgcatgcatatatgttgttggagtgttggtgtatgtgttcaacgtgttacctgcagtgataattgtaatatgtatgtatacttaggttgtggatgctaataaaagcaatacatcggcatgagcttatggaattacttctggtcatcatgaattagaagcaaatgaagctattcacaaacttctctgaagattttcgtgtcctgcaacataacaattttctccaaggatattttgtgtgctgtaacataacaatctttccccgttgcaacgcacgggcacctaactttgctaaatattctacttatttcaaatgaagtcattacaaccagtttatcattgtttataatggtcgaattgctcacatacattatttaatacctcagattttcaattgcataatcctcatatttgcttccaatttccaatttaagattgtttgttctgcaatggataacaatggtgggagttctgtgccaacatcgtcaacaagatcaggtgacattttcatccatctagctaatgttatatttatcgctcaattgatatattattgcttgctaatatgaggatcactcctccctcaggtccttttgcagatataactaatgtaattgatgccaatttgacgaacaaccatcccgctgctaataaaaatggaactaatgtgccaaaagatcatgagaattgccagcacaacaacttggactctacaggttgggcgtagcactatattatatattttgtttctttttaaggcttttgtattaagcacagtttttgtgtgcatgcactcttcaagatgttacaaaactaagtgcgactgaactaaaaaggaagcgtgctagggagtggtatgcatcattgaccaaagagcaaaaggaagatagaaacaagaaggcacgatatatcaggaagcggaggaactttgaatcacaaggtttaaatctctactgcagcatatctaaactctctgaacagaaaactttattattaaattaattgaactttcagataatgggtctcaagctgcgacatcaaaaaaaattactactacggcctcatctgtttcaggttgagttgtcatatggtcactgctaaaaatatgtttgtaaatttgtgccaaaaacattttttaatatgtttgcatttcaatagcagctccgtttggtgatattaaaattgcaagcactgaagatcaatcagtagggggccggttggatgttaatgatgcaggcactgaaaatgtgggttctattgtaacgcctgtgcgtctaccatttactaacagttctgatatgtcctacagcttcaaacaatactaaagaaggatgagccatggagtaagccactgcaatgcattgtatacacaatcgtaattcatatatgcattaacttattttctttgattgacaggaaaatatgggtacaaagttcaaggccgcactatattagcttgagtctcaaacagcttcaaacaatactaaagaaggatgagccattggaaagtgattgcttcaacatggctattcgtaagttcatgtatgaaaaaatcgagatgattcataaaactaaagaagcaatatcgaatcattgcttggacttgcaattttgggtaagtttttaaattctaatgctcatgtcattctctattgctcatgttattacctataatcgcaatatcgaatatattgatttatctattgcttatgtaattgaaccattttttaaatcatgtagagtgctactggctttggtaaagacccggtccaccatgacaacataaatcttgcagagaccgtcggtagttggtcggaaattcattacaaactttcacagtgcaaagcggtaagatcgctaagataccatcctatatggccgtgttttatatattatcttgaaggttgatcttttgtagattcttataccagtacgccatgctcgaagttttatcgtgcttgtagtggaccaagaaagtcaaacgctctatgtgttagacccaaatccacttatgccagaatataaaaataacccaaatatgagatacaccagaaaactgataactatttgtgatcacttcaacaaagctatgagaaaggcatgccctggctctaggtggaatgaagacatcaacttgtggaggcaagtaattgtcaataatccggtttacagcaggtaagttatcttcttaaaaactcgttcaaaccaacaaatttaactgtgtagagaaagggaagctaactcttcaatttccttaggagtttatcgggttttcttgttcatctcttcatgtgtacatggaataataaagaaccacatttgccggcaattaatgtaagtcttgacaggcattaattattcatatattacattattatatatttaccaaaatttaacttattaaatacatgtgcaggatggtgacgagctaaggaaactttttttgctaaatctactgatgtaccaacaaaatgagtgtgaaagcaacatccctaacggcgtacaagattttctaaagtgtataaagaattcacaacattagggtagttatttaactatatggaacaacattagggtttaactataatatggagtgatttaatttgaggtgatcatccattagaaatgccgtatctacaaatgctggatgttctatattttttgtttgtgctttatttgtatgatatcatcaaattttcatagatgtcttctatctatgttactttttataatttatgtagtaaacgccatgagattgtttcattacgatgccatatttgtcttttcaatgccagatcttatccccgtgatcaacaaaattccccgtagcaacgcacgggcaccctactagtaaacaaaaaaaaataccgaaagggaagctcgcagaggaaaagaagagcacaaaccccaattcccaacacctccgcgacgcgagcgagcgaagcacgaggaaaaaaaaaaatccccgaatccgcgacgagcgaggcggcgagctcgctgcttcgatcgatccggagagggaggtagggaggagtgagcttgctcgctgttgccgcggaggcggaggcggaggcggatcggggcgccgcggctgctcggctcggcggcggcatgatggatccggagatgatgcggctggcgcaggagcagatgagcaagatgtcccccgctgacctcgccaggatgcagcagcaggtcagatccgcgcccatcgagatcgatcgtttcgttggagatggcgatctggattaggttttggtgtcgttcgtttagatcgggaggtaatcgcgtttaattcggtccggtttcgcgtttgcgtcgaatcaggatcgtgtgccaagttcaagttcggccgggatcgcgtttagggccaaagcaaaatcgtgtcacaaacgcacgtacagatgtggagttcagtttggttgagtttgcgtcgaggcgaaatcaggatcgtgccatgatgagatcacagggttaaattgttcttagtagttgatagtattattactccttttaagtcaaaatagtgatgcaattatacatataataaagaaaatggtgtttactcttctagtcttcaagttttcaagtcaattagacagtgagttgtgggttccaggttgggtttgatttggtcagttaattgattggtgatgacaatctgcgaatgtttttctttctgttgctatcaacaactgcatgattgtataaactataagcaataggagcgttgttgctgggtcttttacacattagtttatgacttttgcttcaactgctggtgttttcgcatgtccttacatccgtttagactttgtcagcgttgtcccatacaagcacaaccatgccaaatggtgatcatggcatattttgtaccacaagcctgcttttggtgcttgtattgaactagaggcctttcgtattgatcttgttgttgcttgacattgctggttattttctgaggagccatgcatgacatgagattgacattttccttgttatgattcgtattgtttcagcttctgtcaaatcctaacctagtaaagttagcatctgagagcatgaagaatatgagagctgatgacttcagacgagctgcacagcagatgaatcaaacaagaccagatgaaatgcttgatatggccgaaaaacttgccaatgctaatcccgaggaggttgctgctatgaaggttcaagcagagcaacagatgtcatatgtgatatctggtgccaagatgttgaagcagcaggtatgtatagcagtccaacttcactttttactatcatattctgttggaattcggttatagtaaggctgagttcggtacccatgtttcccacctcactcccctcattttccgcgcgcacgtttttcgaactactgaacggtgcgtttcttgaacttttttttttcattttttcaatctagaactagaatagagcttcatgttacactttttggcaaggacaaatgagtaataaaatttaaattcacaaaaaaattggcgaatgctgtatgtgctatgaggttcataccattacaggtttggatcaccctgagttaactagtggaatgctggaaaatatacatatgaacttcatgctgacgtgaacactaaagagcatttgatgagcctccttttttccttttaccaaagaactacatctactgatgcattagtcaggctgagccagatacatgtactgttttgtgacaaatgtttactgaacctatgcacctttaccaatattatcttgtttaagaaaactctgcacctctttaattgtttaactattttgaacttgcaaacttccaagttttaaactatttttgtaatattgatatttgtaattcccataatatcacccttatttgtttcattttttttaaatttcagggaaatgaacttcataggtgtgagcagtatagt

SEQ ID NO: 3302 - DNA, 687 bp, Oryza sativa
  unsure (1)..(687): unsure at all n locations
tacatgacaaggcgagcccgccagttatttatcgtgacttcaaatcatcaaacattcttcttggtgaaggatttcaccccaagctgtctgattttggtcttgcaaaacttggtccagttggtgacaagacccatgtttcaacacgtgtgatgggaacttatggctactgtgccccagaatatgcaatgactgggnnnnnnnnnnnnnnnnnnnnnnnctatagctttggtgttgttttcctcgaactgattacagggcgcaaagcaattgacaacacaaagccacagggggagcaaaacctagtggcatgggtatgtttttatactatacttgcatcataaatgcataataaatatatgccagtgacacccattgtatgcattcttcttttgaaaataaaagcattacatgtatctcagcattttattttagtactgttagtgaaatacaatcccgccaatcaaactgatgccacccacctgtttctttacaatcacacaacaaataattgtagtgtttgtgctagctcatgaacaatttgatcatggatggcctttacttccaagtgtccaaattgtttccttgtggccaggaaaagttgttgttttgataccgatatttgcatccaccttggtaattttgctgatggctgcaaacatttagcaattttgagagtttggggggcat

SEQ ID NO: 3303 - DNA, 1329 bp, Oryza sativa
  unsure (1)..(1329): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcaacggcccatggataaagctgaattacgaccgctagattgggtccaacaggcccatctaaaaaaggagcccaccaaatcaccaccgccccttcccttccggctcgatggccgccgcttcgccgccggcggcggcggcggaggtcgttgtatccctccactctgtcccagccaactaatagcgtaagagacaggagaatcgcggcgcggagcggcctctataggagcaggcagcgggcgcctcatcgtcctccgattccattccgccatggtcgacgacccccatcttcctcctcgcctgcggcaagcaaggaggtaagggatccgtcgttcaaatcaccccatgcaccgtggcagatctcgtgcaggagggacgaaccagcggcggtgctattgctgccagtttatctatttctgaatccgtccattaatttgactgatccccccactgcaggatgcatattggggattccaactcaaactacaagagcagggatttgaactgttctatgtgaaatttatgcaaaaattcgtatggaactctactgttccagacagtttggcattagctccggattgggattattcatcaattcgttattcctttcttgttcaattcctaaccaatcaatcagtcatacttgctgcttattttagcaagaagatcacagagctcccttggtttggagcacatgatgttgtggtcggctccagcaatctcctcgacttccgtgcccgggctcaacgtgatcaaataacgatgcagctccttgatgtcatcccccatgcctatcaggcacaccctcttcaccgaaccatagttggcactggtaagcagcttgtcatccttcatcatcggatcatcctggaactggctgccaggtgtcatcaataattttgccagggtcaaatcctacccaaaaaaaaaatcaaatgctagtctaatgagatttgagataccagttaccagctattaggacaatagcaatcttaattccaaattaaatgctaaactggaacttgcaagaaaccagagttcatgatgctagttgattgcctcagctggacttagtggataacacctctctgccaagaaatttgggcctagggttactgctgttcctggacctcgtttgttgtt

SEQ ID NO: 3304 - DNA, 22973 bp, Oryza sativa
agaatttggacaaggtccaggaaatgattgcaaattcaaatcatgacagtaattttctgatgtgtatacgcccatctgtttgtgaggttggtggaggcgtggagtctggttggaccggggaccctaatggtagctggcttggatgcctggggtggacaggtgacctaaacagtagctggggtgtgaaaaaatggtactgtgtgctttactgctttctggaggagattttggaaagtgcatgggtactgtttgctgcaatgctccctttgtccccttctcttacttcatacttactccctctatcccaaaataactccaaccctatcttcccaaggtggatttaagaccaaaatacccataattaataataaagttatattggtgggtgggtaggtttggggtattgaagggataaaatttctcgatttgcggatcaatgataggtaagaaggtagaagctagtttattttgggacaattttcaaactataaaattaatttattatgggacggaggagtagttcatatctaacactgaaaatatgtaacttgctaattaattgttcctcttgtggcttggacatgattggttgctggattgtggctttcctttgtatgatgaaagatgaccaagggcatctccatgcgttgttcacaaacatagagcatgatactgctacagcaaccgcaacattgattcttttgtcgcagcgggctggtttggtgctgggtccacatttttatcgttcttttctccttaatttttctcatgggcgatttctttactaactctggtttgaacgagcataccatctatcttgttatgcaggctcccgtggactgagtccatctcttctaggttcggtcatttgcatacactggagatggcctaagctagatgtgctgctctctcggatgctcgggatcactcactcttggcaggtcctatattatgaggcatcaaatggcttacaagagcatgaaatatttgcaaaattcatatgaaactcaattgttccaagcagagcctgcattagctctggacaggatttattcatcattttttttcttgcccaatttctaaccaatcaattagtcatacttgctacctatcttagcaagaagatcagagagctccctcggcctggagcacatgacggcgtggtcggccccggcaatctcttcgacttccacgcccgggctcaacgtaatcatgtaacggtgcacctccttcaagtcatcctccatggccatcaggcacaccctctttaccgaaccgtagttggcactggtaagcagcctgtcatccttcatcgttggatcatccacgaactggctggtaggtctcaccaataatttcgccagtgtcaagtcctacaatataccgtagatatgctaatgtaatgagatttgagatatcagttagtctgaattctcaaattaaatgcaaattggaactttcaagaaaccagagataatatgctagttcattgcctcagctggacttagtggataacccttctccgccaagaaatttgggcctaggaggattgcagttcctggaccttgtttgttgttgatcggtatcattttgctatccaggagcatatctttgggagctttttcccttatcaactgtacaaacaagaaaaaatatcagtaattgaataaatgttcagacatcagagtgagtatttatcagtttgctgatcagtgatcacctcggggatgatgcgcttgccgacgcacggcacggccgcggcgacgaacacggccacagcaatcttctccgggaacctttccatggcgagggcgatgctgaggccaccgaagctgtgcccgacgaggatcagcctctcgccggccggagcctcagccactgcatcgaggagcggctgcgagtactcctcgaaggagtgcacctcgtcaacccgtgctgggtggacgccggacgcggcgaggtcgagcgccgtcacgcggtgcccctcggagcggagcatggtgaccaccttgtaccagcaccatgctccgtggcagaggccatggacaaggatgaaatgcttgctgctactgctgctgccctccatttcctgtaagtgtttgtggtttgctcttctgcaagtttctgacgctgtgatagtagcgatgaattgatttatacatacattatcgagaaatatatatgacagtggcatttataattttatatgcagtaggtatcatttagattgatgatatatttactggcttgaacgtgctaactgtcagcctttgtaaagaaaattgtgtggactttgaacgtactaactgacagtgatcactagtttagtttggtgtccattacatgttctaaaataaaacccgacaattttatatggataattagctccaggtaccttcaaatttacttgggagatgttcacctttttgactttttctggattttttcctcaaatttctaccgtcccttctcttttcctaattaattgagctggtccttcccctctgttttctgcactaccctccttatctccttctctttgttcatagctaacactgaatattatttgcatacactggagatggcctaagctagatgtgcttctctctcttatgctgtgactgtgagcctgtgaggtcaatcactgttggcaagtcctatattatcaggttactacgacttgtctttgctctcttgtcgttgtcagattgatatttttcttattgtagatttttttaatagatttcatcaattattggcacacaagatcaaacaaagcaatgagaaccaaacttctattatttatacttgtagcgatggactgtaagtaggcttcatgacgaagaagcactgattatttccaaactggcatttttctactcgtatttgttggctatcttgatcagaatgtcgcagagttccctgggcttggagttcatgacggcgtggtcagctccggcgatctcctcgacgtccgtgccagggctcatcgccaccatccaccgctgcatctcctcggtgctggagctgtcagccttggcgatcacgtacaccttcttcaccgatccatagttgccattggtgagcaagctctcatctttcatcaccggatcatccatgaactgattgccaggtctcaccagcatcttcgccagtgccagatcctgaaatgtgtggtagtagcatttttttaatggaaagatgattacatgggcatttgacacaacagtgtaccgatgtgacaggtgagcaaaacccctaattttggaaactgattaattaaaaataactttacgggagatgaagaagatattgcaacttgtaaccggatcaggatcctctgcagtcgactataccgtgccattcctgatcccttgtaacctacctctgctggactttgctggtagtatttttgtgccaagaaggttggtcccaaattgattgcaactcctgagccctggctattgtttatggccaccatttcgcaatccataagtaatccttcaggtgcagttcttctcatgaactaagcatatcgatcacacaacaaaaaacaaaaatattagtggtggttaacctagcattagtagtcattttgcattaaaggacaattatagttcactggtttgattttgtaatttgctaatgctttgcctatagcttatttgaagcaaatgccaaaataaatttcattgttaaaaaagagagtaaatggtaatcccttcgtttcatattatgagttgttttgactttttttctagttaaacttttgactttaagtttaaccaagtttatataaaaaattaacaatattttaaacataaaacaaatatattattaaaatatattaattgttagtttaataaagccaaattcgtgttgcagatgttattattttttttcaataaacttgtcaaacttaaaaaaaataaaaaaaaaatcaaaccgacttattaatatgaaacagagggtgtaataatctctttaaattacgagacatgtcagtttatttttacctcctcggtcgggacgcccatgtgcttgccgacgcacggcatcgcggcggcgacgaacacggcggcggcgaccttgtccgggaacctctccatggcgagcgcgacgctgaggccgccgtggctgtgcccgacgaggaccagccgctcgccgggcgccgccgccgcggccacggcgtcgagcagcggccgcgagtactcctcgaaggtgcccacctcgtcgacgcgcgccgggtgcgcgcccgacgcggccatgtcgagcgccgtcgcgcggtgccccgcggcgcgcagcgcggcgaccaccctgtaccagcaccacgcgccgtggcagaggccgtggaccaggatgaaatgcttcttgctgctgctgctgatctccatttttagctcagctgcttcgaaattcttggtgctgtgcctcgatggattagctgaatttatagaatcacagtttcttactctccaagaagctcggtgagatcatcttgtgctgcaagaagaagaaatggctatcgcactacctgaaaaattagcattttgcagggcgacttgtccctagccctcctgtgcctgccttcgacatttctgcgatgctgccggtgcatgattgcgcatttggaaattaattaagcaatcaaaccaaggttgtgttctttttagtgaagataacacgatgtcgcatcccatcaacttaatccgcaagaacaaaggttgaaagcagaggatgcgtcatggtcacgtagcatcagggatcgatcaggcgaccagcaacgatgacaccacggacacacagtaagccgccgctgaatctgattggttaagagagatcggtcgatcgccactggtgtggataaaccgttgaagtgggcccaaatctcgtgatccaaaattagcccattggtaattgggacgaaatagcccaagttgaaacagatcctctgtagtctgtagtattgttctcttactttgagtggctgatatatgtacctcacatccaacggaactatatgttagtgacacacgttagaggacaatgagactaaggctttatttgaagagtttaagatcttaaaaagtagttagatggtactagcaagcttggctgattggctctgtttgaagagcttaagcacctaagtacaacatctgtctcgtaataattgtatttctagaatttaaatttgtttcaaaatagctattacaatagagtactaatggtctcattaattacttctcattcacaattcttcctattttaccctctactacactctcactcttacctatgtaccatttaataagaagtatcatagtctttcttatcaaaccttaatatatactaaacaaactagaattacaattattttgggatggagatagtagttagatgcaagcaaatttttgagaatttggaaaaactaaaaaactcggtttctgtttagctttttttttttgtatctacatttctcaaaatctagatgaaaagttatattgtttgagtaaacttttaatttgagagaagccgcggctgccaaaaactcccccgaacacgctctaaatccaccacaccgcacacctcatatcaagagggaaaatgcggcatgaagcgatccaagatagccactgtcgcctcgccggcggcgacggtaggagataaggagatctaatgcccacgtccatacagatagacgatcgttcgatccaagaactgaatctgtacatttgttcatcacaagatcgggataaaattgatctggtgagatattatcattagcttcacaaaacacaaccgaaccactgattacatgtttctcttctgcttaacactgatagaagacagatactggaatcgtaaaaaaattttaaccctgctaaaaccatttcttagtcatacttagctgcaatcctgagcagcaaatcacacagctccctcggcttggagcacattgccatgtgatccgctccggcgagctcctcgacttccacgcctgggctcagatcaatggtccaccgctgcatctcctcgtcgctcgaagcatcatccatggcgaccaagaacaccctcttcaccgacccgtagttgccttcagtgagcagcgtctcgtccttcatgatcggatcatcgatgtagttggtgccaggcctcaccagcatcgtcgccagcgtcagatcctgcaagaaacagaatcagatgatctgacgcttttttcaggtagaagattgagatgttttcctttttgttacctctggtgggcttcgattatacagtttctctgccagtaatttggggccaagcagaactgcggttcttggttcttgattcgtgttcaggacgatggttttgctgtccatgaagaaatccggtttgatcctcctcatgaacttgtgtcaatgcaagaacatggaatcatattcataccgatgtctgatcaagctctgaaaaatggtgaagctgagctaatcgagcatggagtaatcggtctcgttgtctcacctcttcgagcgtgatgcccatgtgcttgccggcggccggcatgcaggcggcgaggaacacggcggcggcgaccttgtccgggaacctctccatggcgagcgcgaggctgaggccgccgaggctgtgcccgacgagcaccagccgctcgccgggcgccgctgcggccacggcgtcgagcagcgggcgcgagtactcctcgagggagcccacctcgtcggcgcgcgccgggtgcgcgcccgccgcggccatgtcgagcgccgtcgcgcggtgccccgcggcgcgcagcgcggcgaccaccctgtaccagcaccacgcgccgtggccgaggccatggacgaacacgaagtgcttcccgccgtcttccattcggaatctgggaatcttcgagcacgctctgtgatccagggctgcaagaacaacacaattacaggatcacgacacatgcggtgtttatacgcgcttagattcctaggacttaattcagcttctagaatctccggttttcaaatagtctaaaaattctcatacagatttttcaaatctgtagttgtggtatcttataaaagtaaactagaaacaaaaaataaaaataccagtttcatagtttgtctatatttttacgagttacttcttagaatttggaggattgtttatattcttacatgttacttcctccgtttcatattataagattttcttgcgttgtccatattcatatacatgttaatgaatctaaatatatatgtgtgcctagattcattaacacttatatataaatgttagcgatgctagaaagtcttatatcttaaaacggaggtagtacttcttagaatttcaagcttctccgaaaagggcctagtcacgtaagagcaattgagcatgccatgtgatggcacgtactaaggacccaatttcacgtggaaacagaagttgttagacacctggagagtggagacatcgggcgtgtacgtgctgttgacaacttatggctttgtgttcatcatcgatagatcattgatgtggtggtccaagtcgaagtgtttatcctgtcatcttataaaaaaaattggtggtgtttatcagtcacactctcattacaatgcatatcgatatctgtatgcaacttttgattcttcttcagagttacgctttgcctaatttgatccatggcgtgctgatgaatgattcatgttgtcattatgttatatttctgagggctccttgatctgggtgaaaaaaagaagatttaagtccaacttgcggttgtcatggtgcgtagatgatatgcaagacatcccctcgagggatgaaaatccatatcctagaaataacaagatttcatagagctggaaactcttaccttgatagcaagattgcatagagctggaaacttggaaacttttaccgagatagcaagactttatatagatacaacaggattgtgtagaggtggaaactcttgctgagaaaacaagattgcgtagctctgatggagaggctgaggctacccagacctgctgattcttttcctgaagatttgaagctgtcctctgatgttcttctactgctgtgggagtgtttgaatgttatctcctctttttttcatttttctgtcagaatttgctctatgtcaaaacaacaaatgataattttgtcgttgacagcagaactgaccaacaggggacatctatcattcacttctttcgttcaattgaaagcacaactgaccaatgggtgttttgttcgtacctctagaatcgttttgtgtgcagaatctcttcacgaggaagtctgaagaccctctgaaccttgcacttgcagaactggttgttgatagggagtatatttgataacaagggaggctctctctctatgaagaacttcataaattacgcttaaccaaaccatgccgcgatttggcagtttctacctgtgaactgtaacttttccaaggtaccaacattttgatagtagttgtagcatgtagctggtagagccgtagagcaaattcttgaattccagttcacatttggtagcagttcctcaattacgttgttctagatgtaaaatatcaatcacaacctggatagtcatactggttcttgaatcaagtttttctgggaaatcaatgttaaatgtaacctgcaaattgtaatgttatttagtcgttcttttgggtttagaaagttaaaaacagaatataacagccgcgaaattgcttcttaaatcagtttacgagattaaaagaaaaataggaagtgtgggtcaaatccaggcccgcgagatcaaagcccgaaggcatcaccgcaggcagacatgcagaccaacaaaatcaatccatctctgtacacactaccatgcttccttcctcttctcatccagagcatcggcttattgtgcacagtttacatctaatcaaagtgttctttgcaaagaagataggcaaaaaaaaatgttcttgatttgaaagcagaaaaaaagaaaccccctttagcaagatgtctgagttgatcagataattgtagtctgaattttgggtcaacacatacagtttctgtgaaaggttatcatcccatcaactgttacgaatcttgcttgcttttagaagaatgcaatatacgaagacaaatcgaaaaagccgaatacaaaactaagaatctgaagatcttggcaggctcagaaggatccattggtttctatcaatcagaaggactggaatccctcagaaaataggtaggtattttttggtcatcacagcctccaatcagccagatccatgacaaaaacaaacagaaacgcaaacagaataaaactcaacaatggaatgcaacagttgaaacctcatggacaaatctgattatctgaagaactgccaggagggaggcggcgaaagcggacggagcaaggagaacgaacacaaaggcgtcaatatataaggggattggcggctagggtttctgggaataagaataccggactcgttatattgggctggcccatttaacatcttcttgggctgaaattgttcactaataagacggcccatttaattatcatgcccatttttctataggctaaaagagacaatactccctccgttttatattataagtcgctttgattttttttatttagtcaaatttctttatgtttaactatatttataaaaaaaattagtaaagtaaaaaaaagtcaaaatgactgctaatatgaaacatagggagtatttttctagccatggaggcatggaacattgggatttaatatgtttattctcacctaataaaaaatatttaaactatcaaattttctgcagaagttcaaacaattgtctcaacacgaataaaaaaaaaggtaagctcgcctcgtgttaactccatttcatcagattcaaactccaatacgtactagtacatcactacaacatttgcgttgcatcatggagtggagtggattaggcccatgggccaatatgaggcccaaaggggcccacgccatcgaagcacccgtggtcgtcgtcgtcgtcaacgcccatgtagtccacgacgcgcacgccttcccctcgccggcgatccaccacaccggcgtgctggtcgccgccgtgcatcagcgacccgatggccctcgtcatcgcgccgcctccgccgccgtagagctggccgggcaacagcccgcccaggtcgaacccgaccagctgcgtcgccgtctgcccctgcagcgccgccggcacgacgacgtcgtcgtacggcgcgagatgatggcctatggcgggaagccggtcgagaccgccggcaatgcccatggccgggaacgcgacgccgccgtagcagcccgtcgacgtcgtggcgcccagctccgccgccttctgcagcagcgccgtggcggacatgatcgccgccgctgacccggccggcggcggcggcggcgggaacaccatggcggcgtcgcgcgccgcgtccacgccaagcttgcacccggggaggaacggagacgacaatggcgcggcgaggctggacagcatgcatcccgccatgctaagcggcggcggcaagagcgggtttccggccgtggcggcggcgacgatgttgtcgacgtcggggaacatcttgaggtgcgggctcttgacgcccgcggcgtcatcgtcgtcggcgacggggtggtgagcctgctgctggccctgcagagcggaggtgaccgccgccatgttcatcggctgcgcgagcttgttgttctcctgcgccagcgcgtcgcagaacgccctgtgcgtcacgaagctgtcgcgcctgcatgccatggacacagtagtacaactcaagctcatggacaaagcggaaaactcaaaccagatatcctctcattttttacatctcacttaaaaagtcataatttttttaaaaaaaattagtagaatagatcaatatgtgatatatcacttcataaaaatacaaattcaaattcaacttatataagtggaaaacaaaaataacaaatttaactatgaaatgaacgtgtaattcacggtcaaatttattatttttgtttcgaattgtataagtcgaattttatctcgtatgttgcaaaaagatatatcatacattgatctatcttgacaaaattttttaaaaaaattaataactttttaaacgacaagcacaagacgtcctctccacttccagagaaagctagatctcaacaatggcgagcgcacctggagaagacggtgccgcagtcgcacttgtactcgcgggtgccgcagaccttggagtgggccttccagtcggagtggacggcgtagcgcttgccgcagcggtcgcacttccacttcttctcgccgtgcttgcggcagaagtgcttcttgatgccggtgaggtcgcccagcgcgcggctcgggctgtggtgcacgcacgacgcctccgggcacacgtacacacgcttccgcggcggctcgccgccgccgccgccgccagcgccgccgcgctggcgcagcttccacggcaggttgtggcctcgccggtgcagctgcaggttctggtcgcgctggaagcccttgccgcagatctcgcacacgaaccggttcgtcgccagcagcgtccgcggcgacagcgccaccacctccgcgctcgggtctgcatggcatgcgccgcgttcacaccaacgaaacgtgttagttaaactctactaaaatagtactccctccatcccataataagggattttgattttttactagcactgattgaccactcgacttatttaaaaatttttagaattattttttttacttactttattatccaaaatactttaagcacaacttttcgttttttattaataagacgagtgatcaaatagtgcaagcaaaaactcaaaatcccttatattatgggatggagagagtacttgtagatttttaatgcatgacatcattgacttttgaataaagtttgaacatccatatatattattcaaaaataaaaaatgtgtaaatataaaaaacaaaacaaataaattaaatgatagttatcttttttaaaaaaataagacgagtgatcaaatacgtgtcaaaaatcaacaacttcgtacattaaattaactggaggtagtactaaaatttacgttttatttatgtgggcattgcttagatggttgtgggtgatctagctagagcaaaattttgcagatgtaaatgccactccatgcaagatgagctagttacatttctattgcaccaataacttggtaggttgcattgaacttgtatgtgctatcattatcttttaaataactgcaattatgttttgtccaagtgataaagatctaattttcaatcactcttttaaaccaaacttccaaatataaatcattttgtgcgtgcacctaatttcatatagatattgcagttaactgtcctaacaggcgatggtactagatctgtatgtatatacacagagccaacagaaacaggcaattctctaaaaaaaatagcacgctggataaaaaatgtatagcttgatcctatgtgcacttaattaaccaaaaaagctttatgctaattacatacaacgagcttagctgaaatgatgaggtaaccactatccatctattgagaaaaaacaacaactagctagaggattcagaacttgaaatcacaaaatattcagacaattcaactaagaatgctggccttgtaaaaaaatgtcgaatttatctatctcaagattctgaacgaaactaattaaatttctgcgaaaagactaacacaaactacagttcattatggtcaaaatattctgtcacacagtatatgcgttgtcatctatcgtcctagttttcagtgaaagactgaaagaagatttagactgctaaatagtaccaccattatagactttccctatcaattattgcagtcacaagatcgatcgtcaggtagggcaacacaagaccaaaattcattcaatttatgatccacgcaagaattcagacgaactgaagaagtaatactagatgtttgcatctgcatgcagatggtcttaacatacatgaacaattaactaagtggagaacatatatatgcacctggtgtccctggaaggcttctcttcttcttcttcttcacggccgtcggcggcgcaggcggcggatccgagggaactccggcgacaagctgcagatcactgtcgtcgacattggcgatctccagcgggctacccaggagcagcttgctgtaatacggctgctgctgcagctcaaactcctccatcaattgcttcttccacctcttcttgttgctcagagaagataagatcacggtgcaatccaatccctttcaacaccggtcgacatggatgtcatgcagttagctaactgattcaagtttgcatatgcacatgcagagtttcagcaattggcaacacacattcagagactgaacttctcttgtgtttcttgctctttctctggctgaacttggtatgagtgacagctagctagaggaagaagagggagctggtcttctatttatcctaccaaaattttcaccatgttagtgtagctatttttcccttagctttcagagagaattgaacctgtctttgtctgtgtgtgtgtcagggatgacttgagtgtacaggatgctatatatatacagtagctaactgttaggaaagattaatctagaagctagtaactatgcaccatagatacactctagctagtacagctacacatataatttataggtaaaatttttatatatgtgttcttagcgacttaaaagccaatgttaaaaaaactaaataaaaaatatcctaaaatcaacttcaaaattaagtacgaaaatttaaattttggttttggctttagtttactagggtacgatggggcctatagatagctaagccgcgtggacctgagaagagagcttgttcttgtagcaaagaatttttttaaaaaaaagttttagttttatataatgtgcatagtttggatctacctttgttgtttgctcccctcgggatcggccggcaagagacaatgctcaagttttcctggcagagagtataatactggcttgtcatgacagcaacctgtgaatgcatggtcaagttgatcggcttcttgttgccttgttttcttgcctaggtctcgttttataatctgatcgcaattaacaccgccaatttgaaattaatgtggttttccaatccccaaaaccactcttcttatggagtgctaactctcagcttgaatttctgacagagagtgacaggcttctctccttaatctggctgaattcaatacgaactacggtagttttactgcaacagagctattgtaattttaacttttaagctgctctacaagaggctcatatatattttggtgctcttgaatttaaatatagttgactacctaaattaacaaacatagtttatgcctcatggatgatcaagagctcttactaggtacgttattgaattgtttaaggaccttgggatttgcaagggatgataacgatgatgatgcgtaagatggaggttgaacacccatgcagaagtgagctcagcctagctaagttggatagacgaattaacaaacaactttttgaaactaaaattgccctacattttaggaactttcagaaactaagttcacaactatatgcaacattccaagtattttccatgagattttccttcactgcttgatctcccaggaacaattaactgtaactgtaaggtatagtttttttcagaatgaaatttctagaataactgaatattatcaattttctagaataactgaatattatcactccctcatttgctttcaggaacacggcatgtttctgtacatgcatgtactactgagaatctgagatatactacctagcagatatagtactactgcttactcctatttgcttagcacatctgaaaacgactgagcctgaaccaagcacagaatgacaagaaacaatcctgaaagcaagaggaggtgacactgttcaatttcttgaaccaaaaataaataaaggagcttttccaccttcttgattgacatggatggaccccatatatgttcccagacatttaattagtgcggtgttaatttgacatacatgtaacctacaaatgcatttactcttgacatactactacctcagtgacgcggttaactttattaattcatttgaatattcatatttttaaaaatatatgtgcaaatagaaaaacatactactaggcatgttaaaattaagtttgatgagagaactagtgttactaatttcactttaattaactaagtaattgaataaatattattggttgaagttcaataaaaatatgtcaacagcgtcacatattaaaaaaccgaggcattatatcatcattaaattccctccatatcatggccatggatcatgaactaggcagatcaaagcgtcagctaattaaccagagctgagagcacacgctaactagctactatttgatcacctttaaactctagttgatggagtggacaagctaatcgatcgacagggaggggaaaattcagatgcactgaaactacacctctttgctgcttcgttgcttagttaatttctgaagataccaaggttggttgcatccggccctgatctgcatacagcgaaaatgtcgagtcgatgatcagctcgcgaagtgatcgatggagagggaaagatcgagagcaaaactgtcttattccttcgtgatttcaattcactgaaatcgttaaatatattgacaaatagacagaacgagcccacaatgcatatccctgtcgatctcttgagatcaggctagcgatcgagttgttgatgatgattatcaagtgatgactaatcgcttagtgagctaattactaattaattaaacaaatgcatagttgttttcgtattagatgcctgaatattaccattgtcattgctgcgcttagtctgtagtagcagcgatggttacattctcactttgtcctctctgctcaactgttctttcgccgtaacactgaaaaattgcatattttaactgaacatttggaaactgtgcagcgtctattctttacgcggagactagagcacgcgattattggtaagatttgtagctttcctcaaagttaatcaggctcagatcgtagatgacgatgaacaatagcctgcaccctgctgagcactcgcagatatgcatgatgaacagtagccaataatgcattatatcttttcttgacagtattgaacatatattggtaaagagaataaatcacaattgcagaattagtacacaagtgaggatacaagaacacaattacgattatacaccttgccttaaggataggtagtaggtagcaaagaatcttcgtagggcaggaaagcatttctacacgggaaacacaaagagagagaataatatagaaacaaggtccaagctctagaaccctaaaagcctaaaaagtggcgatatttcaaagaaacagattagacaagagagagctacacgcagcctacgtctaatttacaccgctaaacattccgctatggtcatacagtaaatcattggtggccgaattcataaatgtcttcctgaatcttcgccgcttcatcgatcatatgtcaacacctaatctccctgctcattattagtagcttacagtggcaagaaaaagtttaaacaggcctattaaccagtaagatgtccagcaagtctatctattggtaccaataaattttaaggttggatccttcacttgggataagtatgtgacagcgacttgagaattgctacctgaacatcagagagagcgtttgagtgattcttcagatgaacaaccccagaacagtgctcaattgttctgaaactgatcaagctgcccaatcagacgctaacgtacacgatctttcttccattaattccgcatcgtctgacagctccgattaggatccctcagcatcatggtcgattctgtctgtcagtgtggccacattattcccaaggaaacagcaaccattttggcagcacactgctcattatttcagtatttcagttctgaaaaaaaaatagaaatctttctagaatttcatgttcaggaaattctccctgaccctgacttgtcatgatctttagtttctccagcaagtagtagatttgacaagacaatctttctgacgagagcaattatctttggaggaggagggggctataaagtcaaggctgcctgctactgctaagactaacaagaacacaagaaccctaccagtgaggtcagatcttgcgggcaaaaaaaaaaaaaaaagaaaagcagctttctgcagaagcaacggacccatctccagctgctcttctgcttctgttcagctcaccggtgcacatcgccgacgtgaaccgcttgcctgtttcagaaaaaaagcatcggcgaattgatcgagtagttgatagcaagaacaagctaggccaatcgatcgacagcttggccaatttcctcgccgccgcgtgttgccattccatttggttgttgcttttcgattgacagtggcatcttgcgagcgcatgattgcgttatccttttctcttcctctgaatcctgaaattgatcgatgccagcgttatgctgctgcagacagatgaggggtgtgttcatccgatcctatcctgttgttgttggtggtggtggtgctaaggcacatcttttttttattatttttgggggtctggaaacatgatgatgatttatacaatgtcctatcataattgcattattagggtgacattaatttgacgcgaaatggcagcagccaatgtgcagagttgcagaggcaaatccacatgcaatgcactgaccctgcaggttggcccatgggctgaaccgaccagttcagcccatggagaaatgatgggctttaacggccctgcccgtaactcaacatgggccgggccatcaaagagggttctcttcccgactcgcattttcaggggaaaaatatcgctgtttggagcagagttaaatattccaagtgggatacactggcagtctggcagaggcgtggagattcagttaagtttcacctccacgaaaagagagttaacaccctttttacctgcaggggagattttgcagtgggtgtgcccgtgtgggtacatctatacaagattttactctcctcatttgttatacttttttttcaaaaatatttaactcattttttgaagtatcttttttttctgaaaacgttttttaaaagtattttgatctcttgtttgaaaatcaaatttgttacggttctattgtatgtgatatatatatatatatatatatatatatatatatatatatatatatatatattgagaaaagtacatctttttaggtttgtagtatatagtaaatttatttctattttctaatgtatacggtaggaaatcggacacggaattaacacgtctcaaccacataacatgggcttcttttatctaataaaaaaatatacgtgacattgcatagaccaaatgatcatagtaatattcaactaagtttcatggtcggacaatgcttctaataatagtataccctacacgacaagcaacaataagcagacaacgtcgataaagtgggaattgccgcatgtgaatcttatcattctctgcagctctcgagagacgatttatcgggtagtgcgcttccacggcaatcttcacttcgcaacttgacacttgttgtcggacatcattatactttgaaaaacacctttctgcacaattaggatatattagtcacgcatgatgtacaaacgcgcagagacttttcttgtaagaaaaccacgttcaaacgtcagaaaaaaaaccgctagattatatatgcctctagaacatttcttcatggcatgcagggtccccacaaaacctttattgtgaagtgcaaattagccctgagttgcggtgccctttttgagctcttcaatccaacattcttcgtttgccattggagcaactcgagtttaatacaaaacccctcttggaacagcgtaccaaaaagccttctgcacacctgagagcaatcaaaagacacaaactgctcagaatgtgctggatttctttacccaaaatgatgcagcaagtaggagcatcccttgcttgtttggtctttaattttgccctctaattttctctccccaaaactttcaccagacgtccagatggccgccattattccgcacgataaacgagggagaatttgacgtgtctgcaatgtaaaaaccaacgatatttttttcacataagtaaatatgtatgaccatactgccaagtgccaactatgcatcatatcaattttacgtttcaaatatgcatgaccatgctagggcctcatcttttcgatcatgcctatatttctcagtcaaaatttaaattttcaaacagtgctatatttggttcttggtagagtgcactatgcagtgggcatatttgatttttaattatagctagttatactccaaaattaactggatattcacgtgcattatgtaacttgaaatgaaaactatacaaatcacttgcaacgaattgacaaactgaaactaatcaaacctgaaatattacgtttaaaagtatgcacgcaacaaattaaaaaccatacatatatcatatcagtacacctttttttcttcgaaaccagagcagtacaactttggtacaacacatcgtagtactcgcaccggaaaacacatcgtagtacatagacacaagccagattgcaacacacacacacacaaaaaaaaaataactccatgacagtgagctgctcagttgcatatatatgtagtgcaaagttactgcaaatttgcaacctgatcatcttgatcaagaacagctatgatcaacagtagcatacaatgcatggttaattgtttggacgaccttggttgttgcctgatctgaagatggagagctcagctctcacgtcgatctgtatggcgccaccgcccctgctgccggcggcggcggcggcggcggcggcgctgctgctgctgttgagcgacgcggcgagctcctcgccctcgcggtacctctgcaggtacctgtgcatggcgtcggcgtagtggtcgaggccgaggctcctcatggcgtggcagacgtcgtcgccgttcaccgtcttccgccgctcccgccggcaccgctccgacgcctcgccggtgacgaagctgatgaactccgtcgcgcactcctggatcgtctccttggcccgcttcgatatcttcgcctgcggcggcagcccgtccttcatgatccggcccacgttggcgatcggcagcaggttgtcctgcccgttcgtcatcgtcacgccgccgccgccgccatcgccatcgccgccgtctcgatctctcgacgccgaggttgacgacgacgacgccctaggaagcccttgcatgggttggaggcgacccaattggttaaatccagagaaattgagatcgcggctcattttctttggtggaaaagggggtatgtatcttatctcccttataagagaagagagtcgtatggtataaatgggccgcaccgtcgtagcaaacctcgtgatattgttaccgactgtgctgaagggaattggctgactatgctgaagagaaccggctatagctctatttatgcgttgagcggcgggtttttttctacttgtttattggattttctcgatcttgttgaaaaaagtgtggaatgttatgttgtaacgtagggctagcattgcccgccagcaccacatgagataatgattctttccctttccttacaaaaatatggtgcgcccgcagtatttatttgtctattcaattatttatatccaacttgtttggaaaagagttcttttttttacaattttgaggaaagaaataatgggaaattacatgcatgcaaatttgtttgatatgcatgtggactgatttttgactcactacaagtacgcggtaccgtgctttttcatgaacataatatacaaaagtaacataagccaacatttcaatttgttttatatatacttttatagggcaacaattttgtatactactgtatatatatgtagagtgatataaaatcgcatcgatcgatgggcaatcaagcgtttacgtagacttgtgccctgtatctattcatcgctcgcaaaagaagttatctgacacaaaactacatgtacatatattcagttggcgtgtgtagatataatcaaattaatcttcggctaattaattaacggtcgttatgataagaaaaatgttaatcaacggcagtttggactcaactagcagctgcagatcaattaaagtcacaagaagatacccgcataatttttttttacatatatacgataaaatatgaaaaaagtgacagagagcacacactaacacacatgaactttcgatactagtactaattaaagaaatgaaagtgcagagaagaataactttttggcccaagctaattaagcttaagctaatagcactactaattaagtttagccaatcaggctgcgtcctttacaccggcgatggtgtgtatagtcctctaggcgggcgacacctgccggccgacaagccgtgcggccctcccatggcggcgatgatggcctccatcgccgcggcacgtggccgtggatactcccgaatcaatgtcgagacgacgacgacgacgacgacgatcgaggaagaggatgacgaggaagacgagatggaggagaaggcaacttggtcatataaaaggctaccgatttgcagctttctgacgccaaaagggggataattaagcaaatggtagttacacagcaatttgctgtggccaatttggaggagtagtgtgcatatcaagttttcatcttttgatgcgctgattcctagctcccaatcggatggaaccatccttgaatttttctttattatatggtttcattttcccatggacattgtgaggaattaactaacatgtactagacggtaccgacgaagaggctttcgacacatatcatgtgcatgcatgtacaacctcaagtgttagctagctacatacgttagagtttgtgtcaaatatatatacgtaatcggttacagtttaagacttgaagttgaattagataaaaaaaatagagtaaaagtcagactctatcctaaactctctcttaaatagagagatagacatgttgtaaccgtatagcgacttagcataggcgagagggagcggctatcgatcagtggcatccggtcaaggtcgttgtaactctaatatgttgtaatatgctgaaccagggaggtcctcggaatataggtgttggctgaactcgttatcaaatattgtgtctcggtatcgtcatcagttttggatctcctatggcattaaataatccacataatttggagttacataattaaaaagttataaaattttgagacaattaacccacataattgaaaatcgacaaaggattaaatgtagttggtgtttagggattgggattgcatatttggagtacaaaaaacaagtatagtttaattagtgacacacacatatatactactaaaaattcagcagtacagaattaattataactaagaaacatgtactatctccgtttcacaatataagtctttttagcactgcccacattcatttaatatatacatatgtctagattcattaacatctatatttttttacgaggattaacatctatatgtgtgtgagcagtgctagaaagtcttacagtatataacactatatgtgtagttggaacaagttaccagaaaaagtcaaccatgcatgtggatatatacccttacagtactaaacaataatcaaacttaattcacatcaatggtgaagcacgggctggatatatacatatatagtcgatcgacaaaaggttaattttcacaaatttaacacgaatgactttctttccgataa

SEQ ID NO: 3305 - DNA, 7127 bp, Oryza sativa
actaactaagaatatacacactatatatgttaatttttgtagacatcagaatttgaactctatgatctataatgaattgatataaatgaacgactagcataattcaaacattaattcaattcttgtaggcatagaaacactctcacacaattacgacaaggcactctctatgtcaaagaaaaaaaatcaaattttatataggaatctagacataatatgtagaaaagttgatttattttgggatggacaaagtaaataaaaactatacggtgcattttgctagcgacatatatacctcggtttgtgtatcaatcaaccatacaagcatattatgtagtttaaattaaatctgataagaaatactattatttatatatataagcaatgaagaaggtcaacacacaatgcaagaatgcataacacacagggtgcagaagttatatatgtggtgctcaagaataagagacagtgcctaactaatttctcaagagtcaaaacttatcaaactaaacccatatatgcatgatgaaatagctagcctaggaatatcaatcagcacaatattatccctatataggcataaggcatgcaggaacctagaaatcaacttttgatcaaatctagaattaaatttactcagattcaaaaatacccaactccaactatgtcaatcgtcataacgtgcagatcaaaataattaatcactacaaaaattaaattggacgtacaagaattattcatataaaatcgatcattttgcatactccgattaattactccatatccatcatgtcgccgggccatcttagctgctagcttcttcatcctaacctcatcttccatgtccttcaatcaatctcagcacatccatccccacctagcttctcaccatcatatcacaccatgaacacagattaattagctaatctagctagctactagtagctaagcactggctactcttactaattattaattagcttagccactgcaatagctgttcatatggaggagtaaggtaagatggagtagctagagacgatggagtagcttagcttaattaaattactgacctctcaagattaggaggaaaggttgggtgttgggtgagaagaagacgacgcaaagaacggtggctagaactgcctggagctatccgtcgacctgtccatggcgttgaacatgaaatgaccggcggtggcggcggcggcggaggaggaggaggaagggtggtcggggcccgcggcggcgccggcgccggagcgggaggtggcggcggcggcggcgcggtcgccctcgagctcgcggtacttgttgaggtacctgcgcatggggtcgacgtagtcgtcgaagccgagggcgccgaaggcccagcagacgtcgtcgccgttgaccgtcttgcgcttctccttgtggcacttgtcggaggcctcgccggtgacgaagctgatgaactccgagacgcactcctgcatcgtctccttggcctccttggagatcttggcgttgggggggaggatctgcttcatgattcgccccacgttcgcgattggcagcaacctgtcctgctccttgatgatctccgccgccgcctgatccgccgcctccccctgcagctgctgctgccggcgatgcccgtcggcgtggtggccgccatggtggtcggccatggctaagctcgagctctctctctctctctctcttcagtggtggtggtggtgagttcttgggctagtggaagcgctacagtatatatgacgatttagagggcagcacgcgcgcggccgccgttggttgtgtcttttatatgcggttgggtaatccgattggcgagagagacgaccagatcgattcacttgttattgttgggaataatggacttttcttcatctgctttcgctaagctatacgcatcacatcctaagagccgagtataataaggtgaagaaaacgggctgtataattaagttgtcacctcatatttgtgcttatatggagaaaagaaaaaaaaagaaagaacaaaacagactacaaatttacagccaactgcagcacaaacttcaatgtattaggtattaatgatacgatgtatatctacaattaactattgtatgagtagactattaggtgtattattaaatttgctctaatactacaagtctaaatagtctttatctagatatccaaatttttagtacaagatgaataaattatactccatccgtcccattttaagtggccatgattttccgtgcccaactttgattgtccgtcttatttgaaaaaatttaaaaacataagtgacgcgcaaagtactagtcatgttttaacaataaaaatactaattataaaaaaaattaaataaggcggtgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtgagcctcacctaaccacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacagcctatatgttgtatgaagaagggcgaacatgcagattgttgaactgacgcgtggaggacaagaatgaccggtctgacactggtcatgtcgtcggcagacagccacgttcccacgacgcgcctgccttcggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagattcggaacttagaacaagtgagaggttggctcacactttgtagctccctcatacacagatccaccaaaacacaggagtagggtattacgcttctcagcggcccgaacctgtatacatcgcccgtgtctcgcgtttcttcctggctcgcgatctttccacataccgagagagcttgagatttcaccctaagcccccggccgaactggcaaaggggggcctgcgcggtctcccggtgaggagccacgagctccgtcatctggcgcgccaggtagggggctcagcgtgtgtcttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcgctcgagagggtcgaaaaatccgcagcatcgccagtcgcgggtgatgcaggagaacggcgagatggggagcgtcgcctcctcgtctacggcgacggcagcacgcctcagggcgcgcttcaggctgttggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcgtcaaggcggagggcgcggcgagcggcggctgttgcacgccattcggctgccactccctcgtcggcacctccgactcgggaggatcagcatggagagccggatgctcgcctcgacatcgagcgccggcgtaatagccggcgtactcctcgcgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatggaagtgtcaaccccaccgagtttctccaggtctatacgaccgggattgaggccgctgggggtgacgacagggtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctacgcgttcagggggggggtgtgcggcacaaccgcatgctcgaaaagatcgcttccaaagagtcccagactaccgcagagctttttcagctcgcggaccgagtggctcgcaaggaggaggcctggacctagaacccctccggttccggagtggcagcttcggccgcccccggatccgccactcagacagggcggcgtgacaggaggaggaagaagaggtcagcccataccgacgacgagggtcatgtcctcgccgtcgagggcgctccgcgggccacccgaaaggggaggcctgcgagcgacaaaaagaaggaagccgacgctccctgacctcggctacttggaagagcgaaggcggcgcgcggcccttcgagccgcgcgctaccagcagagcctgcggcgctaccatcagcgccacgtccgggcccgatcactctacgtcgacgacctcgtcctacgccgcgtccaaacgcgtgctggattgagcaagctctcaccaatgtgggagggtccgtatcgagtgatcggcgtcccccggccgggctccgttcggctggccacgggtgacggcacagagctgcctaacccgtggaacatcgaccaccctcgtcgcttctacccctagtgggggtcgggtgtcaggtcttgggctcgggccaaccccgcgcccccccccccccggggcgtgcagggttggccgggggcttatcttttttctcttccgtatttcaataaaaacattttcgatttcctaaggactgtgtctgtgccattgtttccttttgaagaatattggcttgaattagcacgctcgtgctcgatcctgtcctcgggggctcgggtcggctaaaatcgccaaacggggcccagaaccgagccgtgccccggggcgtggtgaactccgagggggaatcggcaaaaacccacaatcgggtcacccataaccctcggtcaccacgctcccggcctggccagtctcgacatgtggatcttcccaggcactagccccgacccgagccatttgaggactaggacctgggcacgagcccttgttcaagccaagacacagaaggaccgaggcataggccatccttgtctcatacacacaacaaatagaattgacatagaaatttcctctttatttggttgcagattaaattagtctatacaagaagggggcccgaaggcctcggaagaagaaagaaaaagttattcaagattggcgggggcctgggggctcactccgacgcgcccgggtcaccagccttgtcgtcgctgtcgtccgcaccaccgtcaccgccctcctcgtcggagtcgagggcgaacgcgagccgaggggccgtaccctcgaagctgtggacgatgtggtcggcggcgtcccggacctgcgcgcgtgcgccgtcctcagttccggaagggaactcttccagcgctgcccacggggagaagtcagggtccgagaggcccccaagccgaacggcggcccaaggcccccgacggccggagctggccctctgcctgcttgttcgacggtgccaggcgcccccgacccccaggatggccccgaggccactgcgggaaggccgcgcctgtcgccctccgaccccgaggtcgtcggcgcagaagccgagggcgccccgcgctgcctctcggaggaagagcgccctggagatgcggcccctagcgaagaggatcggccccgccgaaaggtgcagcggcccgtctactttgttagcaaggccctccgggacgccaaaacccgataccctcaggcccagaagatgctatacgctattctgatggctccgagaaaagcaccatcaccatatctccaggcgaagcaaatcggctcgcccagattcgtgcgctgctcaggtaatgtggcagtcttgaagagaccgcccattattgacagccaaggtaccattaccgatgtgcatggtttgagaccgttgggtttttgcccaaccatggagaccggtcccacctgtcaccaggctttaggagtggcggtcatgcccgaccgcttcccttgagaagggcgatcgccctggcataacgccgggggctactgtcggtgatatgggaccgggagtatcgtgaccagaggcttgaggcagacacaatcgcccacgtggtctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtgagcctcacctaaccacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgtt

SEQ ID NO: 3306 - DNA, 2210 bp, Oryza sativa
ttagatttataccaggcttcatcccaaccattacagcctatatgttgtatgaagaagggcgaacatgcagattgttgaactgacgcgtggaggacaagaatgaccggtctgacactggtcatgtcgtcggcagacagccacgttcccacgacgcgcctgccttcggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagattcggaacttagaacaagtgagaggttggctcacactttgtagctccctcatacacagatccaccaaaacacaggagtagggtattacgcttctcagcggcccgaacctgtatacatcgcccgtgtctcgcgtttcttcctggctcgcgatctttccacataccgagagagcttgagatttcaccctaagcccccggccgaactggcaaaggggggcctgcgcggtctcccggtgaggagccacgagctccgtcaggcggatattcaaaattggatatggaaacttatggttacacttataatgagacggatggagtatttgattaggggtatgtttagttgctgaaaaaagttgaagtttgaagaagttgggagtttggaaaaaaagttagaagtttatatgtgtatgaaaattttttatgtgatatgatgtgatggaaagttggtaatagaggggaaactaaccacggtctaggttggtttttacagaggcggtacttcatacatcctactccagctaactccatccagctggggtgtgtgtgtgagagagatcagacaaggacaaggacaagtcacagagagagacagacatgtactgggagtttgtgacgtggggcggggtttgaaatgtcaccggccactcggtcggtcatcacgacgacgtacgactcggtcggtcgccgatgagagcttcaccggcctgttccggcgatcgatcgagctatatataaatgatggcccatgtgtgtacatccggatttgatcgaggtgagacagtgtttggctaatgagatagagaaatgattttccatccatcaaaagacatcttcaaatcctaaccattcattctccatattccatttaattctaacctttcatttatttcctaatcctaatcccactccccatttcccattatccaaacacaccggtattatgcatgattagctatgaccgagttcgatcgattatatatatattgcatcatcctcctgcacactacgtatgtatatatatatatatctcagttatttctcattttctgtataaacattcactcctatatgaaaatatccttatatatgtgatgacatgccatcaaaaggcacaaccaatggctgttactaaatagttcttgcatatatatgatctgttatatcatatccatcgtcactacgtaccagactagaaattatttgaagtttaacactatctcataaattattttgttgcaaatatgtacccacctcctactcgattttattgcaaaaaccacccaacacacatgtgcttaaccgaatcaatatgttttcataaattaagagacgtccgtataatctttatcaaaattaagtcattatttgtcaggacgggtatgctaacaatacaatattacttcaatttcgtaacaacgtgtgaggtatcaccatgagattagctggattgtaactacagagtatacaccatagtacagatgctagccagcgagagtggtgggggcgcgtgcgggacgcacgtgacgaaggcactgttgctcgccggggagaggcagcatcgatcggctcaaggccctgatctgatggatggatggatccccccaagatacagctaaccacatgcttaatttctccatcaacagcaactttccctgttacaaatagtactacgtaccagatctaccacaaacacatcacacattcacacattgatcgatttgcatattactattagtagctagctagtacattattgattattgctagttatagctagaatgctagtagtatatacccccagctagctaggtgattaaacaactaaaagaatgtcagtaatagtgcacttatcaatcaatca

SEQ ID NO: 3307 - DNA, 9070 bp, Oryza sativa
attcctgcagcccgcatgcatatatcggtagtacaaatatttgacatgcacgttgtgccttttttttttctaattagtgaactatagggtcatgaataataccaagcaagtttaattcttcgtaactccccaattctcaaatagaatgtctcgttttaggatacgagaagtagctaaacataccttgaaatctcaatgccctaattaattaacatatgcagtatacactggctcatcttttgcttgtcatctaaatatataattataaaagatctgaataaaaatcaagcaacatagatcacaacgtcacacgtcatttacaaatatgcaatactaaatacaatctacatatattccacactcaagaaacaattacatatatgaatattgttagtaccaatcatgacaaaatttgtttattttttctctccatatggattgattttggacttgaaattttgcaagattgtacatgcaaatatcaacgttctcatttttttcagatctttttataactatttagtttatatttaagaaatgaggcgcgcgcaaatatgttcacaacatgcacctgagcagtaaaaatacatctcccattggcggcaataatatcgatgccctaattaacaacaaacaaaagaaactactattgttttccctaaaaaaaaagaactactattgcaacactgtttttagcagaaatggatcggagatcgagggtgtgcctgcaagaatacaagttgtgcagaattatgagaaaaaaaaacgcgccgaattcgccggattagctagtactcctctctctgctagtacggagtagtatgcacactgtagtacactactccctcacagccataataaatctagactaccctttgtatagatttgttactattatagaagatgtcacatttttttttctatgttaagttttttttacagttaagttttttttacagagggagtagtaatataatcagagtggaatcttcatgtgtaataattatattagcaccattgattaatcaacgccagtatattagtcctcgatccaggtggcaatggatcgatggattggacacataacctaattaaaaaagtaatactccatcggtcccagaatatagcaatatactccgtaggatagatgtaacgtatcctaatactgtaaatttggacatgatatatcccataccagctagtactatattctaggatggaatgagtagctatccttgtggaaccttttatgttccgatataagattatctttacccatcttatttctcctaaaataagtcaatctttaagtgatcattgtattagggagtatgagacaatttatcaaaacaaaataaagtgaaaaaaagttacgtcttaaacacgataattttttggtccgtccgagatgagtcatctctgaagagtcgcgttgatgtgaaagtcgaatctttttaactttgtatttgtacgaatgggtgaaaaatagagatatttttaagaagggtgatagtactcccccgtcccattataagcgcaaccatgcgtttccgtgtctaattttgatcgtccgtcttatttatttttttataattagtatttttgttgttatgagataataaaacatagatcatacattatatgtgacttatattttttattttttaaaaataatttttaaataaaacagaggattaaaattagatgggacgaagggactagtacagactggcatgcagtgcgcggtctccaatgcatgcagaagcaggccaatcgggaaggccggggacagggcaagggcacatgtgtcggtccgtatgtggtccttaattccatgcagccagctgcgccctgcatgccttacctggtgctgctgacagcgtgtgcgacacgcgctcactgctgcagccttcctatttgcccaaatagatcgagattatttgtcagattataattgtccctaacaaaatttcatcctctagttaggccccgtttatttcccaaatttttttcctaaaaatatcacatcgaatctttagatacatgcataaagcattaaatataaataaataaataaactaattgtacagttatggaggaaattgcgagatgaatctttttgagtctaattagaccataattagccataagtgctacagtaacccacatgtgctaatgacggattaattaggctcaaaagattcgtctcgcggtttccaggcgagttatgaaattagttttttcattcgtgtccaaaaagtccttccgacatccggtcaaacattcgatgtgacacctaaaaatttttttttcgcgaactaaacaggcccttagcaccatgggattaaggctactccctccgtccagaatatagcaacctactgaattagacgcatcctagtactacgaatctggacaggaagcatgttcagattcatagtcctaggatacatctaatccagtcctacgttgctatattctaggacggagggagtatatgttttggaagcttttggtcaaatgcagcttcctttgtaatctctggctctttctaacaattcagatgctcgcgtagattctgagaaaaagtacgtacctacctattataatgaactaaaattcacaagctgaaaaaactagtttttttccatattcttattttgagaatctcaaattctcttacacatagcttaacctagattgtgtgttgtcggacattgaactcctccaccagggaaccgtgagaccccctttgtgagttcggccgggggcagcgggtgagattcaagggcttggtgagcggagctgtgtgatcttgagggggttaggcccctccaagacgatgagacaaaagaggtttatacaggttcgggccgctgagaatcgtaataccctactcctatgcatgattgattgaatgtagaacacaagtgtttagggttgcgagacccaagcgccagttcgctcggaagtcccccctcctccaccactaggcctggacctccttttatacctcaaggggttaccacatgggcccaacaacctaacctagctccgatggagaagtattataatctttgcattaaatgcatgtcttgtctcttgacttgggaagccaagcacacgtcgtcttgatgatggggcctgtcaaatcttgtcgcctgacacggagggtgcccctgtcagtcaccatttaatgggtgaagacttctgggctcctattacaccgggaaggagccttgctttgaacagagctggaggaccgactccggctgggataagaggatgagaacctctcaccatcactatttgatgggacatgttaggctgcatgccgcctgacacacgagcaacgcacaggcgcactagccagtcccatcggtcattcgaccggtcacagaccggttgagtgctctgcacgccgcattaaatgcagcgtggcgcgaccactcgggacgccataaatgcgggtaggtgggcacctggaggcagacacctaactcaccgtacgtggtgacctagagagggggtcgggggagcccgacccctagtcacgggaggggcagccgccgcctgacctcgggcccgatcccccctcgggggggagccacgtggcgcctggggcggccttctccctctagcctaggccagggagtggccgccgccctacctcaggcccgacccccctcggggagggccacgtggcattggagggcagcctcctccatccaatctctgggaaggagtggccgccgtcctacctcgggcctgactcccctcgggggagggccacgtggcatcggggggcagcctgatacccccgggaccatatcaccgacatgtgtgtttggcagtcgtcccgtgcattctgctaataacgatgatgtgttaatttggaatgtgtttttttgtgattgatactgataatggcactataggtacagaactccagatagctaggcatatgcctttcttcttttctagccagtgacagtgactaatcttactggctccagtgacttacaggaggagcaggggagtctagctttcgttgctgtggctgcttttctatccattcatggaccataggaagtgcaacaagtggcatatggagttagcactttgcatatatatgcttcatgccaaaggggaaagggaaaaggacctactatacataaagtttgggatgatgcctctcagacatctttgaggttggtccactcttgttgtggattcctatgcacataagagtactacagcagatgtgcttgacagtggaaaagcgccccttaatttcttgtagagattaatcctctttgtttcaagcaaagctagactagagcataaggaaatgtcagcttcaatcatctgcattatctgatctagattctagcttaaaaaaactctatgcactaattcacattgagttatatgtaccactcaaattctagaacataagcttaagttgacgaggaagctatacatgtagatgtagttcgtttaagcagcttgtttttctttgcataaaattaagttgtagattactgtttcaaattgattactgttttcaaacaatacacataaatataaaatggtttgacaataaggtagaagggactattggcttagtggtggtaaagttgtgggtgcacggctttatccatttagaactcaaattcatatgtcctgtttttgattcaatagatattttgagatgttaggatgtactgttgacctccatctctatatctgagcgtgtgtacaagtatggagtgtcttccatgtaataacaaaatgtagagcgggatatatatgtaatttccatgctggtgaagtgaaaaaacagagatagaaggtccaatcaacggggagattcctgacatatatatattggttttggtcagaactgaatgctccaagaatcaacagttaaatatacttacaaacaacatgcaaggaagcacagattccttgttgatttgattattcctctgttttcatccatgcgtccatgctattaactctaaacatctcaacaaatggggccacgagttgctttggcaactaggtataattcaactctttggattctagcgaccaatatacaaccttgaactcaaaggaatctccatgacgacctgcaggagatgcatgaatccattaattgaactgcaatatatatggagcctcttagtgccggcacgatgactaattaagagtttaagacccaatgcaagcaggctcgtttaattttcttatcagatccaccactaaaacctgagaaattctcactatggaattaactactagcctaactacctcgattgcacatgccaacgagcgcctcacgcattcatgttctatctcttcagacatcggtttgattattggatagttggcaagaaaagtatggaataatcttgcagcaaattaaaagattaccaaaacgacatcagcaacgagatgtgaacctctgaagaattcagaacagagatggacagagagcacgcgtgcaggaccacgcactaaggcgatttctgtggcgcatgtctagctagcagcatgaaattaaatcaaatatatatccatctcaggtcatctctaacatgtctcgctgcaagcagatctggattaaagaaacggagaagcatatgcagttgcaagttcatgcaggtataagattctgcaaaccgagcgctggattccaaatgatccatggaccagctgcgagagaaattaaaggaatttaaaagatgtagacgacgacgaaaccaagccggccaatgcgagaaataataatgcctgatatatgaattaagtcgagggttttgttggtgtcaggtgtgattttcatgcaccttgcggacgtcgccctctcctattcacaacctagctatcggccagtggctgattcagctctcgggtagatcgggtgaccgtcgggactttggcattatcgtcatcaccatcgatagccatcgacaccgaaaaatattattaagttgttagggcttaatgatatcgctaggttcactacttacctcaacaccacgattctcctccttctccgatagctcacactgtagatccaccaccgtctcccaatgcctcctagtgcctccaccaacaaattactagctcttatcgctaacatatggtctctctcccgcgactaaggtagcgtcatcgccacctcgtcgccccaccacagccacccccattgtcgggccacagtcacctcggctaccgcctgttgacacgaaaagctatcgcctccacacgaagatatgggagttgtgtttatctccaatgggttataaaaattcaggttactatatatgtaagtaatataagtttcagcatatatgctactacctccatcccaaaatgtttgacactgttgacttttttaaaaatgtttgaccgttcgtcttattcaaaaaatttaagtaattattaattctttttctatcatttgatttattgttaaatatatttttatgtatatatatagttttacacatatcacaaaagtttttgaataaaacaaacggtcaaacatgtttaaaaaagtcaacggtgtcaaatatttagggaaggagggagtatatataaaccgaaaatactatatgtgctgaattatggatgttaatcgctgcaaaacacgtactgctatatatgtgagattaattatatttgctgttctggcgtgttggcgtgaatgcgtgatgcatgcatgcatgcggagatgcaaaacactgaacacacatgtgcatgcatgcatacgtactttctcctgtttggactgaagtaacactgcatattttcatgcacgttttcgttgtgaaaacgtactgttcgaccgtctctgcatggtatatgcatgcaagatatatatagctggtcagatgattaattattgcgacgacacgatgtgacatacaaatcggccgtatcttcagagagcaaacaacaacagctagctggcgagtgatatgatcgatagggaaggagtactcctgcatgtcttgatcgatcatactggtggagaaaccatatttggtcggtccaaccaaattcacaatagtcccggttccattaaaaaccgggactaaaaagcatttttagtccggtttataattgtaatgggactatatcatctttaatcccggttcgtgttatcaaccgggactaaaaatcatctttagtcccggttggtaacaccaaccgggaataaagatgatctttactcccggctcatgtcgtctgaacggctgccgctccctagcgaccggtattcgcggtcgagcttaccgacccggactaaaatcctgactttagccccggttgttgttcccaaccgggactaaaaatcaagtacaccgtatataatccattgctgctatcctcaaaaaatttctatctcctattcctcctcctctctctcacacttatccttatcttcttctcagacttctctctcacaacacttagccggaggagctcggccctggagcgcggcggcggggaccctggcgcggtcggcggctcgtgccgggaggcggtgggggccgtccgcggcaggcggtggcgacggcccgcggcggtggccgcccgcgcaggaggaggcggctgcggcggccgtccgcggtaggaggcagcagcggtggccgcccgcgcaggaggaggcggcggtagccgcccgcggtaggaggcagcggtggcagcggccagatttttctttttttaataacttgtgattcaatggatctggatctgtgttatttgatctgtgatgtatttgtgatctgtgatgtatatgtgattgtgattgtgatgtaatttttttttagaatttgtgatgttttttttctgacaatttgtgatgtgaatattatgatttgtgatgttgctatttgatctggggatgtagggagcatcttgatttcgatttggaatttctgattgattttgtgattttggagagattggtgtgaaatcaatattcaaaagaacaatggaaaaaaacctggaactaaccctttagtcccggttagtgttgtcaaccgggactaaagattcttctctttactcccggttggtgttaccaaccgggactaaatatcgatctcttgtcccgagtatttaaaccgggactaaagatagtgatctttagtcccggattgttactcccggttggaaaaccgggactataggggattcccaaccgggagtaaagagcatttctctacctgtgttaatttcagctctagcacaattacatgaacatgctacatgcacatggtaattaatcatactcgttttactatgaccaggttacagggtccggctatatatttagaggaccttacgtgaacttcgtaacataaactctcaaaactagatataattttacttgtaatatatatttttataaatcatatacagtaaaaatgatgcaaataaacattataaacacctaaaattacgatgtaaattaatcaaacgagaaaaaacaaaatcacagcccaatttttagactatagatatatagatgcaaataaggagataagaaaatcacaagacttcactttaagcccctaaccacaatgaaataaagtgtgactgtgtgggagtcggacattctgatggctgggttggttggcataggcgaatccaggggtagtccggtccactcgggaccacctgaaaaaatcctgacccaatacatatatatacatatgtgaaaagaaacttttagaaaaggaaaaataacttctttattaatatgttatgatgcacattagatcagtttatagttataactttgttatatttagagtatttaaaagaattatataagttggatcatccatataaaaaatcctagatatgccactgttgattggtgattcacattggtagtttggtaaagttagtatgaaatttaaaattatgtcgtcattttaatatattatatatattaataaattgagaaaacatatatgttattatacgagaaaaaaatataatgatgctagcgggtaatctgcgcgggacaacatgctag

SEQ ID NO: 3308 - DNA, 32651 bp, Oryza sativa
ctaatagttcgctatcgtaactgctcttaggatgcacggggtacgaccatcctaccgtcgtaggtacgcacgtactgtacgtacaatggatcgacgtaaatgcctaccccaggtccaatgtaaatgcatgcctcatgcacccattcactactcatgaaattagtgcttcacctgtcatcttatcttaaccatttctcatttaattttacgtgaaaattttttaaaaagcgtttataatttaggatgtagcgagtacgtactgtattactgcatctgcatgcaatgtaattagtggtgtaagtaggtcagccgcgaacctactttttatcaaaataagcgggtttgtggtttattttagcttataaatgagttttgtgggttaatcacttactccacccctaagggtgtgttcggcaccccttttcccaacccatctccctcatttttcgcgcgtatgattttcaaactactaaaaggtacgtttttttaaaaaaagttgtttaaaaaaaatcaaattaatccatttttgaaaaaaaaaagctaatactgcgaacacaccctaagggggtgtttgggaaagaggggctaaactcaaaaaaataagtccctcccctagggacttacggctgtttggttggagggagcttttaagagggattgagagtttagagggatgaggctattaactgttttgtttggttgaaatacatgggaattttggtgggatggggatggggaattgagggagaaactccctccttttcaatacatgggtaggggaggtaattaggaggaaatttctcctttattttgcctaaacaaatctcagccatccattttcattaatgacctaaactccaactaaactccctttcaatttccaccacctctaccaaataagatactgggattaaaaatcaaattcccattttaatatcaccatcaattccctcgtataaactcccaattcccttccctcaagttaccaaacaagctgttatggttttgagagaggggctactctctcccaaacaccccctaatacactccatgacgccgagagagagaaagacagatgacgcagatgaagttggtcgctagctgccgtcggcatgcgtttctccggccgtccaccagctggtttctgaaacttttgctgaatctgctctgcaaatgccggaggagagggaccgcgcggccagcgctctgcaggcgacgacgacgaagaacgacagaggcgtcagaggcagagtaaatgtaggagtaatttaaacattgaccaggtgaatgatccatcattcgtggcacctctggcaacaatggaatacgatgacgacgtcacttttgcgcctttgaatgatccatttaatcgacagttatgcatcaccagaagagaagttaattctgcattactgaacattcaaaatgatgttttttgttttttttgtttttgtttttcctctctccctgcatttctcttcacctcaagagaatatcccccttgtgatgcagagaaagaagagagagtttcagagatagtaagaaacttatcgagttttgttgtttttatacactcaggttttgatttctcgagtgaagactgcactgatgtgagaattaatgtgggtgacagagatccctgcaactgcaaatgaattaaggttgatgattcgatggccttaaatctgtcaactgttgcagtgctgaagaagatgctggacaaaggcagcagcagcagagcacgttttcgtcactcgccagcagcagcagcagacgtcgggtaatggtttacagttactgttcagaacaggttcagagaaaaagctttggcgaaattaatgtgagaattccaaggcaataatacacgtaaggtacagtaggtaggtacggccctgcaatgcatgcagctcatgatgaggccacgttttattctgggagcatgtaagaaaacatgcttagcacagtgcttaaaactttaatacatgtgccatagtataaacagtagtagaacacacatgggttttcagagtttcagacttcttcagaactttctactgcaactcgttatctgaacatggaattcctctgaacattgctatggcagttcagatttaagcccacgaattcggcagataagcagagcccatggagaaaatgagatgaatttgggctgaaagcgtgtccaagatatatgggcctatgaatcctcagaaagatatatgggcctaaagatgaatttggtccgcataaggttttctcacctatgggcttcagagatttttcagccatttttttcttaagaacatgtcagtacaatacagtaattgctaaagtttatctctaatatttctcgacgagattaatccatttctgatttatcgtagataataatccatctaaagcgaaaatatttttcatctcaaagagaaataaaattattttaacaaaatttatctatactactactagtagtaataaacaaatgaggaggaaatggtagagcactacacataaagcgatcttttcagaaaataattttgtcccgaaaaatacggattgtggagatgataatatagtacgttaaggcactgcctcccggggcccacctttttatctgcgttcccacctgcgacggaggagaagagagagaaacccctcaaaaccctcctcacccgcttgacctcgccaatcgccggcgagcgacaggcgagacgagagcccgcggcggcggcagcggcggcggcgatcaggacccgatcctcaccggcgcacttctcctggttagaagctcctcctcctcctcttcctccccctcgagttcctggttgattggattgatggttggttggttcgctttcccccctaatctggttgaatcgggttgtgttccgagcaatctgatccaatccgatgggcgttctccggcgaggtggatgccgcccgcccgccccctaggttatgcgagattttctaggaagtagccctcgccccttcgccttcttcggtgctcaacacgtagggatgaatcgcggctatcggcttccccgttagtctgaccgatccctcaccggcaaaggctttcgagtaggcctccccgtgcgcaccactgatccatcgctgaggggatggatttggataggttagtacgtttgttggtggtgaactctaatcaaaatattttcgtcttgcgtgggttctcatcttgagttttggtgtgggctatctaatcgaaatattttttctctccagtcatccagtttgttgaggattcgtttgatgcgtggtggttttgttcatttcggaagttttttggaaatcggcttaatccccatgcccctacgttaggttgtcctctgtctactgtaacgattgacatggatgctgaattgttgttaggtcctttatatgtatctatctgtatgacatcatttttatagctccttgatttggatggaaatagggtttgtggtacatgacaggttgattgttatgtgtcgcatactgcacatggatgaaatttgtagttggatactactcaggagtgctactgtctattgaattaagaaaaacaggagtattattttcatgtcatcatgcaacattattgaaatttttaataagaaactactttgtgttattttgcctatttgtataaaacttctacgttctctgaatccccttgcataacaaacattgctggatacataaaaatcgattcctcttattgatatttccatcgcttcagttcattgcaggagcaaagcagtaaaaatgaacgagcacctccgctttgaggatggctggaagatcctggaacaggggattgtgaaatgctcaaagcttttggaggattgccctggtggaaggccaactgtgaatgagtacatgaattactatgagtatgcttctatcttaccactgcacattatgcatgttctcggttatccacatggtattaaaaacttgctgctcatcatacattcctctatgttttccagttgcgcttaccggatggctgtgcagaaagaccagtattgtcaagagatgtacaattcttacaaagcaacacatgaaagttgcgtctgtgcaatggtactacagtactagactgttgctagtttttaaatccacaatgtcatatttctagacatagccaagtaagtttattgtgttgcataatgatgattgaaatcctcaatttgaatctaatgaaatgtcaacttcatttacctccatagatcatctgttgtaaaatctgttgttacagctcactgtcttgacgctcacatataaaatcttattaacatattgtttgatgtactgctgttaggcctagggaagttaggtcttgtacaccatgcctcccataaaaatgaagctcacatgcacatatgattgtatcggtacccatggaaaaaagatagcaacttagcggtccttctgctgttgtgaaacaggcatgtttgatttgactaatatgtgttattatttgatatgcttattatcatttcacatattattaatttaatacgtgaaacaggcatgctcacatataaaatcttattaacatatgattgtatctgtttgcatcttgtgtgttacaagttcctttagttggagaagagagttcggccgttctatcccttggttcacttattttatgtatttaggttttaccccatctgatgcataagcaaggtgacttattttggagagagcttgtgaaaatgtggtcaaactattgtgccatgattagattcacaactggctttttggcctatttggaccgctgctttgttacacataagaaactaccttcgcttgaagacgctgctgctacttctttcttttctccagtgagtgtcacgcaataattcttttagttaatattccatgtgcatttgtgataataatctgcttacgtatctatttctgtacacacaactgatcatgtccttctgccaggtcttttcctacttcaataatgaaatatcagatgttctactgactctggtaatctgacatggtatacattttattacccttttaactgcattccttctgtgcataacaattaattcatcccagattcgccaagagcgtgatggatgcaatgttgatatggatcttttgatgggtattatgcgtggcatatgtcgttctgaagtcaaaaccaagctgaaaagtgctgttattcaagatacatacttgtactactccaggaaaagttatgaatggattgtgcaataccctttgcaagattaccttgctaaggtaacctacttcaatagaactacgtagtgaggcagtgttacttcctttgtagtttctgaacactgtttatatgtgttatcttgtaggtccaggaaactgtgcagaaggaaatgaagagactgattcactatctgtgtatttctgaggaagagggttcaggcctctgtttgaaggtaagctaggatcattacgagtacagttttatgacctcgagttcatgtgcacccatcatactttctacagtttaaaagattctaaaaaagaatatatatacattgacaatatgtaatgacatgttgacctgcaaaaagaaaatgggtgttacaaaagtcatttgtatatacattgcatatgagaccatattttttcacaaatttggtgcagttgctagtgcatagatggatgaactataacttgggtgcatatgagctcaagttcttttctgcatttcatgagtgtactgtgtccagtagaagccaagcagtccttatctatcccatgtttttgatgtttcaaattcaattttcaatttgccccctgcacctgataaggttatgattgcttaaacttggaccactgcactgcatcagctaccatgcttgtttttttaaaaaatatctttaattaaattttgttactttagactttgataaaaattgaaaagaaagaaaactgagatactattgtttcttatactctgtctgttctgtaacaggctgttagtgctccattgatgcaagcttatgaaaactatacgaaagagaaacatattggtggtcaagttttgcttcaaacatacaaggtaaactcagctgcattcccagtatcgtttgatagctcatttccttttaatagattgcaactaaccattcatttactcatagcagactgtagaggatgatcttctggacagatgcagtcgcttgacaattgacaatggcttggacaacaattctttcagtcacatggagtagtaaggtagcattagctaacatctgcctataagccaggttacatatagaagggttttagaacatggtctacatgaacgagaaccttttgtgcagctaggtttttgcgatagctcgaagctgccacgtatagatcttgttgacctatcactgatctcattggcaagattcagttagagttctatgtgcacgctatactgaatccatacttcttttttgcatggacacaagagattaattcttagtccacctaaacataatgattccggctcctttgcctcatggtgcatagcgttccgcagaatcagatgcgctcgagatgtacaggatgctagacagcattgtgtttcctgttactgcctttaggtgttagggtgagtgcatgtgcctgtccacatcaaaagtttgtggcatgacatctgatgaatgggtacgcgtaatctgttgccttgcctttgcctgcttctgatgctgttcattgttgaagtctgctcatctagttttctgtgacttgattctactctgctttgattgcctgtcttgatggaatgaccgttagaagacgtcacagctcgaggcctgtgaggctgtgagttcctgtggttcattctggccaattgattacaactgattgttcttctattttggagtaccatggtgaatgatgcttgaaacttattggactgacattgaatgattctcgcagcatttcaatgccgtactttaaaatgtttatcagagaaaatggggcctcatgaccaccaaacttctgaaagaaagtgctatctgtacatatcttggcctccgttaatgttccctgtatgattcgtgccttaccttcaaggtatctaaaagtgtgataagctcgactaagatcaatcataatccatgtagggtcatctcgtcttcctttttgccgaaaccattcgaagcgtgctagtcaaatgcttttgcttttccgttgtctatgggtttaaagaatgatcgtagtttaaagcacctttacctgtacttttgacgcacaaatgaaaaagctactacagctaacttcaacacgaggtagtgctgatcatcttatccagcactgtagatgaaatattgaataccaaatgattatgaaaatcgttcaaattatgcttgtccatttttgtggaatactagtacatacaccagacatagtacaatacttcttcagacttcagagtatagtaacattagtatacttcagattatcataaacaataactcaaacgcaagtattgtgtcaacataattgatctttttaggttgattaattatactgaattactcggtgatcaatcgatcaacttaaatctttgcaaattcaagcgtcttcttgccctggagccggctggtgacgtagtgccggctgtactcgccgtggttgtacgtccggtacctgcgcggctccccgtcggcgacgagctccggcagcgggccgagctcgacgtcgtacgccggcgcgtagaaggtgacgacggacatgcggtcgtgctcgccgctggccaccgcccggtgctccacgctcttgtacctgccattggtgagcacctcgagcgtgtcgccgacgttgacgacgagggcgccggggacgggatggacggccacccagccgccgccgccccggagcacctgcagcccggcgaacgccgcgtcctgctggagcacggtgaccgcgctgccgtcggagtgcgggctcagccccagcaccagctccggccgcgggcacggcgggtagaagttcatcctcaccgcctgcaccgcctccccgaacatcccgttcagcctcgccggcgccagccccagcgccgccgcgatgtgctccagcagccgcacgcacagctccctgatctccaccgagtacttctccagcgtcttactgcactcgagatcgccattaaaacatgtttaaccctttgtcttattaaaaaaattaattaattattattttttttctattatttgatttagggttaaatatacttttattatacatataattttatatatttcacaaaagtttttaaataagatgaacggttaaatatgtttaattaaaaaagttaacggcattaaataaaacggatggagggagaagctgttacctaaagttggccggagttgtcggccagaggttggggcggcggatgaaggcgggctcgacgccgagggcgagcatgttgcaccagtcgagcttctggtcgtcggagaagacgaaggcgtggccgtagccctggatgccgccgggctccatggggtacttctccttctcctccagcggcagcatgaagaactccctcgccgccttctccatctcctccatcgtctcctcctccactccatggttcacaacctacaaccaattaaatcattcccaaacacaatctagctagctaattaatcaataaacttgtagtggtggaggtataatttttcgttttcctggttataatcttcagaaatataatcttaatttttttctgctatatcaatagaaattcgcacttcttgtgcaagtcgtttaaaaaaataaactcgtagtgttaattacctggaagaagccccactgctcgcaggcgagcctgaggttgtcgagctcgtcctcgctgccgcgctgcagctcgccgacgtcgatcaccggaatccgctcctgcgcgcgctcgtcgtcgacgacggcgtgatccggccggtcgtcgccgtccctgatgtaccgctccggcacggtggtggcggagcacagtcgtcgctgcagctcctgcacgtcatcaacctgaccgatcttgatgatctcactcgccttctccgcgcagacggcagcagcaccagaatccatgccaaaatttgcccagttctccaagaatctatgccctactccaaactcaccagttgatcagagtatcttggttgagtgtggtttatatatagtggctgccaggttcatcaccgccgtccattctgaattggtaactactgtaccaattagcgacagttcaaaattagttgcataatttctgtcttgtttggagatgactctgcgtcggacatccgatattccatcaaatatcggacgcatgatgtttgcgtgtcatcacaccacctgcgtatgcagcatgaccaaaaaaaaattggtccgtcaaatgttccagttgactaacgagtgaaatatcaagttatataggatgaaacaaaaaattagcaactaaaacatttaaaaagcttatgaaacatgatgaaaatacacgttgaaacatatcgctatcacatatgaaacaaccagtgttagtggattgaaacatatgtttttctttcatcaaaatataatcatacgatatcttgttataaagatttaattatgaagaatacagcggtgtgatcggattatagattagataagtaatttaagagaaaattcgttttgaatatcattaaaggtgcatgttatatggttggagatagagatacagacttggatatgtgcatatgtgttagagactgcccgtccgatttttcttggtggttcaagcattcgagaagaagcattttctgtcttgtttaggtgatcaacttgcgtttatcgattggtccactggcatggtggtgaaagggagatcgagaaatgcatggttgcacttgtattggagatcacttgcagtggcagagagcatagtgcatagctagctgcaaagctactgacactgtagcagttcttagtgcagtgttgtgtcacatgtgagctcaccggtcagcattctgtccgggatgtgtcggtgacacgtcaggcagatgacgtgtgggcccaagggggcaagattattgaggtccagaaacatccactgaagattcaggaatcagaggaaactgttgtcgctgaaacagctgcagcagcctactaggatcaggaattcgtcagaatcccagccggcgactgtgagattcatcgatgatcatgcagagatatgtgaatcatcaaattttgttttgcactttctgcttgtcaccctgaccggattcactgaccgattaatgcaaaaccattagtgcgctctaggcttttaattttagtctttgtaaagccttttgctttcgcctggttgctgcttttgacgacgctgctgcgccatgaatcgtggttttgtgacgcaaccgcaattatctccgatctctccatcgagtgacgagttggttcagaatcttcagatctttgtcaaactctgaccgatttcacatctctcactcttctctttctctcccctttttggagattgagatttagtttatgttatcgcctgataatcatggctagtcaggctagatgatggtggtgcacctttgaactttttttaacaataacttacattgaacaaagtaactataactcatttgattcacaattttgtgtattccattatcttaaatactaaaagattttgtctttagaagaagagtgtgttacatgggcttcatggagccccagaaaatcgaggttgcttggcccattcaggtcagtctgtttcatcttcttgtgggcttttctggtgaactcaattcaatgggcttttatatgggccattttgcttacaaacttacgacggtccaagtttcggcagctgcgaacaattcctttttattttgtcttcttcctcaattcgcaatcatagtttgtctctgcgcgcggcgagtggccactgctcgtcagtcatcatccagctatacaataattcatccatttttgttcggttttataaaaaaattgcaataattattcttctctttagcagctaccccttcatagattcaattttaaatttcaaaagacccacaaactcatctatgatcctgatcggagagttttaagattctgataagctagctggtaaaaatccgaagaaactgagagtatctgattgaaaatctatactgtttggggagcttctactagctaatctctagctgccagtagctcccaaagcataccctacatctgcattccctcgtgatctcagatttgctcgagatatgcaaaaacaccctaaaaagatggcctaattacgaattgggaggggtaaaatggcataatggtaattaataatgatagtgatagtagtacgacgccatctgtgatccatccataacccgttccgttccattcctgtctcctcgtgatctctacctctcgacggaatcgcgcgccgcgctctcgcgacgccgccgccgccgatcgatcgatggacgccgaggccggcgtcggcggcgccgaccagctgccggtacgcgccccccgcctccggccgctctgctccctccccccctcattgccctgtctctctgctctccttcacgcgcgctctctctctctgtgctggtgcggattgcgctttgggggggggggggggggggcggaggctggatcctaggtttggtaggttaagtggattacgagggatgattttgggggtgggattttgtggatttgagttatgtttcggatgggatcaagggtttcattgcgaggaatttcacccgcgattttttttaaaaaaaatcggcgttcgatggcgagggtttcgcttggaggaatcggtcgtcattgggtttgtttgtttgtttcgcttggtgaaatccttaggtcttcattttgttctggtcgtgtagagtggtttgatcgtgtaggtggtccagggattcgattatgatttcaaaaattgattcagaggggacgtacgatcacacctgctaagcagatagatttatcattcgtaatggaagatccccattggccactttgcggtagtccacatactactatagtcacatgatacaaaagcctgcaattcattgtaaatggaaaggactgtaacttgtcgggatgaagttatcgaattaaattgtagttttctttggttagatttattcgcagatataagttactatattaccatctgttatcggtaaattcagaaacatcagtatacacttaatgcctgtccctttccttaatgctatatactaaacggtaactctgcttgagtttgtgaacgtacaagtgttgataattttgattagtcatatgatgcttgcaagttttattaatatcagcctgttatatgtaaaccttagtacttgcatattcatggtattggtacgttctctttgatcatttttttggttatttgatgattgatcattatggtacttaagagtaactagcatgaaaattcatacttccaaggaaacatttcctgatggtagtttttttttccacatattttcagtggaggcaacactacaggaatttactgcttttagcataccagagttttggtgttgtttatggggacctaagcacatcacctctttacgtttataaaagtacattctcaggaagactacgtcgatatcaagatgagcaaacagtctttggtgttctttccttgatattttggaccttcacacttattcctttgctgaagtatgtcactattgtattaagtgctgatgacaatggtgaaggtacacagtacacactatttcttggaaatttggtataaacacacctgaccttacattatctatcatcttgatgaatcagcttacagtaaatatattatcaatctatttgctggagtatcacactaccaggcttcttcttgtctttttctttttacaaatttactctgtatctttgttcaacctgaagaaaaataagtaattcctgtcacttttgtaggtgggccgtttgctctttattcactgctttgcaggcatgcgaaacttagttttcttccaaatcaacaatcagcagatgaagagctatcgacatactacagaaatggttttacttcacgtcatggatctttaccttggctaagaaggttcatggagaagcacaagaatgccagaaccgtgcttctcctcatagttctgtgcggtgctagcatgatgattggtgatggtatccttactccagcaatctcaggtggatagtgccatctctctctgttagttcatgtaattcaaagttgttacatatcaacctctttgtatgttgatgtgctttgttctgcttgtttttccccctccagttctgtcatctatgtctggattgaaagttcgagctactggtttacatgatcgtaagtacaatatacctctaactcataactccttagtgcaacaattttagaacacatctaggctgttgagtgagtattgtcaatttcaaatttacagccctatgtaattacgttcgtaagtattaatcaatagaattattctttctctgaatgcattcaaaagtaggcacctctgttttgactgtaatttcatattattgtggattttttacttatgtgaacatctgaatgcacttgatttacttccctgagaatattagtttgtcatgtcaagatgcacctgcacagtatcttgcaaaatttaagttctgtagtgtctgcctgctactaccatgtattttgtagtgtctgcctgctactaccatgcacctgcacagtatcttgcaaaatttagtattttgtatttaccatgtcaaaggttggccagtataagtttctggctactatattttttttctggtgactatttctatatagtgagacttccatcctatttgcgtgataaacaatttcctttaggaattattgctattctacttttgggattaagtgtaataacttattttctgtacaggttctgttgtactcctttcatgcattgtgttggttggtctatttgcattgcaacaccgaggtactcagaaggtagcgttcatgtttgcaccaattgtcgtcatctggctcttttgcattggtggaattggtttatacaacataatacattggaacccaaggatataccaagctctctctccatattatattgttaagttctttaggacgacaggtaaagatggttggattgctctaggaggcatacttctttctatgacaggttggttactatttactccttactcttggggtataatctgtattcttgttgtactttactttggtaagtaaaatacttgttgggatttaaggttcattttctgtttcaattttacaggctgtgaagctatgtttgccgaccttggtcacttcacgagtgcatctgtcagggtgagttaacttatctgtctttagttgctcactttgtggagatatacttctaggtctgttaatatatgttatggtgtgatattgtgttgcctagtaaagcaaccatggaaacttagagaaagcaatttgagggaaaatataacggaagcaaaaagttaatgtactaaacagccttatctgaaaataaatttagttagcttgtgagttgtgactacatatttgaaaccaaccagaggctcaaaaggaatggaggaacctagtcattttctttgttgtggactaatgttgctcgtacaagttctctcatgtgacctatctggttcatttttattttgaagcctcctcctggattccatatagtattctttgctagtaattataatttatgtttactaaactttgcttgcttcttctgccagttttgctcattattttttttctattgctgaaatatatccatgttttgtccttgttacagctagcttttatcaccatcatatacccatgtcttatattacaatatatgggtcaggcggcatttctgtcaaaaaatatccttgacatgcccacaggtttttatgattctatcccaggtttgcactgtcacccctctctctcacatgcatgcatgcacacagatatgtaagtgtaatgttaattttaattgtcatccaggacctatattttggcctgtgtttgtggtggccactctcgctgctgttgttggtagccaagctgtcatttcagcaacattctctattgtgaagcagtgccattcgttgggatgtttccctcgagtgaaggttgtccacacatcaaggtggatctatggacagatatacattcctgaaataaattggatccttatggtgctctgtgtagctgtcacagttgcattccgtgatattacacttattggtaatgcctatggtaagcgcctgtaaccatgatttttcacgtgatcaagagctccttgcatatagccttttgtatatttccagtatactcaagtgctaagagtctaagcactgccattgccatggtttgtcattgcaggtgttgcgtgcatgactgttatgtttgtcactacattcttgatggcattgatcatgatcttcgtttggcaaaagaacataatatttgctctatctttctttttattattcggatccgttgaagttgtttatctctcctcatccctcatgaaggttactcagggaggatgggtgccgcttgtgcttgctttaatattcatgtctgtcatgtatatttggcactatgggacaaggaagaagtaccagtatgatcttcagaataaggtatcaatgagatatatcctgtccctgggtccaagccttgacgtagttcgtgtcccaggaattggtctgatttacacagaactggtgactggtgtacccaacatcttcacacatttcactactaatctccctgcctttcatgaagtcctagtctttctttgtgtcaagtcagtaccagtaccatatgtgtcgccagatgaacgataccttgtgggcaggattggacctagagcatatcggatgtaccgctgcattgttaggtatggttacaaagatgttcagagagatgatgacaattttgagaacatgttagttatgaacattgggaagttcattatgatggaagctgaggatgcatcttcttcagcaagttatgatactgctaatgaaggacgaatggccgtcataacaacatctgatgactatgactctccactagctgtgagagattccaatgacctagctgactccatgacgatgaggagcactaaatcagagagtcttcgaagcttgcaatcctcttatgagcaggaatcacctaatgtgagccggaggcgacgtgttcgctttgagctgccagaggaggatgacatggatcaacaggttaaagatgagctgttagcacttgtggaggcaaaacatacaggggtaacctacgtcatggggcatgtctatatcaaagctaggaagaactctagtttttttaagagatttgcaattgatgttggctactctttcctccggaagaactgcagaggtccatcggtcacactgcacattccacatattagtctgatagaagttggaatggcgtaccaagtgtagcgcgatgctcatcgcaggtcacgacgtcacgtggatacccggtagcaacaaatcatggtgagtactagccattaaaccatatgaacttacaattgttccagttttttgttcttgtaattatcatttggatatgcgccgcagctatatccctggaattggaagatattccagagagaacttggtgagcgaaagatctttttaagtatatgctgttctttagaggaaccaattaactttggcaacatcggatctatagcaatggaagttattatttttggttttatatcatttgataattgactaatcatcttcatttctccctctccagtgctacctgtggccgcctttttggagtcgaggctttgattcctatgctttatccatgcgttttcagtttcagttggtacagatgaagaggctctctatgttaatatgatcatttagctcaaataaagcatcagatctaatgatcgtagtttgctcttcccttttggtatatttacatgcatgctctgtaatttttatgggagctatgtaatggaaatatgcgtccccgtttttattgcagctatgtaatggaaatatgcgttctcgtagctgatatatcccaatttttgttaggaagcgattaccacatatattctttcatgtatgaatttcttatggaacagaacatctgtagatatacagtgcctcgtggaatttctctgcaaataaaccagatactagataacatcagtatgatttcctttttcatttggaactccacttttcctgagatcccttgggccgggatctttgtaacgcaaactggttttttttatctcgtgtgaaatgtgagattcatacattccaaacagcctgcaactcaaggggaagcaagatgaaaacagtgcttttattaagagaaaaatatctacacacaaccgaggcggctcaaagagctttgggaacccgaaagctaaaccttctgcaggctaaaaactctgccgatttgttacttatgtactttccagaggagctccatagccgtaggagggaaagacgcttcaggcagcagcagacgaagtagcagctgccactgtcttgttgagcagcacgcggagagcgtctgcagaggtcaccggagggctgcacttgaagtcctggcagacgtgcgccaccgctggcttctccggtgggctgctacgtgccatctgcgcgatgatggcgttgttgctctcccagaatcccatttcctcggtgttcctggggtctatttggatcacctagatcaacaaacagggtggccagatcagtaaaaacagtagagacgctacgtcgaatgtagaatttatgatcaactagttcatcgctcacagttctatttggatcatatgtcgaaaatgcggcagcaaccatgtcacggaattcagtcgattctttgttccccaccagaaccacctgcttcctggacgggacagatagcatgtctgccgcacaacacatcaacggcagtgctataccaagttccctcagcctcgtctggaagacagcctacgaaacaaaaaaatgtataacacgcatgagcaaatctcttgttcccagatgcttagctggaaacgttacttcttgttcgccaattgacatcagaggctaaccttgagcctcatgttggaactattttttatatataattaaatcagtcttgataataggcttaaatgtgtttacatgaaacagcaccatctggtgaacaattcccaaacagtaccattactttctatgaaagatcaattcaagattcagaaatcacaaggcactttttttttttttggaaaatggattaaaacccagcctctacatccaaatcggatgtacacagccacaatttgttttacattaatacaaagtgtaaacagttatgatatcaaagcacactacagatggatagagaaacatgaaataatcacataccaggagatgctcaacattgcatttgtaaccatcggattttgctgcatcaaatatactggacaatctgatcaagttgatagcagctactgagttaccagaaggctccgcaccatcataatcttctttaacacgcagaagaacagaagggtcttctccaggagtattgaaatagccaccaccttgtttgtccaagaacaattcatcctgcatatgtcaacaattatggcaaagaacaaagcaaattatgcaagatataaaatagaagtggcaaacaagtacaaattccttgcctgaatgacttgaaggtgagcagcccacataagccactctatcttaccaccatactcatagagatccagcaacccgtttattaggaaagcataatcatccaaaaaacctggtgcttttgctggcccatttcggtaactatgattcagcctgtttgagctgctatcatatagtttttcctttataaaacgtgctgccttttctgcaactccaagatattcctctggctgcaaaatatccacatacataagtggtgaaaactcaagaaataatttcagagcgatgggcaatggataaatatgatgatgcagaccaggtaaggaaaagatttatcgcacttaatgaggtagctaagatctggatatgaagccatatgaagcaacaaagagcgccacatgtgcagaaaagaatgttcaaatacaacattatgctactttcatcgtcacccaaggaacaacatcataggcaacatttccatttattattaaacagatcatgtatgggcatgcacatccaagagactgtttgaccaaggaaaactgccacagcaaatcatggaaaagattacaagagaacaaagtgaatgacaaattaatcaatcatgtgcattacaatgagaagcaatatctagagggtggagcagaaaactttacgttgcacccagtaattgggaaacaaaatctggttccagttggttctgatttcagaatttgggaagctcttgcaaaagcagatatagctagtccattccatgagacaataacctaaaatagactgtagttagtacattatgtgacaataaaaaaatggatgtgccagacatttaagcaagaaccttatcatccaaatgtggccttggcctttttgaccggacatcaaacaacttatgccgacaatcccccaggatttgagcatattcatcaacagacttgccacactttgatgccatcaaagaagcttgttttctttctattagcacatttttacccttgaactcatcgtgaggatcactcatccgcgaaaggtcgcaattgccagatgatttgacatagtaatgattcttgaatagctctgaattctccccaagtgtgtcttcaatctgtgtgaagaacataatgtacctatttaatgaaaagatgcatatctctagatctcaggcactataatgtaagtgtgtaaattcaatggaattattaatgtaactactaccaaacagatactatttatttttttaggagctattgtataaaactgagtagtatttacaaaattcgtttccttcaatgcttacatttggtatggaacaaaagaatcttcaggctataatggtactataaatcaagtggaactgggactgaagagtttaatatctatattagcaggatgtgatagcagtaaaactcaaatcaactgaacatagggttaagcctcacaaattagtctaagaagtttaaatcattaagcccaccttctatggactgggaagaggtatttatgtaacaaaatgttcacatgcactagtaagaatagttcatggatgatggacgtacctccttattagtccacacatagaaagctccctccctttttcttggagcaccatcatattctgcactatcagcatcttctgctgagtaaatttcaccttcttctccgatcatgtctctcctcaagtaatcaagtatatcacgtgcaactgaagaataatactcatctcccgtgatcagaaatgtatctagatatacattagctatctgtccttggtcgtacaacatcttctcaaaatgcgggactaaatacagagaggagatatgtgaggggaattccacaaagtggtatgacggaaaatttagccttgaacttaccatgccagcactcatccacactatatctatgaaagccacctccaacgtgatcatgaactccaccccttgccatacattgcaatgtatgagttatcatcttcattatattttgggattcactcacctgtccagattccaaatgcttccgaaatttatataacattacacaattctcaacaggtcttggaaactttggagcagagccatatccaccgaattttggatcataactgcctgctaactgcatagatatgagctgagaatctgtaagcgcacatatatctgatgaataatgatgctagtaagaaaataatgaaaaagtaagttgtgcaacccaaggttttcaggctctctataagcttcattccataagcagtgtttttcacaaaaaaaaaaggtcacaactacaacatagttggctgcttacatatactaattgaccagaacaaaatccttgtatgctgatattcaattctaattcagaagtgtatcaatgcaatatgtcaaaaaagagtgtaccagtacagggaaaaacaatgttgatagactactcaataataacataagaataaagacatacaaatatgtaccatcagccatcgcatgttcaaacataaacacctgcaattgaagaccttatattatttttatccctatttttgaacctcgtctacatcaggcacatttgtagaagttcagacaacagagcaaagtccattttgtgacagcacttttgaaaagttcatcttgcttaaccacatatgaacctaagatactgatttgatctaaccaagcttccggagcatacaagtataggatgtttgtatcactaaactgtgacgcaaatcttacaaggctaggattcatcatcctaaaaaaataaataatctagctactgcaatactgttacaccattaaagaaatcaatttggtcagtcagtttcaagtagaccatgccagagtttataaatatgatagcgtggatatatatggagtatttctcgaaccttttcaacacaattatccacagaaacaacagccagatcatttggcatatcttgagagctagctttagcagataatgcatctcgcagttgtttgatgaccacatttcctgtcttctcaagcgcatcgcgtttagtttcccaggcctccttaaccttcctaaagaaggcaagtgtaggcgtgtcaaattacacagaagctaagcacttacagtaaccaagtccagaattagtaaacttcagctgataccttaaaatagtcttgaatcctgttcttccgtacttatcatctggaggaaagtatgtaccacccatcaacggtttcaaattaggagacaaaaagacactcaaaggccaaccaccaccgccatacagtgctgatacatatgtcatgtacacctaaacgatgatataccatgattaataaagaacaaagtataacacttaaggaaacagaaacacaagggacccttttagtctgaagatacaaaataagaaaaaaaacaactcagcttgggacacttaggaagattaccttgtcaacatctggtcgctcttcacggtccacctgtcaaaactaataatcagaaggaaagcaatacagttacattgattctttttgaagcatcattacattgcatttacatatattttcacacagtgaaggcatgtattattttttttcgccaggagtgaaggcatgtaaaatgatatgactataaaaatgctactggaacacttcaattaatatcagaatagccgtaccttgatgctaacaaacccatcatttagaatctttgcgatttcatcattctcaaaagactccacttccatcacatggcacctttgaaattcaaccaaaaataatagtaaccaatactgatgttaaacatgaagtgtaagatgcagaagagagtcacatatcacacataatacgaatatacatgatattaataaaagcaaaaggagatactaaaggcaactcaccaatggcatgtgctatagccaacttcacgggcacatcaacatttgccatgaagcaaaataagcggttagaatacaagaagggagaaaataaatatggaaagggtgaatttgaatgaatttttagcttagattccacttgaaaacagttcaagttacaatgattgtaaccatactttaccacggcacactattgtattattatatttgagagaatgcactgttcctattgttgttttagacacttcatacttgatagaaagatgggaacgtcctttctgcgagccttctcgaaagcctcttctccccaaggataccaatcgacctgcattaagtaaacaagtatgtcactaatctagtttcttctataaaatttttaaaaaaaacaatcaaacaattttctcggttagcttcttacatgtctaagaattagataatttttttaaaaaaaaatcgctttatctccataaccatagggtcatcgtcgactacgtgatactcaaattaattcgaggaaaagctcccacaagtggtgtgctcagtgattctctacaaattacaaattacgagatgcctcccaaagcggcggaagagccgatcaaatcccctcattctcaactcaaagagagcgcaaggtgctcgacaaaatcccgcagagaggaggcaaagacggcgtaaacgtaaatacgtaatccgcccccgcggagactcactcaactcaccgggttgtacgcgtgctgcagcaggtaggggctgtgctcggcggcgaggcggttcgggctccgccccacgccgtgccgctcccctgacgacgaggaggaggacgcgccgcccgacgacgacatggcggcggaggaggcggcggcgaggcggcggcggcggtggtggcggcggaggaggcgaagcgtggagagcataggaggaggagggcggcggcgacgaagcggttggggaaggttggagaagaggagggcgaaagcggcggaggccgccatgtggcctcggcttctggacgacacctgcctgcctccgctgcacccgcgtccacgcacgcacgcccaggtcgttgtgacgctggctctcactgcctgctgggtcccactcccaggagaaaggaaaggataacattgttaagactaataaaattttaaaaagaatatagtaattttttcaatataaaatcaaatatattcaatgttatagaaaaatatttacaaataggttctcgcttaaaaatatttagtgactgaggatctatttgtaaatatgtttttacagataggtctcctttttttacaaatggatccttggtgctaatgttcatattagcgacttagctttcaccggcagacgagggagatggcgccaatgttattggcattgtcatgttagaccatggcgccacgaaaaaggttcattccgaaaataaacttttctaaagatctatttgtagaattattttttttaaaagcactgaaagttgaaaaatccagctccaatctctcactgctaaaaactaaccgaccaatgtctgatttaattattagttgataataaaaaaatataataatataggaaagttgtaatgctagatttaacaagatgcttgtattgatagctaattattttttttagtggtaggcgacataacatcgacagcggggtatctgtagtgacttcgtcgaaccgaagatatatcgagcccttatttcaaaatagtacccataggtgtgtgtatgtgtttatatggtgagtgtacacacgttgtaagcgtccgtccatgatgacttcattaaactcaagatatgtcggcccttatttcgaagatactaataaaggtagggtgtgtaagtttattgagcccttatttcgaagatacttataaaggtagggtgtgtaagtttattgaggcgagtatgcgtgcgttacgagcatatgcgtttataccgtgtttttttaaaaaataattagaatatttaaagagaaagtggtggttaatgaagcttaaacatgccgccgtgtcgatgcattcgctcgtgcatcttcaagcggccctcgaagcgccacaaagcccacgtagaaatggagaattaccaaaatgcccccttcgtcttccatctctcgattctctctcacaccttcctcctcctccatctccctctccgtttgactctccctgatccgcggagctctcgagcgcccgccgccggcgagcggggtgcagcgccgcgcgggcgacctcctccttccacctgcctccatcatcgctgcttgaatcgatccgaaggtattcgttcttctcccgtactccatcgtctaccacttccgggccagttttgagtagatagatactttgtactagattggtaatccgttcggatttggaactatccattttcttccggattccttcgatgcgtggtcggatggaaattgagtccacaaggggcagtttcatttcaaaacaagaggaattcggggttcagttcaatctccgcgacactagtttggcccctggtagtggtaggcgacagtgtaagatgatagtatccgtttatggggatttagggaactattatcaaatatcgttcctagtgtttttgtgtgagactgtcgcactgtatctctctctccattcgttacatctactgatgcaaagttaaataggagtataattgtgatgcaagtctgcaatcctgaaattttgatccctctgtttgtgatgcttgatacagcattgtaaatggctgctgggaggggcatcagtcagcttttgaagaaagcatttcgtccatctgtaagtactgtgagaacttcggttcccccctattcttgtacatggttcttttgctaaaaattataaatttattccacgtcctttctactactgcctctgttttagatttcaagtttgatcaagtttgtagacatatatactaatattacaatatcaaattagttttattaagtctataattgaatatttttcataatatatttgtcttgtgttgaatatcttactacttttttcctacaaacttggtcaaacttaaagcaataatcaaaatgacttataatctgaaacggaggaagtattgtatttgtgttattatcaatcaaagaatctccatcctactcgtccagacatttggattactgttatcttggtagttctagatttttccttgtaggtactttgtttggagtaaagcagctgccttctgttttagcctagttgtgttgtatagactataatgtgggctcaccaggggatgagaaagttggtgtcatgatggcagataagggcagcaggccagcagggttagggatactgtgtagttttaagggtgcgttcgggtttcagggatgggaattaatccctcccgcacggaaaacggagcgatccattagtgtgtgattaattaagtattagctttttttttcaaaaatggattaatttgatttttttaagcaactttcatatagaaactttttgcaaaaaacgcaccgtttagcagtttgaaaagcgtgcggcggaaaacgagggagaggggttgggaaaaggggcatccgaacacacccttaaacagtcaggcaaaagggcaatgcttctccaatcggtagaagaaagggaaaaaaccccacaacagctggagttatccccgtgcttggaagtaaaacaaggaaatgaaatagtgatagaaaacaaaaaggggtcaactgtcaggctctaacttaacaagaaactcctaatttatctcctacaactcttttataccatttgctttgctttgtgtcggttcctctaataggaatccacaacacctaaatgcaattgttgaatgaatggctgactcattaatactgcggcaactgaacaataatggtttaacttaattgactatttatttaagttaattcgctattgttatttgaaaccataaactttgcagagctcatctccgctctcttcatcctggataaatcatgaagagtcctctggcttcactggattgagagcattggctattctgggagttggtgcttctggccttttaagttttgctacaattgcatctgctgatgaagcggagcatgggttggaagccccacactatccctggccacatgctggcatccttagctcatatgatcatgcatcgtaagtttatcgaatagacttatttttgttaaatagcttgttctgactagagactacttgacttcatttcaagaagcaatcgtgcatctaatatataatgattaactagaaaaacatactccccccatcatgtggtacaacataaaagaaacatcagtgtactatgctgtttgttattttagagataagcaaatgttgcagtgtcaatgttactgttatatgcccatgctgctgaggtagtcttttgagctgttcttttttcatatttttatcttttctttcacctctttatttatttattttaaaaacatatgagcagaataaggcgtggccatcaagtttatacacaagtgtgtgcctcttgtcactcaatgtccttgatttcataccgagatttggttggtgtggcctatacagaagaggaaacaaaagcaatggctgctgagattgaagtggttgacggtcctaatgatgaaggtgaaatgttcacacgtccaggtaagctgagcgaccgtttcccacaaccctacgcaaatgagcaagcagctcgattttcaaatggcggggcataccccccggatctcagtctaatcacaaaggtgagactcacaaattgctgtcagtcacatgtggtgcaatttctcatctctagattgtatctaactctttgttttttacatattttcaggccaggcacaatggccagaactatgtttttgctcttctcactggttatcgtgatccacctgctggtgtttcggtaaccctctctcatacatattgttttgttattttagtgttggtcgctacttgtaggtttcacatatgattctctgagtatctgatttgttagatttgtagggagtggagataatttggtgtgtgctctatggttttgtaacagtttatatcaatggatgcattgggcagaccatgccacacattttttactggactacgagtccttgacaatgcaatatgtgcattcattgcttaagctacatctctatccatcatgcactatcttttttcatggtgatgaatacggtgtttcctgttctagtttagcgttcatgtttttcaaggtttctgtcctttcttgaattaatgcaacatgttatacttttttctttgttggtgctgttgaaaattccctctaggcatagttaccggctttccagatcctttcagagctttgtttttccttttagttctttctcttttactccctctattacaaaatataaggcacaactacttttcttagatgtttcataatataaggcgtgcatgcatgcatgcaattaactagcacctcttctccactaaattattattattttaactctttaattattaaaatctctaattctattgggtgtatgcattatatttattaggatgattcaaacaatgaggtgataataattgtttcttggtctttgggttaagggtgattatgccttatattttggaatggatggagtataaggttagttggaatgacgaacaccgcatagataggcattataccagcatgtaatatacaaaataccctttcttaattggttatgtactgtgtgtgcaaaaacttgtgttcttggtttgttttttttgaacaacgttttcaccaattttgttctactccgcttgaaattttggtcagtaatacatggaatcttggagtgtattgtgccactttctggtcaggaaacctggattatttcatagaacttgaaaggatctagcagcttgcaaatagtactgttgaatattctaatactgaattaaggatttaccagcttgcaaacatttccagtgaaacacatttttcgctcttggttgagattgcctgctaaagtgcttctgttattgttactcctcctagtgcactccctaaatttgcttttgcagtgtcctaaccttctggcgttgatttgaaatttagattcgtgaaggcttgcattacaatccctacttccctggtggtgccatagccatgcccaagatgcttattgatggagcagtcgagtatgaagatggcactccagctacagaagcccaggtagctcctgtttttgagttgtctgcactctgcaccgtttagttaagctgtggtttatcactgaagtattagactattttcatatgtaaattgtagatgggaaaagatgttgtctcgttcttgtcatgggcggcggagcctgagatggaagagagaaaactggtaaccctcttggaacctccctgtagaattgtcctctatttctactgttaattgtctaatttcttcatactggaattgtgctagatgggagtgaaatggatttttctactctccctcgcacttctgcaagctgcatattaccggcgcatgaagtggtccgtctacaagtcgcgcaagctggtccttgatgtggttaattgaggactagttcttcattttcttcaaagcatcggctgataatttgaagtattggaataatgcgtacatgaatcatgatgtacattttgccgttggcatggttaacatgcacaatactcttttcctttgttacatttactcccagctgtgctgggcattattttaaaattttggcctgtcaaatgtaccagcaagcatctaacagtatagtcaaatagatctcataagcatatttatactccgaaccagtgtaatgttaattttagtcatcagtatgagatgatggagaaaaaaaatgaagtgtcactaacactactgtatttctgcctccctgctccattttgttgttatggatcatttgattggcaatttgtggatgcatgggaagaggatcctcttatttatttttctctgactttgagtcactaacatatgaattcactgggtagagggcctatatgtcagtagcccacatcgtgttagagaaaagtaagtttgatgatctcactccgtatgcatgttgcatgctgatgaaaaagaaccaaactttaatcatcttgtggtcagattaaattgcacatccaaacacaattttacttacacacatcgttcttgccaatttgccatgcatggctacaaatatcaggcatgcatgcaaatttaattctgccaacctccctgtcgattacgaagttcaggacgtgaagagctggctaccgagcgtgacaatggcggtgccgtcgcccatgacggtggtgaggctcatctccttctccagaatccggtcgagctccgccgcgatcagccgcatcttcggccgccgtctcgccgacgtgctgacgcactgcaacgtcagcccgaccagctccttcatcccctccgacgtgaagctgcctcccaaccttggatccgtcacctcgttgttcgaactgaaatgtgactccatctgacaaaatttcacaagaaaaaaatgaatctctgtttctggatgaaatttacttggaagattgtacattaattaatatttggatgaatcatactgaataaatgaattgctaaaagaaatgctgaatatatgcattacccaatgaaccagaggttctcttggttctgaagaaatcaggctcgctgcttctttgccagtgatgagctccaaaagaaaaaccccaaagctgtacacgtcgctgctttcagaaagctgcgccaaggaatgcaccctgagagaaaaaaatagcccatcaaaatataaatgatggtaagacaaaaatattggtgaattacagaaagcagtgctaacatttttacagctctgcacaatgtagttgcagctcatacttctgataatttcagaggcaaaagttcagttaaaacggcacaatgttcaggcttactctgggtcttggtagatgctgctgcaagacgacgacggatgatgcgacggcgcggcgccgtcgaatcctctgagcagcctgtcgattccggcgtcagccaccttcgcgatgaagttctcatcgaccaaaacattgctcgtcttgaagcccttgtggatcaaaggaggcacgaggctgtgcagatgattcagacctgaaaattttcatagtttcagacactgtgttgtacactttggtttgatgaggaaacactgcacatgaaaattgaaatgttttgtcacctttggccgctccaattgctattgagagcctctgcttgaactctagtcttgtcattgactctttgccggtgtttgctaaacagtgtaagatcattattgtttgaaacaaatttcaagcaaattgggcttcgaatttgacaggaatcatcaactttgttatattaccgtacagatggccacagacactgccattgggcaggtactcgaacaccagcatttgtagacctccttcttggcagtagccgatgagagtgacaacgtttctatgccagatttctgatagccgcttgacctgaaattcagagcgaattcatttttctttgtcaaaaaatgagagtgaattcactcggttacaaatttttacaattatcatacaatcagagaggctatttctaagaataataaagaaaagttacagaggcattcactggcttgtctgtgatcaacaactcaatgcaactaataaaatggaatgtgacactgacaagtgacaacaattaaggagcaattttcaggaacaagtgtactgattaccaactgaaaatgtcaatgagattatgactcatatgacgcaatgcagtgatgacgtgacgtcagcacaagtatatgatttttgatgaggcagagtttgcgtgtacctcgtcgacgaagtcctggcgcggcgaggcgacgcggcgcttgacggcgacgacggtgccgtcgagcaggaggcccttgtagaccgggccgaagctgccggcgccgacgaggttggcgtcgctgaagttcttggtggcgtgcgcgagctcctccagcgagaattgcctcgccccctggtactccggcgccgacaacgtccgcccacacctgccccactccactgcccaatcatcaccaagctaataatcagctacagatcgatcgatgctgctgcgaataattaaatttggagaccaaactcgatgtgatcaagttgtgattattgctatatatggacgtatacctagtgtaggaggggtctccgacgagccggtgtcggagttccggcggctacgacgcgccacgcgccaccaccacgccgcggccacggcggcggccaccagcagcgtggcgacggcggcggcaatgccggctaccaccgcggttggcaatgccatgatccgggcgaccggggcatcgaccaccctcgatgatacgatcaagaaccgctatagcttcggcattcatcaatgcagaagcgaactttgcttacctctgccaatgaagaagacgactgatgatgacgacgagcgccagcagcagcagcagcaatgtcgtaggattcttagctaggtagcagctagctagctgagctcgtcgtcgcgagcctgcagaattggccggcgaggctggctgtgctctttaaagaatccgtcaaccaccatgaacgagcagcagcagcagcagcagcagcgcaggtgggtgtatgaatgaatgcaaagcccccccaaccccacatggcaattgggcgccttcttgcgccatgcccccccatgtgtccatgagtctgcaaatcaccacggccacaacggtaaaatcaaatcaattggtaagtaagtttctgcatttgcctgaagatttacttaaaccaaatgcaagtgttagtgtgccagttctccaaggtagcttaggatggactgaattccatgcaaattttgcatgaaaaagttcagagcttaccgaaatgtgtcaaaatggcaggagagcatcggacaggtaggacctagtg

SEQ ID NO: 3309 - DNA, 20310 bp, Oryza sativa
  unsure (1)..(20310): unsure at all n locations
ggttcagtttctagttttcagaataattgtctgtctgtacatatcatgttttggatatggcctatgcatgctcgaggttagttcagtttcattttatgctggcaagtggtagcaagttgttattcccaaatatttatcctcgcttaaactactgcaatttggtcatgtcataacaagaaacaagtatgttcagttgatcgatctggttagaaaactatatgcatgaaaacgtttgatacaaaggcacatgctgacctcaatcaaagaggtctcgagaaaaactgatgtaaccaatacgacatcaaaaacattgggttcatttagggtcttaaagaattgagcaggcataatgtggtggctaccactgggaaataaagattgaagatcatgtctaaaatgaggacgacctttacaggcatttcagatgggatttggtaggtttgaaactacagagttctatattcgaccaaaagtatttccatcgaattgaactctgaacagttcatgctaatcttgataggtcagaatttggtcactttttttctgcagcaaattctcgtgctgtttcgagttcagattttttcagaaagcattttattttcagagtacattaaagcaagacttacctaacagacacttgctacgtttagttgatggaagaatctaaatgatttaggcgacaatgtgcaatacaactctttgcaggctagcagaatgcaagttgttttatattttaaaccaatgcgagttgtaacaagtaatagggggtccagtcagatactccctgagatccaaatctgaatccaatatattatcagatttgctcgctcgtacgtacacattacagatagaaaattgcaggacatctgaacatttgtttagttccaaatctatctatagtaaattaagatttcattctgcaggcgtacgtttatctgaatgcaattacaaaataatgcagttacctggatcatcagactgactaattctcagagttgatttacacatacctcattaatttcggttcttccactgtcgactgaagtaaaaactgcaaatcaaacagcaagctgacatcagtatcgttaattctactcactttatccaaaaaagtattgttaattctagtctaagtggccaagtacagacattcaagtgatccggttcatccatggattaaagtcaattttgagttttccaacaccaactagaccttaaccagtcttagtagcatataatactggttccatataattatatgcttacatgaacactcggctgcaatgaacctggactgttcatggagattatctcagatgcaaagttcaattgatttccagatactaacatatatcgatataaacatcttcagtgtgcctaagtgaccagccaaaagcaaagaaaacaaaagattaaagaagaggagcacatgcaccatgtccttctgcagatgagaatccaatgactgccacaaaaaaaaaatactcattgcaacaggccaacttccagcctgtcttgtgcaaaattctagataacttcttaccagatccatataaactatatagtcccaagtattgccatctatatcaagtatcataatacctaaactacaagtatataggaatccgaaactagataactgaaagcctgcataaggagctttaatggcaggtgtacttcatttcaagtgttaaaactgtagtgtatgttaccatcggattctactaatgattctttcatgttgaagtcagcttcctgtataatatggtgaacccagagactgtaaaaggatcagtaggctggcttactcctgctgtactgctggatcttgaaaaaagattaacatcaagataaaaactgtaattcttgaaagttgcatctgcaatagtgtgctggtaagctggttttctaacctagaaaagcaccagtgaagctagccaggttttcaaacggactggagcaataaaactgaaaagtatctatagtcctatagggctgtaatgcatttattgcacaaatttcctgaacaccaaatgttgccatggattcaggaccaaacaacattaatgcagcagctccccttgtcaagcaggagaagagagaaaaggacagatggacagaccacccagcatgccagcaaaggtgagcagtcaagaaaaccacagccgtgttgcctactctcggtgcaaaatatagcaactactcgattagacatcacctagtactatgaatctgaacagaccttaattcgtagtgctaggtggcaagtggtgtctaatcgagtattaagtcactatattatgggacgggtggagtacatttcttttgcaggcgccagcccattcaccacatggtttgcactgcagcaggccaatggtccatagatatgaacgctgaaatcctgatccctgcagctcacaagatctgaaaaacaaacaacaagaagaagaaaaaagaatcaaaaatcagaaatgtaatagtaacaaatataccaaaatctccagtctgattcctgttcttcagttagtgcctcatctgaacttatagtattccaacagccattgatatacaatctggtacaccagacagacaacacatgccttgcttcatcccaagttgccggagaggtttaaattacgggacactatgatcatagagtatactgctgaccacagctttgctgggacactggtatctgctgtctacatccatgtctgaacattgtatatgcatacgcctgtacctagtcagctgctggtcgtcgaaacttgagtgcatattgcgtctcagctggggcctgggagatcagcatgagattttgtgttgcagaggacagtacttggatctacaatgtacgagtacagtacgattgtatgatgggcagtacattggcctaactcagcagcatgaactggcctgtgctatatcaatactggatcaatgtggtctagttgcacggatttcataacagatagtatcatttttaggatgaagacagttgatgctttcaacagccaaaacaatagtgcaacacccaacttcgacagtgtttaatcatgtcagtggtacacaagagcagagaaaattgcaactggaatgatttcacaaggcaagagcaattaactccctagtggtggaatagactaacagtagctcatatattactgcaaaacacgacaactgggagcgattccagaagacgagaaattaacagaactcaaggttgatatataccattattacaaaatcaggagactttttcaatctaaggttttagggacaaactgatcgttgcttgaagaaatacattgtttggtgccttagttggccttaaatcagttcagccaaaatcagaaaaagatagcaagttggaactgcagaacagaggaaaccagcagcaggcatttgtccatcttgattattttcagtgtacagatgggtgcctaacacgtctctcaagaaactaccatgaacttaaaataaatcgaagtagacaactgtttccttggccatgattatcaggagaatcttgaagtatatgaaaacccacttcctggtgatatcgtgatggacatagtccagaaggatctccttgtagaacatgtagacttgatggaatactgatgcgaccagaagagacgtactgatgctgttctttgatacaagaagcagagttgggatcatgtaatacgtagatcgtgttagtagctctgtctgcttcactttccagctttcagatgtcaatggaccttttctgggtttggcgatgcttgcttctaatgggctgaatgccattacctttctggtggctccctcctgtgtattcagcgcatcagattgtgtcacccagtaattgtcttatgtgatgtcagtgagatagtaagaaatatctagcattgactggtggggagtgaaaacaatccaataaatgcagaagcctatataatatgcactagggatagatacgcacctgctgagcagaagatccatttgatgttccagtagaaaaccaacgaggcaatacttgtgtaccactgagtcgagatgtctgttcatatcctggaatctgtttgcatatgataacattagaaaagtcccttacaagttcttaggaacacaataaactcatgcattgaactaggggaaaatgagaacagaagtattcaagttacatacgaacagcaatttttcattacaaattcacaatgtgattctcttaaagatgtcattatcagaagacaataagcactgaatggatggcgccaaataaaattagctattcccacaaggaaagatcatcttgcataatcatcagtactaaattatcagcaggtgctacccaccacaatgaaccacttaagcatggtatcaaattgcaaatatcttcagataccagtgagaggacataacattttccaacaacaactagtgcagatagtgatgagattaaccaagggatttttttgtgtcaaggaactattctattttcagatttattagctacattccaagtcattggctcatcaacagcaattgaagccaaacaaaacaatcatgaaggccaagaaaaaactaccaaaactaactggagtgatatgcaaagattaaaaataaagacttaggttaatacacaagaggtgagcagatacatgactccacccttccctcactcgataatcgtactaacagtttgcccaatttttcatcccagaattcaacgagcctggtaacgcgatgaatcagaacaaaaggtaaataccattttaccatatgttgctatgaacttagcgggtggtgaagcaggagaatggcctacttgctgctacagtcccaggttcccaactgattcccttcgccattttcccacgacatcctatctcccccaaacctagattataactaaaagcatgaccagaactactagtagactatcaatctaagcacaacacaacagaaccaaacaataaaaatgcaattaagaaaaaaaaaacattacagatcgcgcgtggactagggcatctcgcttacaaacccatcaccccaaacaagccacacacactgatccgatccaaacagctagttcagctcgcaaaatccatacgcctagagagagacgaagcgagggaagaagaggtcaaccttggagaggccgagaggggaccccacggcgggttggcgcggcgcgggggcgggggaggcggcggcggccggatcgcgggggagggaggacagcgtgcggagccactgcactccggcggcgggccccggcgccgccgcgtcggcgcgggacagggcgagcgctagggctttggatcgggcgaggaggcgcgacgccattcttccccccttctctctctctctctctctctctctcttcacgggcagagtaaggaaggtagtagagggggagagagctagtagaagacaatagggtacacgtcatcgtacatgggccgcattggtagccataagcctggcccatataggtagcacgaatactagcccatacatggaactggaccaaaggcccatgataatcaggcccaagaaaaagatgagctatcctaaacggttttgctatttcacttgcaacagatttttggacttctattttttgatttttcgtccgtggaatctttgcatcaagatttgtgttctttagatttgatttatatttatacttagttacactgttacagtgcaccaaaattagatttttattaagtttacgattttttacatgtttattcttttttttatttcattcaaaaagggttgtatacattgttgaaaattctgtaagatttgaaacttcaaacctgttgaaagatcaatagtagtcccttctgaaatatggaataaccaaaattcttctctttaatttcttcatttagaagtagagatcgaataatatcaatcatttgtttacctgcataaatttaacaagggtcaattcaacacgatcatcacacagtacctgattaattagtggaagataattagaaaggcagatagggcggttacaacctgcttaattaattaattactactcctttagtaggcttatatattctcccgacatgtaaagggtaccagaggattcgtttattctttgagtggatgcttggcgtttgaaattcattgcttaacactaaccctgccgatttattccggcattgacgtggaaattcctggttctgttatgcggacacgtagaaaatataaagtgggatattaaacaaaaggattttggtccaatgtcatccaaaaatgaaaaatgtgcttcatgatatgtctacccccagagggcattattcgtcctgttaaaatggtaaaaacaagcaattagggcggatccaaaccttatcggcatctctaggttaatttagtatacattactgtacggtatgataaagttcagctcaaattgcaggcaactaattatccgatagagtcgattaattaagctcaaatgtgttgtaaaataatttatagattgtccagcaaatattagtgtttaatttggttcgcgcatctgctcttagctagttgtgcattttttttttatatttgctactctatatatagatcaatttgccttattatcctcattttaaaattcagaaacgtttagaagtcttccggctagttccacaagaagatgggctagttggtctgggttcgaagccttatccttataattatttgatattaaatcatttcctaatattcgtgttttgttttaggagaatggaatggagcgctgtgaattttgcaataacattagcatgtgcatttcccgagtttataaacagtacaatttttaaaaaaacaaaattatatttaaacatattataatgttgttttaaatccacttttaactttttataatagctaatttatttatctgtaccatcgaataattatcacaaagtcatccatctattcagcatttcattctattcatcacaaaaacataaatatatattttgatcatagtaaaacctcaatttgcatggcatacccccatttcaatcaaataaataattcaacttttataatgctgtcccctccggccaaaagcaaagctagagaaaaaaatccaagtactaaacctctaataagcgcacaacattcccaatcagtgccagaggctgtttattagagtttcaacttctaaatttagcttcagtagttagatctatagtagagttgtggagcggcctaaacccaactccaactctctagttcagtttgtgagagagccccatccaactccactcttattttagatggagataaaactgtttagctggagaggtggagctgaagttaaagctgtgccaacgagcccttaattagttattatctcttcttcttccttggttcagtttcccgtcacctataaataagcatcgcgccttctctcatcatcaccatcacaaccaaaactactcaaagaattttcgaaagtctccatagatctagctcgatcgagctagagtgaagcgaagtgagagctagaggttggcaatggcggagagggtggcgcggctgtcgtcgcagagggcggtggtgatcttcggggcgagcaactgcttcatgtgccacgtggtgaagacgctcttctcggagctcggggtgagctgggcggtgcacgaggtggacaaggaccccaacggcaaggacgtcgagagggcgctcgccggaatggtcggccggacgccgccggtgccggccgtcttcatcggcggcaagctcgtcgggcccaccgaccaggtcatgtcgctccacctcgccggcaagctcgtcccgctcctccgcgaagccggcgccctctggctcagagatacgaagtactcctatatactaccagctaatcaattaattaactatcgatcaattaattaatggcgataactagctcttactactgttaattctgctacatgcaatatgcatgtcatcaatcttcactgatggtcgtatgcacaatgcatcagtactgcaggcaattaactaattttggggagatcatctgtcagattaattagcatacatgcatatgatcttcagttgtacctctacctacgtacatatgtatggaagatagtgctttgcaagtgatgagtatgtgttcagctggtcagaaagatcagattagttaattaattagctagtgtactacttaattatcatgaagagctgaaggcattagctttgatcctttgctttaggctttaattaggtgccattaattcaaagtagtctgaccagagaaagggttaacttaaactactcctatatgtcagtgctagctgcaaaagtacaaatatgtcggctaatgcctttcagttttcaaaagtagccgctagatttaatgaagggtttagtagctcaatgtgtgtcccatgaagccatgatgcaaattacgcagtgcgcaccatatatactgatccagtgatcctttgccctgcatttacgaaggcaaagtcctgaaaacaacagtgtcaaattttgttagatttgttgtcggagtcgatctgagacgtttgaaacaaattctcacgacatgttatagtacctgcaaaaaaaagttactactaggtaattctcagagtcaagttgggccaaattagctctctattttgtcatactttatagtgtatctttgagaattattgaggtgtctaatatattaacgtgtgtaaggtttttgtgcgttttttttaaaaaaaatattgaagtgctgaatacctgatgatatatagcgcaagtcacagtgcactataatataaggctatgacttgttactaaatctacaattttatgatactctacattaaatttgtaatttttttgagaaatttaagatatcatccgtttctaaatatttaacgctgttgacttttttaaatatgtttgaccgttcgtcttattcaaaaaatttaagtaattattaattcttttcctatcattcgattcattgttaaatatacttatttgtatacatatagttttacatatttcacaaaagtttttgaataagacgaacggtaaaacatgtgctaaaacgtcaacggtgtcaaatatttagaaacggagggagtattgtattacataccggtctcacttttcgtttacatgcagctagaggggtagaacatattcgtgagagtaatcctttattcacaaatcgtggcgcatcgacttggtgaaaagatatacttcattcgtttcataatgtaagtcattttagcatttttcacattcgtattgatgctaatgaatctaagacatatatacctatctagatttattagcatcaatataaatgtgagaaatgctagaatgacttacattgtgaaacggagggagtacatagcgagatcgagatacgagagagatatattcttggaatccaacacagtagtagatgcaagttgatgtgtgactcgatccttggtgttgcagacacatagaatcctatatagtgtactatagtaatttactagctttgttcgtagcgattccaattagcactcggcgtaacgtgttgcacgtgtgtatttatatatatacccgcgtgctgcacgtacgtacaccctcggttcaaaaaattcgaatcttagcaaaatataaacatgaataagtactacagtgcatgcctatattcatatatatgaattaatttttgagtaaatttcataaaactatatatactttaaccaaattatcacaaaactacatatttaatattaaattttgcacataactacatatttaagatagagtatcgtaaaacttcaaatttagtaacaaagtaatcacaaaactataaatttagtgttaatttaatcacaaaacttagatgtttataactcaaacataacactagtgctaagaatttaaactcaaaaatctataggtttgtgataactttgttattaaatatgtagttttgctatacttcgtcttaaatatataattgtgtgataaatttagtgttaaatctatagtttcataaaacatcaccttaaaattttagttttacgataatttagctaaaataactgtagttttgtaaatatactcattttttttaaaaaaggagagagtatggatgatgccaaccaggatgtgtttgaagataaggattattgagaaccctttcttccgatacgtaaaatggagcgtcggattaacacatgaataattaagtatcactaataatacttaaaaaaactaatatgaacttttaaagcaacttgcctataaattttttagaaaataaaacatttaagaattagagaagcatgcgcacataaaaccatggggaaattggaaagagggagtatagcacatgattaatcgatgctcttgcgttgtgtcgtcgggttgctgatggacgacaacaccgagacgccggtcggtggccacgtgagaatgagagagccctgcccgttttatcaggcccagaacatctcgggctgtcacgtacgtagatgggccaagattttcgatggactgggccatccgagatcggacgccgcaccgcacggtccaacccaaagaggcccagtgcagtggcacgcacaagcttatcggtattatctctccccgtgaggcatcattaaccgcctgaccaatcacaatcggcataatactgtgacgctctgatacagaccgcgtactacgccccaaaataatttaattttatccatcctatactaatataaactactacatctgtctcaaaataatttaattttatccatcatatactaatatagatacgaaaagacaaaatataagaatactaatactttatccaatcacagtgtaaccatttattattttatctattcatagtataattattttcacttttataaatttcaatacaatgattattactccctccatcccaaaataagtgcagttttgtattattcacgttcaacgtttgaccgttcgtcttattaaaaaaaaattatgattagtatttttattgctattagatgataaaatatgaatagtgtaactaaatatttttaaattttttataaattttttaaataaaatagacggttaaatgttgggtatggatatttacggttgtacttattttgagacggaggaagcatgaacttaacgttgtgattgctttttttcaaatttcagcacgtactgtaccaaactgcagcagaagcagcagttgctgacctgtcgtcctggacggtttgccggcgtgatcaatttctagaaaattctcggggcggtgtgaacgcctgccacgacacgatcaaatctcgtgttacgtacacgtactactaatacagacaggcacgcagtcaaactaaaccactaaggccctgtttggcacagctccagctccagctccacccctcctggagctggagctcagccaaacagtttcagctccactaaaactgggagtggagttgggtggagctctctcacaaaatgtactagagttgtggagctgggtttaggcagctccataactccactctaaactcaactcctggagttatatttaggagttggagttataccaaacaggccctaactaaacacacaccatggatcgagcggtcgagacaccgacccgatcgagcggtggtggtggtggggcgtgccacgtcagcaacgttttggtgcgtggagcgcgccgtttccgtcgtgacagaacggaacagcaaaatccgtggcgtggcgccactttgcacccctcctgcttcctcggcggcccacgaaaacgacgccaccaaaacccaacccaacccaaaagagacgctacgctagtactaggcgtcgacgtggccaaccgtccacgagctgtttatcgtaggatctggatgtctgcttggtactttctccgtatcacaatgagtcattttagtattttttacattaatattaatgttaatgaatctagataaatatcattaacatcggaggaagtagtaacttatcaaacataattaaagtccaaatttaaaatctgctttctctagtttcctttttagtgtatgtgtgttactgaggctgttcggaaacactggcttatgcaacaatatgaaacgtggctggcagctggttcgcaagctacaaccgttagcattactgaatagcccccatcaacttttcaacgtgcgtttaactatatattttactaaaatattatataaatatgtaaaatataaatccggcttaaataacatataatcacaagaaaaaaaaatcataaaagttaacgacattgtacattaacaccagagcaagtgatttttttcatttaatataatacaaatataaaaattttgcttataaattatttttttcctttttattttgctgctattattagctgtagctcaacgcataagttattaccaccgtaactccaagcctatttagtgaattacatagtcctgttctcccatgaatttgcttttcgaaatgcttcatgaattatttctaaattattttttttctatttatttttctactactttaccagctcatctatcacatcttaactgtattttttaaaaaatcgaaattctactagccgtttactgaaactacctaccaatctaagccctatcggttggcttgataagccaaagcaaaagtcaaaatttaaaatttaaaacttaattctgtagttgattttaaaatattttcaacgtaatttctttttagcattgacttttaaatcgctagaaaaatatataagagttttactcaaagattaatttttattttttaataaaccgtcttgattatcatggaatatggacaagccatgaaggcaaattatcagggaatatggacaacccatgaaactctgtttcttgtatgactttgccttctgagttctgaaacgttgtatccatgtgaaattttttactggagaggtcagggtcaatatgacatttgtgaagcctgaaaagaaaaaaagaaaaaaagagagcttgacctgttcagggcctgccagtgagtgggggtgatgcaaacatgggccagaattaagaggagagtctctctctctctctctctctctctctctcttgccatttaaaagaggaggtggcaggcaggagaggaaagtggatgtgcccccaaagatcccctcccctctcctctcttcttcactctgccccagagctgacttttgcttcttactcctactactactacttgtctttctctttgcaccctagcctcatgttcttcttcttcctcctctcctcctccttgtagcttccacccccaccccactccctcccacccccgccgcccgcttaaaagtccgattttggggaggttcgtgcgctcagatcggggagggggtccaacaccccatttcgtcttgctgcggcggggagggtggtgaagcgaaagtttggattttttttttttggggggaaggttctgcttggatgagctgcttcctgtgcttcggatcggcccaggagggggaggccaagaagcccggggctgactccaaggacgcgcgcaaggacggctccgcggatcgcggggtgtccagggtcggatcaggtgcgtggaggacaactggatcttggaattagttttcgcggcgttttgctgcggctttcagatgttcttttttttctttccttctgctgccttgtggcgctgtggttttcctgttcatgttgtgtttgtactgctttgctgtgcgcgaacgatgatttggtgatttaagttagacaaatgtgcagggttgctgtcgtgttagtaagcttggaggctgtatttaggctcaggcacgctttcttcttcatttagagaggaaaaataggggaatgcattgtttgccatagtttgtggctaggatggctaggttttattaagaaaatctgtatcgtcctggcaattttaggagattcatgaatatatagtgttgattttgatggtttgtcttgtttagatgtgtgggtaaaggctcaggatcattttgaagttgtcttaggctggatagtatatttgtgtgggaacaatgggggtagaaagtgatggatgtgttgtttactagtccttgaactcgatactgtttatgaatatacaaatatgtaggtgtcatttcattttgtttttttgagtatacgaattgcgggtatgttggccatcgtacctgtccagtttggcagctggttcatctttggcatgttgcaaattatctgtaaggacctggggttgacatgatataataaggattgattttagtgacctaggacagttcattgtggatcttttcttcatgaaactgattgggggagggattattggaagtacatgctttgtctttacgttattctgtttatgctttgagtattgcttcacaaatggatcggtgaaatctgcttcgttggcttctatcgagtagtaaagtgtactaaatacagtactttaaatgactgatttagttttatgtttctgctgataagagtgttaatgctcagaggatagcacacaaccattactctgcccctcaaaaagaaaaaagaactgattactaactctacaacattttcttcttagataaatcgagatcacatggtggattagactctaagaaggacgttgtcatccaaagagatgggaacaaccaaaatattgctgcacagacgttcacttttcgtgagcttgctgccgccaccaagaacttcagacaagattgcctattgggagagggaggttttggccgtgtatataaaggacgcctggagactgggcaggtcagtctttcttaacctatctagatctattgagattttactaaatacttgaagtttaggttttcagcgatttagttaatattcagtaaaatgttggcagaattgctgttttgctttatccctggagcactaatgaaatataccacttcccaggctgttgctgtgaagcaacttgatcgcaatggtcttcaaggaaatagagaattcctggttgaggtcctcatgctcagtcttctacatcacactaacctggtcaatctaattggctattgtgctgatggtgaccagcgccttcttgtctatgagtttatgccattgggatcactggaagaccatttgcatggtttgtctatcttctccttgcctttctagtcttgcaagagtccatgggcgcttgaagcaatgtacataaagtagtagtactgcattattgtgaagtactatacttggtagttagtacagctgtttaatggcatcctgttatgtttaaagttcaatggcagcttcaaatgaagataaaaggttttccaatttctgttttgtagatttgccacctgataaggaacctcttgactggaacacacggatgaagatagctgcaggtgcagccaagggcttagaatacctacatgacaaggcgagcccgccagttatttatcgtgacttcaaatcatcaaacattcttcttggtgaaggatttcaccccaagctgtctgattttggtcttgcaaaacttggtccagttggtgacaagacccatgtttcaacacgtgtgatgggaacttatggctactgtgccccagaatatgcaatgactgggnnnnnnnnnnnnnnnnnnnnnnnctatagctttggtgttgttttcctcgaactgattacagggcgcaaagcaattgacaacacaaagccacagggggagcaaaacctagtggcatgggtatgtttttatactatacttgcatcataaatgcataataaatatatgccagtgacacccattgtatgcattcttcttttgaaaataaaagcattacatgtatctcagcattttattttagtactgttagtgaaatacaatcccgccaatcaaactgatgccacccacctgtttctttacaatcacacaacaaataattgtagtgtttgtgctagctcatgaacaatttgatcatggatggcctttacttccaagtgtccaaattgtttccttgtggccaggaaaagttgttgttttgataccgatatttgccatccaccttggtaattttgctgatggctgcaaacatttagcaattttgagagtttggggggcattatagttcagctgttccattctcttacaaatgatgttctgttgctcgctcaaaatttgtaaatgaaaccagtttctaatgcaatcttaattgaaaaaaaaacttcgtggacatttttattttggataatcaatacatttcatctgtttgcaggctcgtccactattcaaggaccgcaggaagttccctaaaatggctgatccaatgctccaaggtcgcttccctatgaggggtctgtatcaggctttagctgttgctgccatgtgtttacaagagcaagctaccactcgccctcatataggagatgttgtcactgcactctcatatctagcttctcagacatatgatccaaatgcccctgttcaacatagcaggagcaattcgtcaactcctagggccagaaatctagctgggtggaatgaagatcgacgcagtgtgcgctcgccaaatcatcattctccagatctgaggagggaagctgccaggtcatcaagagcagaggttagcaggactagttctaccggtgattctggccggagatcaggattggatgatttagacatgacagggtcgcagatgggtagtccagctcaaacaggaagaaaaagagagactccaaggactgctgatagacagcgtgctattgcagaggccaaaacgtggggggagaattctcgagaacggaagcatccgaatggtcatggcagctttgatagtacaaatgagtaaatcggagggtttttgtttcagaaatcagtctacggaggatgaatctgctcatctacacgaaacggatccaatcaagtaacattgcattggttccacacggttctttatctgtgaataagacccttgttcttccccggccatcagtgccactccatggtcactatgtcattgctatttgacatgtcttagatctcccggcgtccattccttgtgaatgtgattgtgtcatgtgtctttagagttcggctccgttcgggagccgataaaattcagctggaaaggtaggcaacagaagagaggaacctgatgaatgccttttcttggttacctgatcgccatgctcatgctcagcaccacctgtgttacgaatgttacagcatttcaggtttggctacctgaggacgtgaagttacttccgatgagaattcaggtttggagataggacacattacctgtgtttcgtacagttttttcttttcttttcttttcttttgagttgcctgagcacttatttatttgtattagcttactgtacctctcatgtatcttagcgtgaacgttgttcgacatgcagcaagaggtttttatctgtatcaagctatttcagagccaatgtgttgtacatgtaatattttgcagtagtagtcaatcatgtgttcatcttgcaaagccaaatgagctgtatcaaaccaaatctgattggtgtggcagtgctcttcgcattgttgctatctgcagaagctatctgatgcttagctgctactctctcctttccatattataagatgtttggattttattcttggtcaaatttcttcaagtttgaccaagtaaaacgtctgataaataatatgaaacggaggtagtactgtaatgcaacaacgcaagtacttgtgaactgaacaatgcttcacattaccaaaccacatttacagcaagcatctcccaatcctcttctgacgcatgaacaattttgacacatatgagcatcagagagaggaacacacgtgtagtagtactgtacaataatataacacatctaagctaccattatactaaatctgttccattttgaatcattggtcactgtgttctaggtcacctgacaaacccagatgctttgacaagacgatgttgccattgatgtccatccggtaacgcagcttgctgtagtccatgacgatcctgcaggagctccatgcctcggcgtgcatgctgacgccgagatagtatatgtggtcttgcacgctgctcccactcacagacctgaaaggtgaaagtggcgtcaaagaaagagagagatcatgaagagctcatcaggttcagggtcaccaaaaggagaggagatgatgaggtgtggttcaccccccatctgcttgtgtttgtgcatatggagaagaagaagaagaggggtagtacctgcagcacgatgggtcttcaccagaatcatcacagatctgctctaccgagtacactaggcttcctagtccgacgttatgaacccatacctgaagaaaaagagcatcttttttagataaaaaaaagaggatttttattgaactcggtcgattacgtcaaggtgatagaaccatattgaaaaggagcactcagcactgcatcatgcattgggaaattatggaaatgcaagatgagtaagattgcatgtgtactgtctgtaagcaattgatctcgtcagaaaatgcatatatggttcaaggtattgagtttcaggtaagcatattagacaggtagagtgtatcgtacctctcttgggaaatgatggtaggtcttctgtgggaagaatgagaagtatggtggcaggtgaggcacgatatcatgaccatgggtaactcggattgcgtgaggcaagtatttcttgaaaaaggaagcaaaagcagcattgccaatccgaggctgcccaaatgtcattagcttcacaccatctagcccatagttcacctaaaagaaaacagaattcctgtttagctgtagaggcaaaacctggaggtaagtaagcaggggcggaaccacgcctggggcaacttgggctggagccccaggcgtgggaaaaaatttaacggtcttatacctgaaaattcaacagatattttgatccttccatgtctcagccctacgcgtatactccagcctgggacttagatcgattctatccctcactaccattacttggaggcctattttaattgccgaactctctagtccatactactactatacttctttggaccggcaaaggaggcatgtatcccaacaattctacaaacaaaacctcattctatgatagcattaggtgatacatttgctaaatatgcctatctgtaggaacacctcgtgctctatcctacgaggtcgagaatatataatagcccacctaacgtactccctctattttataatataacaaatttttagttacgaatctggacaagtgttgaatccagacaattctatgttagattcgtaactaaaaattgctatattttgaaaacagagatattatataggaattttgggtagctttaggctgagttcttaagtgagtttgggctgaaaaaatgtcttatttatcatgtgcatgttttttgaattactaaatagtgtttctcatacaaaagttttcaatatagaagtttctctaaatatataaataaatatatattttaagtttataatagtcaatacttaatcaatcatacactaataagctttcttgtttctcgtaccgctaaaaatatcattctaacatcggaaatgaccatagcttagtatttagttttgagccctaggcttcgagaaatcctggctccgccactgtaagtaaggaatggaaacctacaaaccgaccatagatgtagattgctactacataactgaaaattagtactaggctggcaaaggaaagatgaaagatcggctccaagaagataaaaaggctcgacagcttcgcagactatttgtccatttgaccagaatataaagtattatcatggaagaaggtgtttccaaattccaacaaaataaaacacttctctcttttatgtgaagtcagatgtggagaataaaatgtttataatttattgcacaaaactaagcagagaaacaatatgtggtgtaattttctaaacagaaagtgatataggagctaaaagtgaacactattgaattcagttaagatgcagtactcacaacaagatcaagtgcacaaaacgaagccatagctccacccattgaatgccctgttaccatgatcggaacatctccaaacaattttcgagtcttctgaataccgctgacaactccatctcgcattgttgtgttatgataagcagaataaaatcctcggtgtacctatggtgaggtggagcacaaaatgaatttggtctgccaatgttgcaactcataatgctgaagctaacatggctcaccattgcttcaggcataccagggtagtc

SEQ ID NO: 3310 - DNA, 1196 bp, Oryza sativa
atacaagatgctactagagacatgaagataagtgttatgatgtacacaggcagaaacgaacctgcaagcagttctccaatctacgatgatatccatcatttcaaacccctgggcatccaacaaatttacttcaatcatccgtgccaagaattgcaggaagttgcccaaaagtcaaacaaaatcatgtcatggcaaacagaaagtataccagtgataaaggattacctcaatcaggtcaccacatctagcacatgtccatgtaaacaattgtgtcaggtcagcagtatagatctgcaggacatcctctatgttaaactccaaaatattagaaaacgtgttgcaaacggttgatccatattgaaggatgatctaacattcaggaataacttagataaagaaaaaggtgaatgaacatacagctgaagcatattccacaagtgtcttggcaagctttgggttatatatggtggtagagggatggcgttgaatgacctgaatttcttttttcaccaaatgtaaaagaaccagcatcagccttttaaaaaggaaaacaatgaacatctagcgaagcaacattcaacatgctggatacatgtagaaaagatataactagtgacagaaaatgattatgtaacatgaaacaaaaaagaaaaaaaacacattattgtaacagctaaacttttggattcaaagtcgaagaggatatgcaacagctttgaataaaaagctgcatgaaagaacccttatagttcttctgtaatagccttttgatatgtcaaaaggaatttgaaattttgcactatatatcatagtaccaatggcaactagatacagctacaaccagccattttaaccagaaagattaaattgaaagaaggtaattttatactagtaaaaaaatggaaaaagaaactatcatactgtttcaatatactagtaggcactacaaagggggaaaacatcgaggcatgcaaatattgtggttcactgctagtttccttgcccaatgtgaacaattctcccgttaatcatttttttcaacaaaaaacggttaagttagttctatgcaaattatttgtttgaagatttcccaatatatttccatctagcagcaagctaaaacgtaatcaagcaaaaaagaccagctctaaatgcaagcaggaaggaatccactacaacattttgaagtaaaaaag

SEQ ID NO: 3311 - DNA, 17511 bp, Oryza sativa
agctaaattacccacctctcccggagcaaagcacaatcaagcacaccaaaagcgccgcctttagtagcccgcggcgctccatgccctaccaaaaaagagagagaaataaccaagcgcccatggcaaatcttggcaaaatttgcacaaatcaactcacctgatgccccaaatcggccaaatccaccccggaaattctgccgccgcgcgatcgagctacctgctaccgacgagttggggggaatcggagagtggcgaccaatcgatgaaatcgaagattttattgccgtatataggagtagtaaaagattattaacaatccgagttcgtgtaagtgtttgagctagtgaagaaaagtgaggagcaaaataagttaagagaggcgagaaataaattaattaaagattaaattaaggagcgagaagagggaacacgaaatgaggattagcgaagatatatatatagccgagccggtcttgtgggtcaaatgaccaatttgcccctaatgcttatctggatttagctgattaggatggcggtttcgggtcagattggagagaggaagcggatcgccatccgataaggttcagagcatctctctcttcgtcttcggtctttgcagccgaatttctttcttgttcggccatgccatagagtgggctccacacgtactgaacagcgattttttgctacagttttttcccttttttttcattttttacctttattaatacctcagttccaaaatgtaacatagctaaaaatgtttatattttgggatgaagggagtatattatcatatgaagaataactaaatatagtcagttgtctctcctaaaggtgtatccccatcttaaaatataatataacgaattctaaaattcgacacataggtcataatttcaatatgagttatgatttatgagtgtagctttttcatcacgtactagggtggagtagttgcgtaggagtagtctttttaattttctattaatttgcttattgcaatcttgattataaaaacttacaaactttttaggtttttattgtagtttaaatgagatatacaacacaatttattaatgattacatattttacaatcatatgaaaaatgcattttgataacacagatgaagtcatcaatctgaactaaaaaccaagtatggcatttttttctttgtcctttaagatgaagaatcttgtttcaaccaagaatatttttggctatttagaataatccgttgcaacgtacgggtttttgctagtatgaagaaaatatgttgaattagatatgtgaaggttatgattgattgaaaaaaaaaacgatttatgtgagaataagaggtgaattactatattctaaaataatttttttaatactagaatctgctacatttgaatacgaccgaggtagtgctgctagataacgcacagtacagtcaacaattaatgtacggcacccacaaaatactgtttgcacatagtttagttttctcactgtaatttaagtatgggtatgtgtattttgcccccgcgtcgcctcccccacgggcgacacgggagacggaaaccgccggcgtcgcccgctcctcccccctcctcctttcgccgcctcgccgccgtccgagcagccaccggcaaagccgcgcggccgcaaggatggcggcgacggggcttcaccctcgtcttcgtctccctctcccgtcgcggtgggaggccgcgcgcgggacgcgcgaagaccgcccagatccgggccgccacggccggatctggcggggaggccgccggcggcgggtcggtgtgaggtggcggtggcagttggtggtggtggcggcggggattaaaggtggcggggtggtggcagcaattggtggcggctggcgccggggaaggcaacgacggtggcgggggagacggcaatggcgatagggatggcgtgcgtgctggcggcgtgctgcttctcttgctgggggcgtcgatagtggggttggagatggtgcggggatggaggtggcggcgaggcttgcgacggaggccggatctggcggcgaggctggcattggcgaccagatccaggcgctggagatggttttgccccggtggcgggtgcgacgacagcggagagctcggcgatggcgttggggcggttgcgttggcagtgccagcggtttgcgacgacaactgctggcgtcggtggctggtgatagcggcatcggcgacggcagccgacttgcagcggccgtgactgaggagacggtggcgacgtcgaaggatgtggcagtggaggtggggaaggagttgggtgtgaggtgacggcagcgacggtgaggtggtgaccgtgacggtggtgggaggaggcatggcggcctcggacggcttgccgagggcgtggcagacgactgcatcggccggcgcagcatcgtttgaaggaggggtcggagaccggctggacgcagagtggtgtagccgatggcagcggaggccggctcggcgcgagaagcgcgggcggcggagatagaggccggcttggcgcgagaggcgcagctgatggagggaggccggattggcgcgagaggcgcgtccggtggaggaggccggcttggcgcgagaggcgcggccggcggtggaagaggcgcctcggtgcatggtggagctgccggtgggtgtggcgcggtcttcggcgcacgaaggctggccggcgggagcgtcggtgcaggggccccacatgtcagcagagtttgagtggtggtggagcatcggtgcatcagccgtagattcgcagatggtgagcggcgggtgaaaacctaacccggccttggctgaaccgacaacgatggttaattccccctcctgagggcattgtcgtgctgtctcacacctcaagggtgattaccgggcgaaagcccagtcttggctcctttgagccctgatggacggcggcggcggtcttccgtcgcttctctttttgaagacgtcgttttggcacccccttgctgtagggcgatctcgtctgtgttcctttgttggtctagcggcggccggtccggtgctaaccttctcctggtcgtgtgtgttggcgttgccggtacgtgggtggtggtatattttttttctttctcctggttatgacccttcagggttataatcttgtaattttttcctgctctatcaatataatttcgcaccgtctcgtgcgagtcgttaaaaaaaagtatgggtatgttgcaccaaactagtgatggtgtcgtcattgccggggacatcgcatctagagctatagcttggtctctttactctgcacgagtatccatcagtttgttgagttggttatgcatgaattcgacgtaacttcttcatgtggcaataacgatgtaacgatataagtatgatatattatgatgcgcaagtagctagtgtactgcaatagtcatatatatgaatagagaggcttgattaatttggcttctttctgaaatgtttaattatctaaaccttgtttgaaacctgctacctgaaagacgagcgatcgatcgagtcagcatgcaattaagcatcgacgtcgcgtgaaatggcagcgaatttagcgtgtgatagcctcgttgcttgaacgatcggagcagctcacctctggaatcgaagaagcctgacacgaaaaggcgagagagaaaaattcttcatattaattactcgcttaatatatactcccttcatcctaaaatatttgacgccgttgactttttttaaaatatttgaccgttcgtcttatttaaaaaattcaaaaaatttaagtaattattaattctttttctatcatttgatttattgttaaatatacttttatgtatacatatagttttacacattttacggtcaagcatgtttaaaaaagtcaacggcgaacatttagagtaggagggagtaattcagacgtgcgggaaaccgaaaggaggtgctgcgtgcctgaatcgaatcgcatcatattgagcgatcgccgacgcaggatggcaggttagcatcatcaggatgcatggaaatgtggaagcactggatttaccaaatttatctcaataataatgttaacggattagattccacgctctgcaagcccaagatattgggatgtgtagcggtgagattcggttgttgaagatgcatcatctagcaataggatggtactactacctgtaactgcagtgcacggtgagtgatcacgcacgtcagactgatcaaatcatgatgttgcgattctcggcgatatcgagctgcagcgtctatctacggagcagagctctccttgatcaggtccaatattccagtatggtcatcaggtcacctgatcagggcagctaaccaacaaccatttgatcttggtgtgcagtactgcctaaatgctatattcgttttaaaatattattacaaaggatattttagaacggatgaactactgtaacatattggagaataaaaattctctaataagcaaaaccaacatattagagaataaaaaataatttttagataaaacttttatatgtgtgttagcgacttaaaagccaacactgaaaaaaaaaccaagttgaaaatatcttaaaacaaattcgtaaaaattatgtttgaaaatacaaattttgtcaatggcttcggtttattagggcaactagtgagactaatatatgcgagcgaaggaacctaaagtgaactttttcctgaagaaatcaaccaaccgggccttgccttatataacggcccacccatctccccctcccaggccggacgcggagcccacggagcgatgcgatggaaagaaagccagcgctgcagcggcgcacccaggcccagcgcgggggctcactatcaccaaactcgctgattaattcgcgcgtccccccaaccccaccgccacacgaccacgagcgcggtcgtgcgatgccgtgccgtgccgtgcgaaacggctgcatatgcatgctctcgcatctggactggatcaacccaacggtgaccctgaccagtgaccaccggcttctcttctccgccggttagtgctgctgcttcggcggcgatgcgaagataggattctaaatttataatctcccagatggaagtacacccctttttttttatatcaattaaataattataaaaaaattaacaaggtagattaatatataatatatcactcaatgtttagattcgacttctacaagttacaataaaaataataaaaatagtaacaaattaaactgtaactagtgtattttttttatttttgctgtaacttataaaaggcgaatttggacttgcatgtttatggcgtaatatattacatattaaaaaatttaaaaagatttcatgactatttagttgatatgtagtgcttacaaaagtttccccatctcaaatcatcatcatccaactactactgcaagttcctacttctgtcacctactgctgtgctgcattccctgccccagatcgatcaggtccccaactcacaacgacccatgcatctgctgaacctgtgctttactgaaatcatgcacaccctaggttcgttattcttctctcacctctaattctcttcacatcgtactatgttacatgcaccattacatcaggtacatattgctcggtattcacaatggagtataaacctacctccgatttgttttcattccatcccagcagcatcctattctgcttgtttcgaccgatttaacagaaagatgttcagatacggttgctactacaatacaaacaccttttctgaagtttccgggtttttacacaaaagttgcagaagcacacggttctccaaatcatttcatatattccatcaggccgcaaatcaacagtatgcacataaaaattctaacaactcgcaacagaaacgagtctatcacaattcgaaattcagcataaattatttcggaaactgagcatatgcaaatcggtcagaaaagatcggaacctatgcctggctttaaagcttgacgatgcctcgtcgcttctcctcgatcccctctgctcatctgagaggatcggagcaccgccgccgccgccgccattagtagcaggggtacaccacgcagcgcctgcgccgcggcggcgtgcacagcatcagcagcagcaacgcgaggacgacggcgacgagcagccccagcaggttgaactccggatcgtcgtccgtctggctgcaacacagcttccccatgccacccgcttcagaaggagaggacgagagttcttggcttgcaagatgaacttctctcggtctctttctttgagaggaagtagaagagaagcagggcttcttggcagtagtgggttttctgaatctgaaagactctgaaagactccggatggaggtcgtctcgtctctgtattctatgacactttggctatgaatcttggggtgctttcaagcatcatgtgggctggctggttgttgaggcatcactgtctagcccttccatgatgcaacttcttttccatggctatgtcctttaggttggatatcagacaaatcgaacaaccaattccgcaccaaccatggccaccactaccagcacatcaggatagagttcttgtaagttataactatgcagagattgaagtgcatttcgggattttactagtgttgattaatcttgaaatgtctagttttttttaatttctttcagatttcagtatggtggacctgatcatctctcttttagccaagacctgatcaatgcaaacttatacattcagttaactggcactgtcattgacgtagtattaatttggatataggatcatcgctgatgcgctgaaaatcaagttggatccaccctttgatgatacggaaatgccaagtggtgaaagaccaggtcacattaatttgagaacctgttcttttattcttctctagcacggttctgaaaaacaatggttcctctcttttttttttacaggacactgttgaatattctggtgagtaatccctccgttccaaaataaatacagttttgtacggttcatgttcaacgtttgaccgttcgtcttatttgaaatttttttattagtattttttattgttattagatgataaaatatgaatagtagcaattatgggcgtccactgcttcacatgataatcacatcactttgggttacgctacgcacgtcatcagctttcattaatagccacttgctgtcactgtatcatgatcctgactgcaattaggcttcctaatgtggataaagacttgcaaagatggctaccaattgctgctgcttaatctgaataaagaacattcttacctgaactaacacaagggctgcaggctgacctagactgcactgcaatttttttctctgacggtgacagattcagcaataatgagagatcaatttactgatcccctcgtggctgtattacaagccaagcaacccctaatctacgtgcttattaaataatacatatacagcacatgctaatcaacgttaaatactcgaaattgcacaaactagcagtcatcatctcagttgaagatgaagtatttaaccaacaagaacagataagcatcatgtacagtttcttgctaataaactgaagggagaaaatttggacatttcgtggaggcatgcagcaatgcattttgtttggtacgatgcgtctcattttcaaatttcaattcagcggtgcttcaattggatcggcggtggcttgttgttcttgtttcggcgactcaattggagcggcggtggcttgttgttcttgttcgtcatcctttttatccttagcgacctgctcctctcctttttcatccgtttttgttgctgtcatggcctccttcaattcaattgtttgtttcccatctgattgccctgcacatggaatgggaacgtctaggagtattatgtgagcagttgaaatcggcagctgataaagttcatctcttttttatttttaaaggaaaacagatcagcagaattatagattgcaatttatgcaagcatgcctagatcactggatgtaaggaataatgttgttagagacaaaatgattagaaaagatgcaaaagaagaataatgatcgttgggtcccctgattttgataaacacaatagatgagataatagcatgtgcatgtgctaccttcggttttttttttttgagctgctaccttcgtatttagattattagatatatataacactgttgattttatgcagtccttggtgcacaactttgaccactattttctaagtattagaatataataatatgatctattaaaatcataatgttttaaaagtaattctaaataaaaattttacctgtatgatctcaatttttaaactaaataagtgtggatgatcaaagttttgaaatttcaaccaaaatatagttaagaatgtcatatttaacgggaggcaggaaatttcagattattatttttagataaatagtccttgtgcgtgtaatgtttagcaatcaaagaaactaaattgaaaaagtgttttcatccctcaggcgatatctccttgtttcatgcatgccacctaaatagttattattttttttaaaaaattacaagataaattaatatgaaatataacacttcacaaaagtgcatgttaaaattcaacttctacatgttgtaacaaaaataattaatgataactatttttaatttaatttgttatttttattgcaatttgtagaaatcgaatttggccttgtatgtttgtggagtgatatatttcatattaatctatgttatttttttaaaaaaatttatattatttatacgtcatgcaaacatctagggacattccctctgaaccttaccatcgtcatctttcgaaacggcaatggatttctcctcctctgtctcctgggagacgatgatctcctcgtgttcgaccttgatctcctcgcgttcgacttcgaccttggtgatctcatctctcgaaatgacagcggatttctcctcctcctcctctgtctcctgtgagacgatgatcttctcctcctcctcctcgaccttgatctcctcctgttcgacattgatcgcctcaatgttgcttgtctccttcttggcatcttctgcctgatcaactccggccaccgcctccatttcgccattgttggacttagaagagctaggttgctctagttgtgctacctcctcgccggccaccggcgccgggacagcggccgggaaggcggcggcggcgctactactggtgtcattctccagggtggccggggcagtcgtcggcgaggtgacactagtgacgtcatcctcctgatgaacctcgtcggcgttggcgacgaccggccgggcacgggcgccggggaaggtgacgctgccttcgtcgtcctcggcgacgggggcaaccgcgaaggtgatgctttcgtcgtcgttgggctgctcgtcgtcgtcgtcgtcgtcgtcgtcctcggctaatgccgcctcgtcgtcgtcttcctcctcgacggctgcctccattgttgccgtggcaacaacctcgtcgtcgttcttgttcttgttcttgtcctcctctgctttaattttctcatcgacggcggcgacattctcggttgatgcgacgtcgttcttggcgtcagtgatcttctccttctccttgacgaactcctccttcattggcactactacatcctctttcttctcatcaatggcgaccttggtcggaatcaccttctccttcttcttatcatcggtgacagcttcttgtttgttcttggcctcctcctttttcttctcctcgacgatcttcttcacggccgccggcgtcgccttggccgccgccgccgtcgtcgtcttctcgacgatcactacgccggtgtccttgacgacgacctcatcggcggcggccgccgtggtgctctcctcgacatccttcttctcctcatcaatggccttctctttcggcgtcgccttgcccttccccttgacctcttcgttgacactgctttccttgacaacggcggcggccgagctctcgtcggacggcggcggcggcgcgtgagacggggcggcgttggcggcggcgacgacgctggacttccgccggaagaggcggcggctggatctgccgccggtggagccgacggtgttgccggtggccacagcttctttggagccaccgcaacccatggcggcggccggccggcgatgtggaggaggaggaggaggaggagacgacggcgaggagagaatgtaggagacacaagagaggattgcatgggaaaatatatgctgcatgcacgcatgcatgaacgaatgttcatatggcgtttgcaaatttagggaaaccataaacaaacaggaggttttgtgacatgtgtttagtgctctaattgcagcctcattgttctatatattcgtagaaaaaaaatctttagcaaggctgtaggtaattccaggtggttttttcagcttcagatggaggtttaactttataatactaaatttgatgagctgttttacctgagatggatgctgccggttttttttgaaactgaagccagcaaagctggtgttatattaagtaggaaaaaaagtatttacatgatcaccaatggtgatggggaaaaacagagaaaaggaagacagggaaaagaagaaaaactgagtcttaggcggataatctcgagatgttttttgctccacatattctcaataacttgattttatcttgtatcttgtccagcagcgtatcttatccagcagctgcatcagagttttttcttgatttcgaaacacacgtctattccactcacaccgtatttcccatgctacccgcatgtggactgatttgttttctttggctttgtctttcccaccttgagatgttctcttaatccaccagtccaacagcggctcattttcatcatgtgtcatgtcaatttcattgcagttcagcctacttaggaccctctcccaaatctgtcaaaggacaatctttgaagagatgttgagctgtttctaaattcctataatatagttgatagaaatagttgtttggccattatctgatctatagctgatctgttgtccaaatcctattttgcagcaatagctaggcaaagtgtttgcatttggagggtgcccattgtttccaaattatttttgctgcagttgagtttatccttccgttgaattgtgctatataggttgacctcacactgtgttttccattgctcatccatcttgaagttatggtatcgtcggcaccttccgtgagggtgatgtcgttgctccatacttggtagaatacctcaaagtactccttgactagctaaactgtgaggttgtgtctgatattctctattcattggtcattagctagtccttcctgtactgaccttccttttcttttggcatgcttgtatagagttgtagccaattccttgagtagttgtccaccaattcagtttgattcctaaaagctcattttgcgtccatctcctattgacatcttgattgatcatgccatgagatgaagctgttggaaatgatatagtatactcacctaactggagtaaatcgggagctgtctgaattttgcccctgaatatctggaatgcaagttgctaaggagagaacagtagttgaaaagttgaaagagagaccagtgggtgagatcgagagttgcatactggcatgatgcaagccattgaatgttagttacatgcaccgatgcacaactactgttctcactgcaagcctataaatcgtccacttggaactacaacatcaaatcaaaccatatgacagcaatttgcaaggatatgttgccttcgctcctgaaaattctgttcttggattgagttctttgtgaagctgtagctagcattttctctcggtgaaatggatccacctgggcctggaggaccgggaggaggccctggcggttggggccctcctggaggtggccctgggggatggggccctcctggaggtggccctggaggatgggccccactacctcctgctggacctggctttctgggtggcccaggccctggccctggttactgggggcctggatttggaggtttcatggggtcctggtaagctgtgtacattacactgccctaaactttctggaagtttaacctcgcgttgcaattgcaaacaaagtttttaattcatctgcttaggaattcacattatcacatatgagttaaaaggtctacgttatgtgcaagttcaaccaatcgaagcacacaccaccgaaatttcacatatcaactcatcaaaagtttgaatctctgaaactctcttgtgcagtttttatgtcctctgctgctgctgcttgctccaggattgttgtgggccattgctggggcgtccaggcccgggtggcccatcgtcacccttctgataccaccctgaccttacccacctagtgaaataatgcgatgtgtttaccattacacatgggaccaaaatcgttacacatcctctgatgaagaacaagtacctgatagcagcttgcagagtcttatatatgctctttactttgtcacttatctctaggggtgttatgcataatcctacttgtttgcatttgttagcaactcgacgatataatgatggttctgctttggtacctcgttgatgccttacaaatgtcaaatcaaatacaacctgacagttttcaaactgacaccagcccaggtgaaaaggaaaacaacgaagaaaactgcaccgattctaagaaagaaccgaatccaacacactataaaaaccccagtgaggggagagaaaagaaatcccgggttagtctactgagccagcagcatctcttggacggttctgtacagatgtaaaagctgttctatgcacgcaggcaattggtacctttgttatatgcaaaaccataatggctagtgaaatacgatgctaaggaatgctcccctttcaagattgatgcgtagctgccctccaattcttgtgacaaactgaagtgtccagctgatgggtttttggaagaacttgacctcataagcgcaggaggtaacccagagaagtaccaagaagtgccacataaaccacaaacagcaaggggaaaccaacttgattccttggtgttcccttctttcgtagaaacatctagccaagccatgcatcagaattagtagacatgtcatgcatgaaacatagtatatgaccagtggtttcaggatggaatttgagtcataccatttcttgctgtaacttatcccgctcctgggtggtagttctgctctcttctctcagctttattatcattttttcagcctgcaaatcagaaagtttgtgtttcacttcagaaagtattatctggaatataagattaaaatcttagtttatcaagcattataagctccatgtttcaggaggatctcattctgaactattgatttgtcctgtccaaaatattacctcttccaattttacttcgagaccattgagctttgacttcaggttctgaacatcttccgttacctgtccaaaatacagagcaacttcaataaaactagtgggaagattgtttaagagacagatcggaaatgtagtgagaaaaatatgtaatttgaagatctctataagtgcagcttagctttagtgcattgtatctagttgcatatttatttcattaaagctacttccagtttaatggaagatagaagaatcacaaaatataaaatacttatttcaagaaatacacttgttgtgtatgaccaattaaaggatgttggatgcaatggacgattggcaaatgtgaccaaaattcgaatcaatagtcagaacaagtaagcattcttatgccatggtgtttgaaaactaagtggagacattttaaccaggaataggtggaattttgtaaaaatctagccactaatagactttccaattgagatggttagcaagaaccctgaccagctaaaattcagtcaaagactagcactgcaggcctccagaaactcaactcatttttgccttatactccacttaaggggcatgtgaaaatagtagaggaaatgcttacatggcatagttgacgactctgcacattgacagccccttgctcacttaacacgacagctgcttttggaagagtttcttctagaggagattccttcaaacttgctaggttttgttcgaaaggatggagagattcgacagtaatggaagaggtatctgttggagggggtggagattctgtcaatataacaggtgtctccttcaatggtgtaggaacttctctcaggattggagtctccttgactggggatacgggtgcaggaacttctctcaggaatgaagtctccctgacaggggaaatatgcacaggaacttctctgagaattggagcctccttgacagggtaagggggtgcaggaataacaactgggtcttcttccagaggggaatgaacctctttctctgcaactggaatttcattcttaatgttcaacgtgtcctttaatgaaggaacctcaacagctgcctcagtgtttggaattccattaattggctgctctccaaaaggatgagatgcactaacaagaacaaccctcaatttactttcctcgatatatctgccactttctttagaaaactgtaaaaaaaaatgatgagttagaagaacaccatgtgtacagctctttccaaaaaaaagggggtcatattcttatgtgcttacataagaaggaacaaggtcctcatctgatgttccataagggacaactgttgtctgaaccaaaaacttgtcttttaattgcatgtctggtggagcagtacgttgtgcttgcatggtaacttcattcagacgagtaaagaaaagaatcaataagagaaaagagcaatttaactgattggtaaaaattataacagaaccaataaacgataagaaacatctgtctaataattactctcccccaaaagaaagcacactgtgcttctttactgcacagttcaactaggaatgagttcattcctagaaagctttatatagattccacagaaaatgaaaatggctatcttgcatgactttccaaaatgagcatacaaaatgcactttatcgtactccctccatttcaagttataagacattttgactttggtcaaagtcaaactgttttacgtttgactaagtttatagacaaatatagtaatatttataatactaaattagtttcatcaaatcaataattgaatataatttcataataaatttgtcttgggttgaaaatgttactaattttttctacaaacttagtcaaaatgtcttataacctgaaacggagggagtatatgctaatatagatcaacaaggtaagtaaatatatctccggtgcaataatccttgcatacacaaaacaatattgccagtgagtaaatgcagtagtgagctactgaacatacctgtgaaatcacatgttgaccttggaaggatgactccagtgtttggtcgaacacaataccttttaggtgatgttgttttaacctaacaaatttgaagggcaatatcagacatagtcctattagatgctcaaacggcaaaaattatcatcctttgattgagcataaaagcgattaaagaatacataatattcagaaaacaaaatatctaagtttagtgtcatcagaaatggcatttaaaaacaataggaaataccttgcattaaaaatacaattttccagccttctcgttaggttaccatataaatatgtatctagcatcactatataattcttgtacaataccataaaaagacatttaaatttagaaaaataaaagtagttgtatgtagtagcagacaaattaatatgtattctttgatatgcccatttggtattcaagaattaaggccatagccgcattcaaaataatagtactgatggacaacttcatggttacaattacctaggaaaggatacacaatgtttagatagcacaatgtacacagtacaccatcaggagctatacttaacataaaaacaagcggcatttgaatttgtctttgagagcactgacaaaccttgaatgcgacatattcattggatttgttgacaagatggacagtacatgaactttgcttcttcacctcaactgccaataataaatgagataccaagtcagattatcattcaaaactttgagacggaatgtgttttgtatcctatactgtacagcagttaaacacatttcaattatatggctgaatgttgtagtttcaaatacaggtgtggtaggaaccagtacgagaccgtcttgttcatccaatgaaaattgcaaagaccaatttaatcatgtgcaaatttgacaagtactctaaattgcacagttcataagaaaaccacctgcagaactaggatacgataattttcagtttcactccccttcctcttttatcagcacatgatgatcttttgagtgatgcatgactaaaaggtaaaaactaacaccaccactccctccttttatgattgttagcatgtgcatcgctgtatcagtccattctcagtagttactgcaaccgcatccaatccaggtaagccaattagacaagcaatcagatccctctcccacacacagacatcagactttacaaccactcgcaccacgaaatcgacctgtcagtaaccaaacgaacagaaaaaggagcagcccactaaaaaagcagcctttaaaaaattccaaaacaaaagtttacagaaaattccaaactccggagccatgtttgtagaatgttatctaagtaacctagagaaaagttaacagtaaaaacaaaatcactcattgcttcttcacttaacactgtaataatctaacaaaaaaaattctgcaagtacctacacctctaaacagaatcaaaaccattcagacaagaaaaattaaaaaatgacagtgaaacgaaaatcaaaaccactaagaaatgaaaaaaatagaaaccagagtggaacgaaaattcccactaatttgaaatgaaaatcgctaagacccttaaacctgttgatcagtccaaacgaggggaaatagttttggaacactaatactggaaccaattccaatcaacagaggctacaaattaaattccactgagggcgaaaatacccggcacgatacaaagtaatactacagcgaagcgaagaaacaggcagggaagtcgcacaccacgacacacatacacggaatccactcgattgaagtcgattcgcccgttaacgcgagacggatcggaattactctctactccactctctatctagggggtggtgaggcgtggcgccgtggcggtggcgtggcagcgggggggacttacaggtgaactggagctcgcgagggtggatctcggcgaggtcctggcccatctccaccgcaccacgaacgagacgccgcccggccttcagcaccgcctccaccgacgttgggtcgccgcgcgcggaagcctagctagctaccaatcaatcgaatcccccgcggactctgaccgggcgagctgg

SEQ ID NO: 3312 - DNA, 9120 bp, Oryza sativa
aggcggcgatggcctctagagaggggaggtggaggtggaggtggagttggagtgaagtcgaaggacgacgacgggaaggcccaccaccaccaccactctctctcgaagccgttttgaggaggaggcgactctcggggacgcggagcagaaggaggcgagattttccagggactggaggattgatgggggcggccttttcattggtgcgggccaacccggcgtatgtctacccgttttttcacattacgcccctacaaaatctaattttatactacaccttttgtgttacagagtctgatactcccttcatcccacggtaagttactccctccgtcctagaaaaaccaaccttactgagaatcacctttggtaacaattttggtcaccaaatccttactaagattggattttttttttaaacggagaggaagtaaaaaagtactggatatgatgcatactagtaatatattaacttattggatgaaggaagtaattggtaaacagtcagtgagaatctgtcaaataagcaggtttctaggttgttatgcctactatagttatagttcatttctaggtctcatgtttaggaattcatttatagattttgcacctacttaatctcaaaatccaaagtgcgaatctatagttgtttgtaagaactcaagattatcgaattggttgcatctgtcggaaactctctcgaacaaagcctattattcctggtgacacatacttatctaatcataaggtgtatgcgaagtgagcgtatctcaactagttaggttctttatggtgaaaccaatttatccgagtttaaatcctagatttgtcacgggtgcacacgtttacaacttattattctttcagtaagaagcgacgtactcgttgacggcgagacgtcacttcgtcaatctcaagatatatcggtccagccttctgaaggaatggaggtgcttatagaggcatggtgtgtgtgcgtgtgtgcgtttaaaaggaatgagtgtgcgtggggtgtctacatttattttgtgtttctaacaaaaaaagttggtgcatagaataaacatttggtctacttatatttgtgacccgagggatcaacccttatttgacattaggcgagaatttgggcccctgggtgcaaatattcagttggtctgtcatgcctatgacaggtgggtcccgcagcattcgttgtcgtgtcggcaagtgacgtggcaggtgcaggtctggtgccacacacggcacatgcccggaaatatacggcgtgattcattccgctcaaagtcattcctaccagtaccccgcgcagggtcgcgcaagtatcaaccgaatcgtcaaatggtccaatggcccaccgccacgtgggccggcctggttggtttctactgctaccgagagagatccagggggacattgactgtggatttccacgtggatttgcagtcttgcagagggtgcggcatcatggtcatccatcaatactgtagcagtgtagttgcacacccaacagagcagccattgatgcttgtgattgatgctctaccagcgtttctcaaacagtttagggtggggttaccgtggtatataccatagttttaaaaactgagaaaattatcgcacgtgatagccgcgatagtcacacgattttgtaaatcctcttttactcccttcagatgagacttgagagtgaagttgatggtgttgaatcactaaattggtgaggttatctgttgcttgcaagatacagattaactaactaagcactagctctagaatccttttattctattcttcattttattttgttgttttactttacatttgtttgtatgaactactcctaacaaacaaagcacatgctctagaatccttttatttggtttttgttttacttttacctaagtggagtatgtgcatatctctactcttcatgtccatatacgagcaattattaaagttctgataaagaaaatggttgttgaagtcttaaatataagaaaatggctttgtaccatgtttaataaattggaagcacgctaggatagacaacttttgcagtgtactgtttcacaatgaaaaaaaaaagagaaaaaaggagtctttacgaaatagagtcaggacacagaactttgttaatgtgttagtagtattacatacacaatgaaaaaagaagaaaagagtcttcataaagaaaatccttttcacgcaatgattcaagtggcatgagaatcatgattttaaagttgtctgatttatataacaaaacttttcctcaaagttagctatatgatcttctttccaattatatcgtgattaaggagtacatttaataactattatgtaggtttctaagatagagcatacatgcttttgactttattacattatagtaattacttctcctttggggatatctattcgggggttatgtcgatggtcgctagtaatgctagctatatttttccctaaagaaaggcagtgctcctattttctcgcgtggggatttaatctgttttgcacaattgcaacattattaatatcatcataatatagaaattgaaatgtacatgatgcaatatttacagttgtatacataaaaacgattatcaatgctaaatactagtagtacaatataacgaacaaccaaccccgccaatgtttcactagcactcctatgtcattataaaaaaatgtattattagagtgtgttgagagaaggagaaatgagaaaataaaaaaatattatttttaaaagcttaaaaaaatattaatatgatttttaaagcaactttaccgtagttttttcttttaaaaaaattgcttcaacttcaaacgagagagcagtaatcaaacactcactaagaaaaacaaaatctacataattgtgtaaatcgccctgtcctccctgggacttgatttccttcaaaggtactcaggttttcgtctacggtggttgaggtctcactctccaaccgaccaccggccattccaatttcctagctagcacagtagctccaagtccttttccagccaaaccgctcctagaaaacgagaggtttccggacgctctcaccgccggtggccatcacactcgctgacaaaaccgaaggttggtacagtggccgtaacgctctcgctaatcaccatccactgctcatgctctctgctcttctcttttcccagcattgggtgttaggttacgcgcacatatcactgtatatataataccacactcatatcctctcggatgtgtcccctaacacatattctacgagacgaaattcagcgactcatcactggtctcattaaaatcttattgaaagtctacctgcatgtgcgtaatatacatgtacattaggatttaaatcctggtgggtggagtcatgtactcatgactctaagcaccatgtcacttatacttcccctaattgtttttttggtgtgatggtgagaaagtagagaaaaaaaaagaggtcgctttagcaattttggctgtttattttactactcttaacttttccttggatctatccatggatcgaaaggaaaggtctgaaaaaactctgaattctgatcatgagatgagatgacacgagaggagaggcagacgctgacatggtgacgtgcatagctcaggctcagattctgggatctttgagtggacccacgaggccataatatggcagtgccggcccaagttgggagttggtcatcgtctaaatgggccgaaactggatagttacctgaagactgcaccaattcatttctgcccagggagctccttttttttcctttttgaaaagaaaggagcttatctttgtttcttcagaaattcagatagttcagcttcagatggaacacttcttgttactacgaagcagcgaagagatgtcgagattattgccattttagcggacagtacatgaactgaattcaaaccaagctgacaaattgaggacacttttattcatcgatttgaaataggacagacggatggccgacgatactacagaaaaaaagacagtgagatttatcatcatctcaactaattgactgacacgtgtcgaaatggcaacaacacatattccctccgtccaaaaaaaaaaagtaaaccctgaatttctgtgccaacatttgactgtctgtcttatatgaaatttttttataattagtattttcattgttattagatgataaaacatgattaatattttatgcgtgacttatctttttaatttttttcataattttttcaaataagacggacagtcaaacattggacacggaaaccagggtttgtctttttttttttaacggagggagtaaccctgaacgtgtcgtgtctgattattttgtgcgtgcattcacgctctgctcgtacgattcactcactggctgccgatgctgaagtcgaagttgccgcacctggtcatggtgccgagtagcaagccgctgaacccgaactgccacttctccaggtcgaacaccaccaggttgtcctccatctgatgcccgccgatgatcaccgccggcgcggccgcggcgcccatgtcgacgaacgcgaagcacgccgcctcctggctcacctccaccacggcgctggcgccgacgatcgtccagttctggccgccggccagcatcaggtcgacgctcgccgtgtacgggccgatgcgcgtcggcggcagcgccgacttctggtagcacaggtcgaacggccccgccgccggcgcgcgcgcgagcccggccgtggccgccgcgaacgcgtcgcgcaccggccggtagatgtcggagcgcagcgcggtgtacggcgtcgccgtgctcaccgcgacgccgcctgtgccttggcgagcgctgagcgacagggcgcccggggggagggggacttggacgctgttcacggcgacgccgatgacgccgatgtagtaggcggtgttcttggggttcttgagcaatggggtgtacctgagacggtcgctgacctgctgcggcggcgcggcttggagccagaacgggccgccgccgaagatggccgcgccgacatcaccggcggtggggaggcacagtgcgaacttcttctccaccttcagctgcccggcgacctgaagcggcagcgacaatggcgcccgggagaggccagcgacgccggcggcgccggcggggagcgagcccagcagcggctgcggcgcgcacgacgcgacggcggagagccacacctggaacagcgggttcttgccgtcggtggcgttcgccgacagctgcaccgtggtaaggtcgccgtacccgcactggccactcgccgggttgtacgcggtggcggaacacgcgcagcgcccgccgtcgccgccgttgctgccggcggcggtgtacgggcagttggggcggtggttccggttggcgacggcgcacacgccggcgccgcacgggatcgtccggtgcttccccgggcacgtggaccagacgagcgggccggcgaggtcgaggacgagctgcccgccgccgttcttgacggaggcggtgtagagcgacgtcgaggggtccttggcgaggcgggtcagtatgggcttggaaggtggccggtgctggccatcgccggcggcgagcgcgcacagcagcggcgccgcgagcagcgagagcacgagcgcgatcttgtagctggacgacatggccgagtatgtttaatttgtgggtgacttagcatgcgtctgtatgcgtatttatagtggtttgtctacgtggacagtagaccagcagggtttacataaccacggttatcatgtgcaataaccttctcagtttttgaaaccaccgtatatatcgtgataaccgtcaaacccgattatcatgtacagtaactttatcagtttttgaaaccacagtatacatcacgataaccatcaaacctggttatcacgtgcagtaaccttctcagtttttgaaaccacagtatacatcacgataacagtcaaactgtgaggcggtgctaacttcatgtaaaacgatttggtaaacccttgtaatcactggattttcttttatttttcgaggatattggaacttcaactaggcgtgtatatgaagtctacgaagtacatctgcacgtgctgtttgtgctaattagctcagacaattacctcgtggctagtatcatatgggttttcataatgctaaccttgaggtttgcgtacgccacttgaacgaattcaccgatatctgggaaggatatgatattattcttgttagtcgtgacactcaccagcttcgattctcagcacctctcactagctagtcacgtttgtcacgaactcgcaattcagtattatccatggaccatggaccgttggatcaagcttctacggtccagatcgtgtgaacggttggcggtgtgctggtgttgggttgattaaaggtctatttgtttcagctccaacttttaaatctagatacagaagttgaatctgaaataaagttatgaagcatgctaaactcagctctactttttttttttcattttgtgagagctacattcagttctactatcatttaaggtgaaattgaaactatttggctgggctatagctccagctgtactagaccggacctaattcgtgagcctgggctttaactcggtgtaaaatgtgggtcctgtgtaatataatttgggcatgtcctgaccgttcgatcaaatttcagcggtccagattgcttcccgcggaggaaaacgttcatcctgatgatgtgctgatggaacgagagattgggaaaaaaaattaacgaagagagatggaaaaatgaaaaggacaaaatgaaaatataccgccaatggttcggagactaaaactccgaccccatttttcggctgggaaaacgtcgatcctcttttttttttggaacggttcggcgatcctcattccgcgctcgtctgatctcaatgcaatatgtgtgagagtgtcatatggcaatcacaggaaactattttaaacactcgggtggatgtccacccgttttttttgcatgtcatctaaatggttacgaaaaattttcaaaaaattgacataataggttaatatgtaatatatcactttacaaacatgcaagttcacattcgacttctgcaagttgtaacaaaaataacaaatcaaactctaattagtatacgtatattcacagtcaaatttgttatagttcaaattcgacttctacaagttataacaaaaataacaaatttgactgtgaatatacgtatactacttagagtttgatttgttatttttgtgacaactggtacaagtcgaatttgaacttgcatgtttgtgaagtgatatattacatattaacctatcttgtgaatttttttagaattttttcataatcatttaggtggcatgcaagaaacgggtggacgtctatccgagatattagaatccatcatcggcaatcacaagcttgatgctcaagtatatatggattttgaattgttcttcagagagatgtttgtagttagctaagctacatcgtcatattagattagatcagatcatccgagcaatgctcgcagaagaaaacttgctacggttgtgacatgaacatcaggaacaatatattactacactttcatatgacaaaactactcaagaaaatgctcagggggtacaaaaactgtctcaacgatgcatcaaagtatcaaacatgcaaaagactgaaggaatctgccgtcgcaagatctgtttatgaagtgccttataagctgaatccggagcccgagcattcaaggtgtgcattccattcctcacacatcacactgcgaaatttttttgacgggtatcacactgcaaaattcagtagtaagggttgcatttaaatgttaggcaaaggtgtcatatgaattttgcaaaataaacaaaataaacagttttttttcagagaagaggcattgtcagatagaacggtctaaatcctgtacaaattgagaaaaactcttgcgtcccaaacaagttcgtcaaaacctcggaaactgttttaaaaaatagtcaaacagtcataaaaatgcatgctatctaaatagacataaaaaatatgaaaaaaattgtgaagatagattaatatgtgatgtatcactacacaaacatgcaagttaaaatataacttctatgatccatatcaaaaataacaaatatatgattgtgagtatgtgtatactattcacagtttaatttattatttttgttatggattgtagaagtcatgttttaatttgcatatttgtgtagtgatatatcacatattaatctatcttcacaaattgttatggattgtagaagccaatgaggggatgtcccctcgagagcttataatccacgctctcaaaacctccttcggcccaaaggattagactgtgtttgtagccgtaattactatttggttgatcttaccgtttggtcgtttattccgatcgctaacccaccaacagtacgtgagttacacacatctggacttctgaagtactactaaaatggaagtacaaaatcagttcatctgatccccagcgtccccttctccagatcaaacagcagcagattgttctccatctggaaacctccgatgacaatcgccggcgagtcggccgccgccggcgaggtccccatcatctcgaggaacgcgaagcacaccgtctgttcgtccacctgcaccagcgagctgccgccggggagcgtccagttccggccgccgcccagcaccaggtcgatgttcgccacggcgaagccgagccgcgtcgtgccgagcgcggacgcccggtagcacgtctcgaacggcctcaccgccgccgcgcgtgggatacccgacgtggccgcgtcgaacgccccgagcagcgcgcggtagacgtcgggccggagcgtggtgtacggcgcgacggtgctcagcgtgacgccgcccgtgccacggcggacgtcgaggtcgagcgcgcggggcgggatgggcaccgcctcgaggttgacggcgatgccggtgacgcggaggtagtaggcgccattcttggggttcttgaggaggggcacggggttgcggcggagaccttcggcgatctccatgggcggcgccgctaggagctggaacggcccg

SEQ ID NO: 3313 - DNA, 8948 bp, Oryza sativa
ccacgatgggcttggacggcgtcgggcggcggcgatcggtggccgccattgcggtcggaggtggcagtgacgcgagcagaagcgagagtccgagccatgggagcacacgtgcgctgtgcagcgtaacgacgtcattctcgctgaatcggtggtggcctcaatggctttgatcaacgtcgcaatgtcctttgctcataatatagatgtgcgtactgcgaccgggatggaagaggaagtgtgtgtttttattatctatgtcctaaaatacttgttgttctagattgtttagtatatataaagtttaagaaataaaactataatagtccttaataaataatgtacggttagatgtgagatggtggatagagtagaattgaaagtgattgattattttgaaacatattttaaatgttagaaaagggttggagcaagaattatttttggtcaattacctcgtgctggattagcgtgctcaggtcagctcaggctcttctgacgatggagtagtagtggcattgatcagaccatgtggtttttttggatggatcctcgtttcgaagctttgcgtagcaacgccagtacgtggttcctttatccaaagtgaagtagtcgaagctctggaaaaaaaaatcgatgtactagtactccatcaacagcctcgtgagtcgtgacaagcagcagtgagtcggcgacgtgaaggtgtgatccccaaataaaaatgggcaaaaccgtgtgtggcgcgtgagcacgttttacagacgaggcccggcccaataggccgataaaagcctttgatacttggggccattttaaaccgttgaattggattgcttgccgcctaccttcaaaccagagaagccgagcatttaactatggaagaccatggatttcagcgaaacaaaatgcatgcagttttcacattaacacaaaggaaatggatttaggcaaattacgctacgacacactaaatttaactgcaagactcaagtgggtgtggaaacgctaaactttttaaaccatatcgaaagtgctaatccctcgtgctatcatatcaaaatcctctgcagttgaagtcacgtgactttatcactgatatatgagtccgatgatccctagacctacatgtctgtgacaaaggcaccgtgtatttgactgcataggatctcaatcccgcgctaccgtgcctacggagtcccccagctgaagttgaagttgctgcacgtagtccggatccagtaaagcaggccagtcgatcccagcctccccttctccagatcgaacaccagcaggttgtcttcaagctgaaaccctccgatgatcaccgccggcgactcgtccatcgccggcgtcggccccatctcgacgatcgcgaagcacagcgtctcctcgttcacctgcacgatcatgttggagccgaagaacgtccagttaccaccgctccggagcatcaggtcgacggtggcgagcggaggccccacgcgcgtccaccacatcgccgacctctggtagcaccgctcgaacggccacgacggcggcgcgcgcgcgatgaggcgtagctccgcgtcgatcgcctcgatcacggcgcggtagatgtccggccggagcgcggtgtacggcgccaccgtgctcagcatcacgccgccgtggccggtgccggcgtcgagggcgagggagtccgggggcacgtccgctccgcggtggttcacggcgatgccgacgacgtcgaggtagaagccgccgttcttggggttcctgaggtagctgatgtagctgagcccgttcgagaccatgccgaactcttccggcaccaccaggaggtggaacggcccgccgccgaagatggccgcgccggtgccgccgccgccggggaggcacagcgcgaacttcctctccaccttgagcgacgccgccacctgcgacggcagcgacaggggagcaccggacagcccagcgacgccgacggcgcccgacgggagcgaccccaggagcgcgcccggcgcgcaagccgcgtgcaccgggaacgccacggggtacagcgggttcacgccgtcggtgacgttcgccagcatcggcgtcgtcgtgacgtccccacgcgcgcactggccgttgagcgggttgtacgggtaggcggagcacgcgcacaggcccctgccgccgccgccatcgctgccgcggccgtcggtgctcgagctgcagttccacgggttgtcctggacggccgcggcggcgcacacgtcggagcggcacgggacggtgctgtgcgcggcgaggcacgtcgaccagaggagcgggccgccgaggtcgaggacgaggcgcgagccggtcctgatggacatggtgtagagcgaggtggaggtgtccttggtgatccggacaagtattggccttggtgcttggaacgcatcactggctagcgtccgtggcaacaacgccaataggatcagcgagaggaagagcgagaagtagcagcgtaacgtcgacatgacactgtacttttgcttggtttttactctgattaattacaccttgatttcgagagtgagttcgatcactatatatatagagcgagtttggtcaattaccgtgtgcaagttttcgatggattgcacctacgtaagtcggtaaatccgtaaatgtactgtagttgactctgattaatttgaagaagcacgcagccatatatggtaattgcattgctcgcacagtcatagacgtggtaaagtcaacctgaagtggcatgctgcagcctgcagggtacttgtcgaggaaaaccctcaatagcggggagtcgtgagacccccctttcgtgagttcggccgggggcggaggctctcctctcgttagtcgtttgctcgtccctacgactatcaggagtgaatgcacgcagtcggattatataggttcgggccgctatcgagcgtaacaccctactcctgtgtttgggattatgaatgatttttacaagggttcctccccctcagagagcgcacctgcgtctttccttctcaagttcaggttttctgggagtcgtcccccatctccgtgggtagggtcctccttttatagcttaaggggatgccacatgcgccgcctctacttaccctccatggggggaaccccactccatctttttgggttttcaaactgtgccttctctcggaagctaagcaataactgattcttgcgcggaacccggcgccgtcctccgcctgacacgggggtcagccctgtcattcccttataaatgaacgatgacatgcaacagcccctcatcgagttgcgctcggatgtgacgggtcatacccacccccactccgtcggggacaagggcgacgtgaggacatggtcgccctatccaacggatgtgacggagacgggccggtcacagaccggtcacatccgatgaacaggggttcgctaggcacgccgcacgtctctgcccttaccgtattaactgcggtgagggacagttggggcgtcgcacatttatggctgttcagcctgcgctcccttcttgctctttctctctctgccgcgtggcagctgggcgagggcctcggggcgaagccgcgggagagcccgagggggtgacgtcatgccccgaggcccctcctcggcgcttctacgactcgcgtggcgcgcgagtggggccaacctgtggagtcacgtggccagagaggaaaataattcccctctactccacatacccccgggcccatatctccgatagtactccctcagtcccacagtataaagggatttgagtttctgtagcgcccgttccgtcgtggcgcctagcgggaaaatgtaattcctaaaaaccctaatttcgaaatctgtttccttgcttattgtctagtgtccgtgccaattccggatctcaaatctccgatcgatcgccaagttcaatcccgaatccaaatccttcccaaatcaaatccctccgcaaaagtctatttcgcctccctcaggttcgatgggccgaatccctctcggcccatctccccctccctccccatctctctctctctccctctcccccactctgcccgtgcgctgcgcacgcgtgcgcgtgagccgcgccgagccgagcgccctccgccctcgctgccgtttcccgccgacgccgcctaaatcgctacgccgcccgttgcttcccgcgcgcacgcgtgccatggtggccgaccggccagtcgccgccgccgtcagcgcctgccgcccgtgtcgtcgctccgctccaaaccgcccggccgtcatcgccgtcgtcatcgccttggccccgcccctcctcgcgcgtgcttccaagggacggaggcagagctccccccacctctgccgcatcgccctctctccctcctccttttccccaaagtggcaagggggcaagccccctttctctccctctttttccctttttcctcccgccggcgtcatcctccccccctgtcgccgttggggccgcgaccgccgagcgctggctcgctcccttgaccgcccaaggtcggtttccaaaccaacattgccgccctataaacccaggcaccctcccttcctttttcccctcccaatctcccccgtttttcacccacgccattgtcgtccctctcgccgaccgccgccgtcgcgtgtgccggaggagccggtgcgcgctaggacgcggaaggggactccgggtgctcgtcttcttcctcttccccggcccgaggcccggagagataactcccgtgccgtcggcctcatgtcactgcgccccatcacccccgcacggtagtgcctctctccgttctccctcctcgttccatctcctccccttagactcgggtagtagcacgagtagcctccccgtagctagctggcgccgccccgaccgttgccgccggtcgctgtgtgctcgccgccgtcgccgcccgtgctccgtagcacccgctcgtcgccggcctcgctcgacgtagctccgcccaatcctacgctagcaacggactcccggagtcgcgtagatgctctagctcgcccgaatcggtctcccgtcgcgccatcgctgtttcccccttctcccgccgccggttgccgccaccgcaatccgccgccgtcgagcatcccccagcgaatccgagccgttggctcgtctcccctcgtcccgagcaacttcccggtgtgctcgctttcgcctgtatcgccgggttcgctccgccgcccgccaccgtcgtccgccgtccgttccggccgacgtcgtcgtctacctcccgccggcccgcgtggcagccacgtaagcgccacgtcggcgccacctcggccgcgaccgggtcaagctgaccccggtccgccgctttccctccgccccactcgcgcgtgcggtccaccgcgagccgtgaggctgcgcgtggccccgccgcaccgcgtcctccgcgaaccgcgcgcatgcgctgcgcctcacctccccaaaccctagcacgccccgcgtgcacctcgctcacggtgaaccgagtcgccgacaagcgggtcccacccgggaccacgcgggatggacccggcccaccggctctctctctcctccctgcccgcgcgcatgttttgggccgccttctcgggccggccggcccgttaagtttgacgagccgcccttttctctcgggccgcgccccagccgcccgaggaaagtctaatttgcctccctccttcttttcttttcttttcttttttcaaaaagcatttaaataaattctttttttttaccaaaaatccaataatcttagaaattcagtatcttcccaaccgtaagtccgtttgactccgttcaacttccaaaattctcaaatctcgagatctatctaatggcatgcttagaggtcaataatagggctttattttcgccgtttgctgagttgtcccgtttcgcgtgtagttccggagcccgaagacccgcagtgcgaggatttcgaggatcaagctcaagatctcgagcaaggcaagccacccttgaacatcttgagcctatatttgaacttaattatgttgcttgaaaaatattatgcattgataggattgcacttaatctgtttgcccagtctgcaaggcagaccgatgggcctacctagctcattgcgtctgatccttcctttgttaattgttataccatgttcccttgtaaccacctagttgcgcctcggtaatcgtgcactctgcacgagtatcgacggtcgccttcaaccttaaaatctgagaaacatcttgggtaaaacttgggttttacaaaagacttggaaaacccgacacctgggtcggtgcttgcgaactaaatgaatttccaaaatcgcggaccggggaacgtaccgggtgtatggtttcccgctcttgcacttaaggaccgtttccttggaatttcatccgaacataagacaagtgcgaccacatgggtggaatgggacacccctggctgagtaactagctaaacgggggagccatgatgccaagagacatgtggattcaacggggtggtgtcggggagaacccccgggtttcctggcacagtatggtctgggacctaatctggtgttggtttgggacccctctcgttggcatatggtgaacctgtgtcggctttcgaaatgtcttgtcatgaaagccttaaggtctctagtcgtggctgttctgcacgggctggatgatccgggttagtaatgttgtgtgggtaaagtgtaccccctctgcagagattattaaactgttcgaacagccgtgcccacggtcatgggcggatgtgaggtgattcctagcgtagttttgtttgactactgctttgtgaaatttgctgatgtggtttgggattgatgtttggaaaatctgcggctgatgggatcagccaggcccgggtggccgtttgaaagctgttggccaggtgccaatcttgatcaattcaaaagactgatacattgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttattttccatggcttgctgagtactcctgtactcacccttgctctatataaataatccccccccagttgctgaagaagatgaagtggatcccgctgacgaggagttcttccaggagcaagtcggctacgatgagttttagggtttcggcctagttcccaagtcgcgcatgtgatgtgtgatccaagtcttggcttccgcttcccttttgtaatgcagttgtgagctcgggatctgtccgcagcccaacatgactgtactcctactctataataaggagacctctgttgctgtgatattctgtcttcctgtgataccagcactgtttcctgggactgatatcgattaacaggttaatttggagcgtcacgggctagtcccgctcggggctagttcggggcgtgacagtttttacttgcaatgtttgactactcgtcttattcaaaatttttttgcaaatataaaaaatgaaaagttgtgtttaaagtaccgtggataataaagtaagtcacaaataaaataaataataacttcaaaaatttttgaataagacgagtggtcaaacgttgcaagcaaaaacttaaaatccggggacagagggagtatatacaacacttctccctacggttgactaatgtgacttgcgataagattggctgacttagataatcacaaggtgaaaaggtcaaattttgcaatcaaagatgagctagctgccggccggtttaggcaaatctgggcagcaaagcccgttagattctgcgcaagattgcacgtgtctgcagtgagcatgtatccaaagccgctgatcgtgtcaagcttcactctcgatctactcctccaatccacaataaacaaatctaatacattcacgatataacacattgtaatgcaatatgattcgtagtactttccctaacgtcccatgttatgtatagttcattttgggatcgagtgagaattccattgaagtgatagtgtggtactagtactactataaaactatagaactatgtgtactgcactggaagcacatatgctcttgtgttgatctgaaggtaacacaagatagatggatcgatctaaagtatgagcaaatacgaaatcgcattgaattttatctgataggaaaaatcgcaatgaatcttgatccatgcaaaccagcacgacctccataactcaagtaaatggctcacaacaatctatgacctctataacttaagttcttgctagagggccgatcacagtggacacatggttctcttattcaattttagtactaactatgtactaactgtaaaccattaggcagcgacagtgaagttgaagttgctgcaggtggtctggagcccaaagaggaggccactgaagccgagctgctgcttctcctcgtcgaacaccaccaggttgtgctccatctggtgcccgccgatcaccaccgccgggccgtacccgaccttctccggcctcatctcgacgaacgcgaagcacgccgtggcgtcgtccacctgcaccagcgagttgccgccgaagatgtaccacgccgcgccgtcctcgaggttgatgttgatgtccggcacggcgtagccgagccggttcgagccgatcgtccggctctcgtagcacagctcgaacggcgccaccggcggcgccaccttcttcggccattgcaggatctcgtcccacgccttgacgaacgggccgtacacgtcggggcggagctcggtgtacggaaccatggagctcagctggacgacgagtggcgccccgtggttgggtagtggcccctggtggtggttcacctcgatgctcttggccgtgatgtagtacccgccgccattgccgccggcgagctccgggctgcggcggagcgcggtgtag

SEQ ID NO: 3314 - DNA, 19067 bp, Oryza sativa
  unsure (1)..(19067): unsure at all n locations
aggcgaggagggagcccggcgcgcagtaggcgacggccgggaaggtgaccgggtagagcgggttgctgccgttggtggcgtccgcggcgagcgccgtgcgcgtcaggtcccccggcgcgcacctcccggtgacaccgttgtacgggtgcgccgtgcatttgttgccgtagcggtagtcgccgccggcgccgccgtactgcatccagcagctcggcggcgtgtagtggttggcctccacgcactcgcgctcgtaggggaggacggtggagtgggaggcgtcgcaggtcgaccagacgagctcgccggagaggtcgagggcgagggggtggccgtccttgacggcgatggtgtagagcttggtggcgccgtccttggtgacggccgtgacgaggggcttgccgccgccgccgcttgccagcgtgtgccacggcaacacggcgaggaaggagatgaccaccaggagaagcggtttgcctttggatttggcctgcggcgacgacatggtgtaccgtgtatatatgtacgtgagttttgttaggctaatcgtgattagtgtgtggtaatctgatgtgatttgatgaatgcatggtttgctctttatatagatcgagctagtggtcgtggcctgtcaggtagtaagtactaattttttgttttcaatttttgtatcattcaattggaagcttcgccatgcaaattaatatgcaatcgccagatgcttacaccgttacacgtgctttaatgtgagcatcatgtatgcatgcacggcgaataaattagccctggagaaggcgtgacggtggcatatatacacgtgaacgtgaccgatggcaaatagtattgcagagaggaaatataatgcaccatgcataggaaagaaaaacgagccatgccgttgttgcacggtggtgatttacatcggagtcggcaaacgaagttgactcgtgggcagtcggcacgtggatgggctcgatcgagattcgagtgtcctagttctatagaactataaacgcgaatttattttatttgtttcaaatatagatgaaatgaatcaagcatgtgaatcacgtactacacctcactgcctcagccatcttgtcgggtatacacacaaaataatgactccaactcattttctgacttcttccttttcgtccccgagggagtagaactcaagaaaacaggttgattactcagatagttgaagctctcacagtacaatacaatggaaagcagcccagctgagctgatggccgagccaacagaaggcccttccactcatacattccggcccaacttcaagcccatgccatatggcttcgaccttttactcgtcgcgttctttagtaccgcaccgcttaatcacatcatgcacgaccactttatatagtcctccaatgtaaccaatcgcaagcaatgacgaaaagcaccagcactggtgggtccagtgcattctccatatatttaaggacgtgtgcgctactgagctttcataagtttccttttgcattcttatcttttgaaatcattcgtcaaaaaatggtaacaaatcacaattcataaaataaaaattgtttcttttatattttttgaaaccatttgtcgggaaaactgtaacagaacacaactcataaaatgcaaagtgcacctacgatatacagccttctggagtactttcctccagttaaagaccctatatatggcctatttacttgagtgccatatcaaacacttctgtaaattgaccgttcaaaaaaaaacacttctgtaaattgagctggaaatgaagcggtctctcttttctttttttgtgagaagaaaagccctgtaaatcattgcctcaacacggtcaaactaagccaagccaagttgacctcacaacggtcggactaagctcatcctagtaaagcctatatcagacttgggccattggttgttataccctacgagggacccctagcacgcacactcgctacgtttttagtaccataccgcttaatcacattatgtccgaccggtttaaatagtccggcatggagcaagtacatcaccgagcaatgacgaaatgcatcaacgctggcgggtccggcgtattcacctgatcatttaggacagagattgtgcaccactgagctttgacatgtttttttatcttcgatttcaatatgcatttttgacaacgacttcagtatccatctgacgtaatctaggaatttttttcttcaatcccaggatgatttgacagcatctggtgatttcctcttcaattttcaagtccagtatgtattgataatgacttttaactttagcatctgatgcgatctaggccgcaagagagaagttgaagttgttgcagccccgttcttttactattaagattagattttaacttaattttcattagtatgtttttcaaacggttgaaacactgtgtcttatgcggaagctttttatgtaaaagttgttttgctttcaaatatattttgaaaaaaatcaattttaaatttataataataattaatactcaattaatcatgtgttgacgattttctcattttgtatgcctacacttaatcttacggccttatcttttcgcttgtgcttatgcttattcttatcagccaaattttgatttttcaatcttaaatttgaagttgattttggggttttttatcgaagtttattttcagcctttgattttatatcgctaagaacacatatatataaaagtttatttataattttttttttcgtttgtaaatacgtcgttttgcgatggggctgttaatcttcgtagtatacatttacgggtcaataaatttgataattcgtgtatgctgtagtgtgtcgtagcccgtaccacatccaacacttctcacaatgggctggaaatggaaaattctttttttttttgaagaggcgcggcccatcgttgcttcaaaacggcagggcaaagcccagcctaactaagtctgagttgtctctgttggatgtcaccttccggcccaaccggaagccctggcagtcgcttcgatttggggcactagactttttttagtaccgtattgcttaatcacattatggccgacctgtttaaatactcccgcacgtagcaattgcaacgaagcaatgacgaaaagcaccaacaccggcgggtccggtgtgtctacctgatttaaccattcgggacaagatgggtgtgccttccgagctttgacgattttttgttttccccttcggtttcaagctttcagcttttaccttctttttttttcctgttttccttttcggtttcaggctttcagcgatgcattgatcacatctcagaaatttctgagtcagtaacaaatctgtggcctttctccattattcattgaattgtacttgtaacaaaacacaactcataataataatgaaaaaaaaatggatgcacatctgatgcatatgtgtggaaaaaataaggatcactaacgtatacactatatagtcgatcgactataaccttcctctcttcctctgccctgaatgtcttagaccaccgagcagtggtgttatctgcacgggctacttatccaattcatggtcagatcgagtttctagttgaatgcagtgcataagagaaagctgaaggacataaagtttagaaaattagtaaatgatgtctaacagatctctccaacaagttgaatcctgacgacatgtctttcttatctgttgggtttcctgtttagccccatatgtgttgaacagaatcgtcttggcgaaaagcagttctcattcccaccgccggatcgatgtcctcacctagtctggaatttgaaggtctgatgcaaaatacagcagatgatgctaatgctaaattctcgcttcctcttggtgttttcaccagatatatggggtgctaaaaactggaaggtttttttaactgaaaggtcaatatgtcattcaggactttgtttccacaaaaaatgcaggacctgatggggttcatgtagcatgtgtaccagacgaacaccgctgtaaactgctgcatttcagcttgaattgcttgctatgtttgtgggactagttcaacaatccatggtttgacaggttgttagaattcatcagcagttacacttattttagaaccgagggagtaatcttgaacgtgatctttccctttctttaagggaaaaaaaacagtacagtgctagttcaaattaactaagcatgtgaatcacaaatctcaatcatctgcgaagtgtaccatcatttctgcctttccccccaagtggtagatactccttcaggtgtgcagggcaattccaccgcgttctgtcaattggactggaaaggaaggcccggcccatcgttgcctcagaacggcaggactaaaccaagcccaacatggcccataactgcctcgcaacgtcggagttaagtttagtaccgtactgctcaatcacattacgatcgaccattttaaatagttccgcacgtagcgattgcatcgtcaagcaatgacgaaaagcaccagcaccggcgggtccggcgctctacctgatattattcgggacagatgatgcaccttctgagcttaaaccccaatttttttccctgctttcccctttgcttttagcttcgacatttttttttcctgttttcctcttcgatttcaggctttcagtaacttcgctttaagctttgacattttttttcctgtattcctcttcgatttcaggctctcagtaacaaatctgtggtattctccattattcatcgaaatgtacttgttacaaatcacaactcataataataataatgccaaaaaaaaatgcatgcacatctccgatgcaaatgcaagctatgagctcgaggaatcgactcgatctaggcggcgagagtgaagttgaagttgctgcaggtggtctgcctcccccagagcaggccgctgaatccgagccgctgcttctcctcgtcgaacaccaccaggttgttctccatctggaaccctccgatgatcgccgccggcggcggcgggctgcccttctcccccttcaccttcaccaccgcgaggcacgccgtgttgtcgctcacctgcgccatcgagttgccgccgaacaccgtccagttcttgccgccctccagcaccaggtcgatctgcggcacggcgtagcccagccgcgtcgaccccagatcgcgcgagtcgtagcacagctcgaacggcgccgccggcggcggcggcggcgtgacgcgcttccggccggcggtggccctggcgaacgcgtcgaccaccgctcggtacacgtccggccggagcgccgtgtacgggatcctcgtgcacagctcgacgacgagcggctcttgggtgtagagctgcacctgctcctggttcacggcgatcttggtcgccgagatgaagtatccggggagatccttgttgcggtggaggggagtttcgccggcgagcgtcgccgccacgtcgggacgccccggcgggaggaggaagagcgggccgccgccgaagatcgccacgccgtcgccgccgccgccgctggggaggcagagcgcgaacttgttggcgaccttctgcgaccgcgccacctgcgcctgcagcgcgagcctggtgcgcgcgagcccggcgacgccgacggcgccggcggggagcttcgcgaggagggaatccggcgcgcaggaggtgacggcggcgaacgacaccgggtagagcgggttcttgccgtcggtggcgttcgccgacagcctcgtccgcgtcaggtcggccgtcgccgactcgccggagaaggggttgtacgggtgggcggtgcacttgcaccggaacgggtcctcgacgtcggcgcggccatagccattgtgggggcatcccggcgggtggtagctgtgcgcgtgcatgcagaagtggtggtggcactccagcgtcgggtgcgcggcggcgcacgacatccagacgagcgcgccggcgaggtcgaggacgagcgggcggccgtccttgatggggacggtgtagagcgaggtcgccgcgtccttggtgatggccgcgacaagcggcttgccattgccattgccattggcactagctgctgcccatggcaacgacgaggccaaggcgacgcagagcgagacggcgaggaggaggtggagcgacattgctggttattagcctgggcaaactagctagcacgcactgtgaattggtgtgtccaagtgtgatggtttatatactcagtacgtcgcagcacctgtgcagcacagcagaatgcgtgtgacatttctctgctatcgctggggatccagacctggtgttttctaaattataaacagtttttatctccagcacgccatgacatctagttagcaatcttgatctaggccagtttagtgtgctcgggtgagttaagctatcagctattacatgtgcattaattgtcactctgttccatcacatgggtgattacagccatggaattgagtatcccaatgtcggtgatcacattttcgagcacgtagtacttccgaagtggtggtgctcatgactctgagcgcagagtgcaagcgaaggttgcttgagtgaccaaaaaacttgccaggtcgtgacagagttctacgcattgaaaacaacgagatctgcattgtttagttgatcccactagcatacaaatcggatcttggtcaatgcgcgctagctggaggcatcaaccatttccatcaagtcaaacgcgtacatgggttcgagaaattccaccccgttcgagatccatccaccggcgcgagcgccagatgccatccaagaaaatccccatgtttcgtgtaggattcgcgttgaaattgtagagatttttaggctctcgattgggcggagccctgtgaattccggtgcgcgcggccgcgtgttctcccgaggattttgaactcgatctgccaaactgggctcacgtggactctgctaggccaaaggcccaattgtacaaactgggccttttgtgcatcacgtcaggtagcgagcaggcctttgtgaggcccagatttcagggcccaaaacggccttcatttcacgttcaaattccatcctacggctaaattaatccaagaacatttcatcagcgtgtttaatccgatatcaatttcaaatgttatgaaatgataggcaaataaacgataaataacaatagattaatcacataaggcacgagatttaacgtgaaaaaccctcctataacataagagaaaaaaaccacaggcgtcagccagcaaaatatcttcactatatctgagcgaggttacaacgccgcacggcggcttacaagaggtatatatatatatgtggaaccttaaaagggacgatgatccgtatccccggcctaaccctaccggtgacgggacgatgatccgtacccccggcctaagcctaccggtgacgggcctccgctccactacgacataaattggcctctattaagtacaaataaatttggatcacaactcaacatcaaatattcgcatcacgtggaacatttttcaaatactgcatgtagatggtagatggactatatattaaaagcaaagttcttaaatgggtgacagatacgggcatatggcatgccggacaccgacattacagttacagttacatggccgcgaaacagtggtaagtaagtaaattatctactgagtcttggtgaaattgaagttactgcacgacgtgtagaacggcagcctcgcgaacccgagccgcttcttctccgagtcgaactgcagcaacatgttctccatctggaaccctccgaggatcaccgccggcgaactggcggcgtcgccggacttcatctccacgaaggccaggcacgccttgccccccttcacgtccaccatcgagttggtccccgtcatcgtgtagttcttcccgccggcgagcatcagcctcaccgccggcacaaagtagccgatccgcgtgttccccagcatcgacgccctgtagcagagcgggaacggcgccacggcggcgaccttcgcgtcgctccggttcaggcccttctcgaactcccggacgaacgggcggaacacgtccggccggagttggccgaacggcacggcggtgcgcagcgccacgccgccggcggcgagcgcgccgctcgggaggggtagccgcgcgtcatcgagggcgatggcgttggcggtgacgtagtagccggggttgtctctcttggcgacgagcggggtgtagtccagcgtcgtcgtgaagtccggcagcccttcgccgaggtatatcgggccgccgccgaagatggccacgccctggccgtacccgagcctcgggaggcagaggaggaacctgccggcgacgccctgcgacgacgcgacctgcgccgggagcgcgaggccggaggcggcgaggccggcgacgcccgtggcgccgcgcggcagccgcgccaggagcctcttgggcgcgcacgccgccacggccttgacggagacctggatcagagggttcttgccgtcggtggtgttggcgatgaacctcgtgtgggcaaggttcccggcggcgcactgcccggtcaccgggttgtacgggtacgccgtgcacacgttcttgctgcagtcgccgccgccgccggtgaccttgcaggtcggagcacggtacgcgttggcgaccacgcacgtcgggtcctggcaggacagcgacgccggcaggtggtcggcggcgcacgtcgaccagacgagcgggccggcgaggtcgacgacgaggttgtcgtagtacctgacggggatggtgtagagcgaggtggccgggtccctggtgacgggaaccaccacggggtcccgacgacgaggcgccgcggcggagcacgacggcggcgacgccagcagcacgagcagcgcggcggcggcggcggcgaggacgaggttgccgtttcgtggcggcatcttgaacgatatgggtgatggatgatgaatgttgtacgtagctaagcttgtgtgtgtcttggtgcgacgcggccatttcttctttatttatagtacacgtgatgaagtgaagctgcaaatgccacacgttttgcaaccaggctggactccatgaagatgaagggagagttcggctttggtcacttggttaggagttaggacgcaaatctggaacttttgttgatgggaatgtggtacagtgggacgtttctttgtcacggacgttcccttctgttggattcaacgattgtttattcactgccgtttgtgtagggtaggaagttggtgtagcagcctgaatttgacactggggacacaggagatcggtttcagaattgcagaggcagcagcacacagattttgacactagtgagattgggtttgtttgccggttcaattcagtgtctgctttgaacttgaaggactgcaggttacaaatgtgcagtaagccgaaaaaataccttccaaacaggccggtcattcctgatctcaagaatttacaacgaaggttgtgtttagttcacgtcaaaattgaaattttggttgaaattggaacgatgtgatggaaaagttagaagtttatatgagtaggaaagttttgatgtgatgaaaaagttgaaagtttaaagaaaaactttaaaactaaacatggccaaagcagattgttccgatctcaacgaacgccataacgcaggcatctcgaacgcatctccccgatctctcaccacaacagcattgcaatctgcatcgactgcgaaaatctggattgattattgggggttcagacttcagagctgctaccatgtcggatcttgcgatggagtaccgagcaatacgcggcagagtcaacggcgcaaacacagcacaaacaacacaaagctcttaacgaaaactcatctcatcttctcgcgcaggaacagacagtgccgcgccgacacaagagtcttctccccaaacacgccacgggaccatcaaccttatcttctcactttgccaagacaaatcgaatcagatgcaatatggtttagtacttcaggacccctttcaatcgcaggattaagaaaacagagaaataggaataacgtaggaattgaatgccacacttattgaattcctatgggattttgaaacacgggtgtagtttgattagcacacagaaaaaacgcaggaaacttagacacatgaagaggaaaacatgaggtgagacctcatgcacctcatgcttatttttctccaaaattgctctagtaagattgctctagtaagtttcattcaataggaatttcaaaggaattgatagaaaacaatcctttgtttcaaaagactatagaattatttcccataggataaaatcctctagaatttctatggtttttccattaattcaaagggcccctttgaatcgtaggattaagaaaacatagaataggaaaaacgtaggattttaatagaaatgtaagagtaaaacagaggattgcaaaatgtaggaaaaacaaaggaatgaccgtttgattgaaccacagggaaaacacaggaattagatgagagatatagacttaaaggaaagttagcaagaggttgaagctcttgctaaatttcctctaaaatctctataggattgtccattccataggaatttcaaaggattagatatgattcaatcctttgtttcaaagggcttcataggaaattttcctataagattgaaatcctctaaaattcctatgtttttcctccaaatcaagagtcacagtttgactaccaaaagagaagaaaaaaagatactaatactatggtttacgtgttagagcaaaacgcattcacggccattcaagatatccacttggtcccaacactgcacaatcgtaatgcttgtatcttagttcaagcgaccaatgtctcaccaatacaagctcttattcaaagttacaaatggtcacgacaagttgacaacaaaaaaagcgagaattatatccttattttgaaatttgaattatagtggcaaacggtgagcccattttagtttcttgcgaagttgaagttgccacaggtagtcctgatgaagaagagggtgccactgaaccctagcctggaagcggcctcgtcgaacagcaaaaagttgttctccatctggaacgcgcccacggtcaccgcgctccgcgccgccctcccgccgtcgacgaacgccaagcacgccgtgtcgcccgccacctgcgccagcgagttcgacccgaacaccgtccagttccggccgccggacgtcacgaggtcgatcggcgccaccgcgtagccgaccctggtgaaccccagcgcgctgctgttgaagcagagctcgaacggggccacgctcggcatgcgcgttatcctcgccgtcgccttggcgaacgcggcgacgaacgggcggtacacgtcgcgccgcaggacggtgtacggcgcggccgtgtcgagcgtcacgccgccgccgcggctgagcgcgccgggagggaggtggaccgcctcttggttcatggcgatgccccggagcttgatgctgtacgccgaggggttcgtcgggctccgggccaggtcggtgtaggagaggacggtgctcgcgtcgaacagcgtcggcggcatcaggttgtacggcccgccgccgaagaacgcgacgccgggcgcggccgccgtgctcggcaggcagacggcgaactgccgcttaagcgacagcttcgagtagagctgggtcggcaggctcaccccgccacggccgaggcccgcgtcgccggccgccatggccggtaacgacctgaggaggctgcccggcgcgcatgacgagacgacgccccggacggtgacctcggaggtcagcgtcttgccgtcggtggcgttggcgacgatgtcagcgagcgtgaggtcgccgacggcgcgttcgcccgtcaccggattcgtcgggcgggcggtgcacgcgcgtcctccgttgttgcaggacttgtgcgcccccgacgcggcggcgcactcgccggaggagcacgggacggtggggtgggagggtgagcacggtgaccacagtagctgtccggagaggtcaagcaggtagttcttgttggagatggagagcgtgtggagcccagtcttggtgtccttggtgatcggagctaccaaggcttggattgcaggagatggagaagcttgcaactgcacaagaatgaagaagatgatagcgagaaaaaatgcttgggaaatcatagccatcttgatggtattgtagctgagttgtgtggttgcatgtaaaaggtacagacatgcaatgagtactagttgggatcttgttgagtttttatgtaagatcaagggtcaaagcttgcttatcctatataaaaacgcgcttgcttatcgataatataagtatggttgattagtataatgatttgaagttctgaatctatttcgttgtacagctagctacagtagttctacttcctggttatgtagccagtggtatttgaccattctgattgactgaagttatatatacatggatttgttcatttgataactataatttgttcgttattatttcaagttatatacttggattacgtgcgtacaactgcacaaattaaatcctacagttcactgatatgatacgcatgaattaggtagggcaagctcacatagtcgaaggggaaaatggccaatccatttaggacaagaatctgttgattctcgaaacggcccagagcaaaggcctgttcgaattcgctgccacacaaagcccattgcatcttaacagttgaatcatcatgtgattatttgttctgttctatgttctttatggtgaactggaaatgcaatgtataaggtctcaatgcaaattagagcttcagtccctgagagcaagctacacggttagtcattactggagagatgccaaatgtgctacaacatgagtagcaagtgaaaactgataggacagaacatggtttaaagcagaagggcacaataatcattctattcgtaaatgagaggaacaaccaaagaaacacagtacgggggctgcgatatagttaccttaagatggcagcatattcagaaatcactggaatagacatgcatgtagagcttttcttcgtcttgcctctcttgtttatgttctctgtcctgagaagaatgcccacactctgccgtgttctgcagaaattatgacatacgattaaatgattaatacgaatcacacctgctgccgaaaatatcacaagttggaaaaaaactgacaattcaaaaacatgcacagctagcgagggatccgttaatccccgttaacacaaagtattcgtacactaagcagtactcaaatgaggcatcacaggcacacaacacactaacttggcatgcaagagaactgaactaattgcacaactaagagatagcacctaagaataacatatatcatagagaagataaatattatttgctgaattcctaggtcatcaaatatactgctgaagaaaatgcaaatgaaatgaataaatattactgggtttttgggaggttccatacctttgatccttcggctgtttgtcccggtatgaatatttcattattaatatgattctagggatgtaagaaatattgctggcatcctccccttggcacctctcaatgagtcttggacagttccaaatgttatagttccttcaagctggtatggttccgtatgctctccggtaaacatgtcatgttgggcgaatcaaagatgttaatttgtttcagacaaatgaacttccctatccattccggtaggctactgaatcctcccaaccatagctcatcaagagcaataagattcttcatgctttcaggtaaatctgtcaaatcgggacaaccttggatttcaatgcattttagcgaagcaaggtgtccaaacaattctggtgatatctccagcccttcacatccctccaacagcagttctgagagcgataatattcttcaagcgatcaagtggaaaagtcaccttggcagttctgagaagcctcagccattctggtagcgtctccagcccttcgcatcccttcaaccgcagttctcttaaagcggtaaggttcagtaagcttttaggcagagatgttagcttgggacaattaatgatggtaatgtattcaagggaaacgtgctgccccaaccattctggcaacatttccaagtcctcccaaaaccccaattctagtattctaagagcaggagccagctgcaaacatattttaaggaaataaatgaggagagagaagagcagcgggctacagatttgtagccagctatagcacggactccaagacgcagtgtgtgtatgacagatgggaccaggtattaatagtgtagtacataactattgtatggatgggctattatattggctataattgaattggagctagtagttggctatactattaaacttgctctaagagagagaaagcactggatgacatcgggcaacgtccgcaagccgctgcaacgatgtacttcaaaaatctcaagggtggcaagtctgccccacctgtcaggggaaaagtggcaattacctatgaccacacgaaaaggaagagtggaagacacaaggctcctgaatcctcgttctggcaacacctcgtcgctactgtccaagtaccagttcatacttcttgggggatatggtaggaaactcaactttgggcagttatctaccttcaaaacatgtaaattagggattaagaactcttcatcttctttaccggaccgtgttgtccaccactcttccaagttagtcattctttccaaccaaataactcttaatttcttacagtttccttcctctccatagaattccttgccaattctcctaatgctgggcatgttattcatcctgaaatgtcttaggtttggcaactggccaaatgcaggaagagaatcacatgttgctaaattacagatcctaatgcacatgagataagggagataggaggatatgccagtcaaccaggatgggaaatccttgcacatgtacccatccaacaaaaactcttcaagagtccgaggaggtatgaggttctccagcaccaatttatccttgtccacacttcttgtgccaccaagttcccaggaaaattttaaccaacgaagctccaccatatcccgcaagttagctttcctagcatcttctagccgctcaacattttcaagatgtctaacttccagctcacgacaacgcagtctcccaagctccactatactgctgaaatcagcattttctatctcatgcacatcatgttctacagtgccaggcaaatttaaatgttttttaataatttgagtcttatgaaacacacattctgatcctgtagcagtgttaagcagggtgagactactcatattactgatactatctggcaagccatgcatattataacaaccagtaagatccaggacttgaagacgaaggtcaccaagtgaagatggaagactttcaagacttacgcaatatgacaaattaagatgcttcaaattaaacatgttgcataatgaccagggcaatgactgtagcttagaacaacttgtgaggttcaaagactggagctcagagagatcaccaaagcattcagggagttgtatcagcccatggcagtctgaaagattaaggtatttcaaatgcttaagttggcaaaaggtttttggtagcacttgaaccctgtagcagtcagacatatccaaaacctcaagtctataaagattaccaagatcttctggtagttgttctagctcatggcagtctgagaggattaggtgctctagagactcaaggttaagactatctggaagtttggttagctttgaacaacttgacaagtttacaaatgagagtttagcaaggctaccgaatttaccagggagcttttgaagagcacaacaacctgatatgtctagatgctgtaagcatttaaggttgttaattgattcaggcaactcttcaagcttagcacacccagataggtttagaaaatatagctcaacaaggtctgtgactgatgacggcagtttattaaggttactattccttgataggtccaaataacaaagtttttggaggctaccaatgttggcaggcaatatttcaagagagcaattggagagaattagactctgcatattttgaagtgtgtggaaagatttagggagggatataataggaaagcctgagacatcaagataccccagcaacatcagtcgacgaatggaagatggcaggactggattgcttggagtagattgctcttcattggacaatccactcaggtccaatatacgtatgtaactggtttgagagaatgcttttcggggaagttgcatttcaggacattctctaaaacagagggttcgtatcttgcagggtatatgtttaaaaatctcagttcgcttatggtagttgaccaactgtgcatgtcgacagtaatgctcattagctttgtcccatgttgttggtttgttggcatccataacaaggacttcatcagcagcaattatttttgcaagatcatacactaaatcatgcatggtgagctttcgtggagctttggcatgcactgggctaacctgcaaaaatataaagcagacattgaaattattaggtaggagtatcaatgaaatacatgtcttttgaacagctttcatggatgtcgaactcttacatgtacagattgagaaatggcaaaatcaaagaaacaagacaaaacagattacaaacacatttatatctattattctccaggctgtcaaaaaacacaatgtaatttgtactgcacatagaccaataggaaaataaaagaagatatttacaaggaatgcacatttattttgtgttggaatatgaaatatggcatgtatcagtgaatagactataaaatactataggtaataattagggttacaggtgataataaatactcactacagtctcaatggaaataaataggggctatattacgaaaggtattgcaacccaatttcaagcacgagtatagcaaagtaaaaatataatatatattgagaataagtgtaattaaaatagaattatgaataaaaaatgaagatattgaaatgtttggttacgaatgtttgaccaatcatgcataaaatattctatcagaaacatatgttcctagcaagtaatgatgaactatctatgtaaccattacttgtaagttacctacaagaaaaatgtaaatataaagtcactgtttcattttactagcaaggcatactgccatacccccaaataataaatatacagtgcatgaatggccaaacaggaacttaaatacttactgatgaagacttggaaatctgaagaaaggacatccccagaagataatcaatacaactttgaccagtatgccttgcttgaatgtatccaagggcgctccattgcaggatcaggcggtcactgtccacaacgaagcccttcgagaatgatgcaagacatgtaaagcacattttgtagtttggcttcatgtagtaatagctcaacaagacgcgttccaaagtgtctcgccgattatctactatgaaatccaaaacaatctttctgtctcttatatctctccatgcctcaacggtcctttgctcagacattacttgcccaagagcattagccaccagtggtagtcccccgcacctcccagcaatttgccttccgatttcctctaagccactttgatcatcatcaggtccaaatattctttgcttcatcaccttccagcagtcatcaggtgataaaacatccaaattgatatgatcggcctcatgcacagggcatattttccgctgatttgcaagacaaccagtgtgtagtacttgcactacacttccattgcgtgtagttactataatcttgctacccttgccgccatgttgtaacatctgcttcaacttttccaaattttctccatattcttcccagagatcatctagaccaatcaagtatctcctattggcaagttcttttatcagattatcttgtacaaactgcaagttgcagttgtctaggctgatacttctgtttgctcctctgatgatagctttcccaattttgagcagatcaaaatcctctgaaacataaacccagattttcatatcaaagacacggacccttttgtctgcaaaaactgcttgggctaaggttgtcttccctagtccaccaagcccaacaattggaataattgagatatcctccttggcttcagttttcaatagaaggctgattattttttctgtttcagcatccctccctagcattccaatctccatatcatcactgacagtaaaagtttcgttgcttctactcccttttgcatgtggttcatgacgcacaagattgagcatcttgccatccttttctattgcaactattttatccctcaagttcttcatgttgcgtgctatggtcattttctggaggagcggattgttccaggaaaagtataacttgagctgaaaaataaaattggagtcaaagtcactgtctatattagtgtcctttgtagatcaattttcatctactcagactagtctctgatagtccgatatggatcgggaaatggcatggtagtggaaaagatgaatttcctttttaattttagaaattaatcgggctggtatgatgcaaaaaagttccacaaagaaaatcacacatgtgcagcagctgatccgtaaagttgaagcatataacatttattcaaacacgacaatatgtggaagtaccttggattgatggttcctgatgagctgagcagcatcgaattcatccagcacgtcctcaacgtcgtaggcgacggacttaactttggagagccaccgccgtgccactgctccatcttttcctacttggcgcaccttatcgtcagcatcttgcatcacagcaaccagatctctcatcttctccttcatgtcattcacatcatccttgaacctccacagcagagtggcctcctccactgcgaggtcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3315 - DNA, 631 bp, Oryza sativa
cagctggagtttttatagagccaaaacactggcctccattcttccccgtcattcatgttgatatctcaaatgacatacccgtgcacttgcagcgagtgcagtatgtcgcttttgcatcactcctaggtacaaataatcagtaattgactattttcttaaaacatatctatttttcaagaactataagttatcgaaagtgtaactacgggctaagattatgcatacctctcatgcagggttggtgatatgcctcttctggaacataatatgtgtcagtgctattgcgattatgtggggcggtatggtttcagagaaattcatcttatttaatttgcattcatgccttgtatgttaagcttatgtccctaatttgttagttttgagcaaatatgttaatttatttcatctatgcagaccctagggcctggtttctggctgccatatacttcattacaggatgcccaggtgcctatttttcatggtaccggcctctttatcgtgccatgaggtactacatataatgcccttactgattctctgaattaatattagcaaacattatagtattgtactagagtacctggtcaaaacttgatcatcactacttgacacttggttgtgtatatccact

SEQ ID NO: 3316 - DNA, 825 bp, Oryza sativa
tcatggatcggaggtcacctgaaaaatggatatgtaccacatgttcatatttgctgatgtccaatttgatatcccaataactcatgagaaaattaaatgctcatgagtcattaagaaaaaaaagagatatcaaaatttgtagagtaattagtttggtaattatcaaagatctcagctatagttttattgctgaaagtttatatgtgcaaaggcgtgaaattctttaccgtaagtttgaatgaccaagaactacattatgtgtgactgctatgtatgtgtaaacatctatgaaaactttatatatggataaaaaatagacatcataaaagattttaacagttataaaaaaaacagaagcccacgcaatcagcctcggtgctccccaccgcctcctccatgttcccatgacaacaacaagccgacggcctcctaaacagatcatcgatccggcattggcgcatcgcctccaacagcaataggtgatacttgttgacggtcgctatcgaccagtttcgaccgtcattattacccaatatatgaagactagctatgtttgcaatgcataattcccaaataaaatatctacttccactatgtgctatgctactaacatgtatgcaggagaagcacgcatgaatggaggagaatcgatggaaaacaaacgaacaatcaatcggaagccgtcgagaggtgattaaccaccaaagttgggagagaatgaacgtgaagaatgtgaatatattttgcgccgatggactcacatggttttgagctacaacatataaaatgagaaattattctgagctaaaacatggtgtaccataa

SEQ ID NO: 3317 - DNA, 4183 bp, Oryza sativa
ctagaaaaaaatatttacgagtgcaagtgaaataaaactaacataatcaacatatgatttccatggtgtcaaagagttaagtccgattaagttcacacgatcaatcgagaagcaacgttacgagatgcactattgggtttatgtgaatataggatgtgcgcgacaataggtggtgggtgagccccctctgcaaaaggaataagttcaccttagatccctcaattcgtcgcccactctgattttagtccttcagccgaaaaaccagatatagccgatccgccaactcacaaaaccaatgcaaacgagatctcttggcagcgtcgtcttcggttttggctgacgtggcgtctagtggcttatttgactaggtctttgtacgtagtactagcaaatagtatctgctggtcagcgaggatgtactacttaagcagtccagatacctttttactatcaagaggatccacggatgcaccagggtcattgtagaaggcaacaggttcatgagggagtggagttggacgtgggtgctacatgaatacaaatatatatggtcagttcatgacaagttgaaaagaggtacgcagaccaaacaatttgaaatgtatagaaacaatttcggaatcacaatactacagtcacataattgctttgcaactgacaataactatatcagtttcttgttgcaggtttcgatgttcatggaaacttaagtgaccaaaagattgtccaacagaagaaaaacaagaagctgggaaattaaactcaggagggatcgagatatcaggccaaattaatctagttagtatagagagataaaaaactcataaaaaaacacaactgaattcgaagcaattctgaacaaaattatattcgagcaagtttatagagctacaggagaagaagcgtaccgagaaggggttgacctgatctatctcgacctcctcgaacgggttgtcgctgtgcccccacctccctccggccgccatcgatcgcaactgtttagaatgccaactctcagaacgtctcgcttggcaattaagctgctaatataggtacgtagtacttgtatgcctagctacgggatggaaatttcgtcgcagatgctgtaaaaagccagtgtcgtcgtcctagtagctacgttgtcatatggcacacactcgatcggacgcacgccttgtacggcacgacggctctgctagcgaaatactagtattgtttcttttgttgtgttatgcacttatgctccctcgagctagtcgtggtcgatggatacgttcctgggccagagtagctagtaattggtgagtatggtgagccggccggccggcggggacggcaaaaacggtggcgttggaatttggttggcgcacaagtggcttcagcagcgtaagcccaagcaggagtagccaattgacagctttttccatgcatatgttagagtatatatatatgcaacggtacgtggagaacaaggcgttggcaaaacaaaattccctaataaatcatgtacacagtatttggtaaattattccgggcttttccattcatgtatgtatactttaggttataaaaaaaaaaactctcgattcgctctcagctcacatgctcaatctctctgaaaattgtcggacgatgaatagttcactgaaaaccaacaagaacagagaaacagagaagtgttttggcgcaccttttcgtttttcttctatttattctcctcagcccgtgaggttgttacatgcatatcagactccgactttactagatctaacaactgaacgcgtcatcccacgctgtagacccaactcagccactacaaccgaaaaagtctctaattgaccgacctctgaatattttagtccggccatgcaatgcacaaaggaatttgaagctaaatgctgttacaacatgcaaaagactaattcaaacaactaaacatgatagggcgtaaagattatttgctactctgtcataggttgtttaggaatttttttgactggggttgttgaagaatttaaaaacagatatacaacattctacagataaagctatagatcttataaattgttgcgaaaacgctagctgccaagcgtccaactcgagcaaaatcattggatgccatccacctcatgccattgccacctccctcatgtttgttttgcttggtgtcaacaaattttctaagggaaggccacaacgttgagcttccccgacctcacgctcgtgacgacctcctcctgctggttgtttctgcagccgcctggaccaaccatagttggtggaacctctgtcttgacgtggcttcgtgagcttgttgtcaatgagcacttgatcccgcgtcaaccgcctccacatcaaatttgcaccaaaaactcagatccaaccaaaggagtagaggaaaaaggtggatctagccattgaagtagatgaaaaaggaggatccgacaacaagagtagagagcaatgacagttccaactactggagtagagaacgatggcggatccatccattagtagaggaagaaggcggatacggtcaccagagcacaggaagaagacaacggtaggatgttgcattatgttgtttatctttactttgttatgttcgagtgtttcatcctctttttgttggatgctaggtacaatgcggaatgtattttcttcaatgttgcacaatagggccttgatgtttcaatcaattttttttcgatgattgcatctgtttgattttttttgccaagcgttgacacatttttcatcgagcgatgaaacatctaaaacaaattttgttgaaacatttttcacagatgatgaaacattaattagatacatttctctattcgtggtgaaataccatttgataatttgtaaatatcaaacgtcctggcctagttgtgtccaaattgctgaccttggttcatgcactggcgagtttgtcctccatcttttgtagattcgataaactttagcaatggcagcaacagccttcaaccaattagattttgggggttactgtgggggtagggaggggagaagaggggggagtttctttttttagaggtgggtcagggtggagaaaggcccaatggtgggtggcagcaatggggaggaggcgacaaagtgatagtactgttgaagctacttggtggggaggaggtggtgggtagtagaggcgatggggtatcgagaagatagtggctaggtggcattgggttatgatggtggatctgatggccggagtcaccgtaaacggaggaggctttgcttctctcccatggaggagggagtccttgccatgttcgttgggacaatattttgtcgtaataaagtatatgtgcaccgtaaagcacttatacgagcatattttaattatgtcagttgtaggaggctgcataccaaatatagtgcacctatggtcggtcacctgaaatccgcataatgcaaagggtggcagaaaaatcgtgtccggctctttaggaaaataaatattgctagaaaagattcctcttatagcaagagatcctatagttttgctacgcttcttctttcacctatttcatatggtagtacaggtcgaactgaaaaaagttattttccttgcacataagatctttcttgggttgaacatagacttttttttaatttactcactcatccattttctcatagcttataaaagagaggaatttcactgtttaagcatacatgagtacagttatacaaaaagtcccaaaatatataaaagagaggaatttcattgtttaagcatttagctagtaataagataccacaagtacatgaagcaaacaacaagaatagtttatggggatctaaaagaggaaaaatggatattaggactgaaaatggaaatgggattctgggataaaaaaaggaatgagatatttgggttgtaaataaaggagtgaaagagaccctccaaacttgatagttgaccatggtttctctagaaaacatcattttagaagaagcccacccttaacatgctggaaaggcatgcaaatggcaatgagcccctccttacttgggagggaatgaaataccctggttggccaatgaggatcctgcgccaatgttgaaaggttgcaccatgtcaccactgggtccagcagtgttgcttctgccgctacctctgaacaaactatagcccaatgagccaatgccc

SEQ ID NO: 3318 - DNA, 11171 bp, Oryza sativa
ttcgagagcttcaatgaggagtagcttggtctcactttcatcggcatcacgcctcaccttgtctaactgctcttggaacttgttgatgcgctcctggatgaagccctccaggtcggtcatcttcttatatttgtccagctgtggcaaggtcttgaagcgctcgagaactctcatcacctccgactccgacggccaaaccaccgttgcttgcgcctcaccctcaccatacaccatgaggcatgtgtccacattgcatagtgttgccagctcgcttgccttcttcatcaagcccttgagccgcttcttgaatgttgcccgccgcttcgcatcattgatgatccgctgcagcttcaccttgttgcgagccatggccttcacgattcaccactttcttgcaagaatgcacctgtagattgatgagaaatggttagattgatatgagatcaaagaaagaggaatatggtgcttttatagtggaagatcagatcgcaacaatcagcaagttgtggaaagaaattatttacagatccaagaatatcaaatgaatcaatgcgagttaatgttttcctgataaaaatgcctggttaatatgcagctggctagcatacttgtcgacctttaatcgtgtctgtctttggaaacttcattgcaaggatgagctagcaacagccaataggcattactcgctagatgataacgtgttcacaccaaagatgttaatctaataaggtgcttaatatgggtccagttcaacagatatttataagctcatcctatttcatacacataataggattgaagtataatagtcaagatttttaaaatttgcttagaattaagtacatggtgtgttggaggtaggccatgaggcccttcagccgacacgccgaagcagatggtaacgaagaacggtggagcacgacaaagcatagtgaaacactatggagttgggaaaacccgcggagtccaaggccgacaacctaatagtggacacctgtggagaggacaataaaagctacctaaaaagacccctgagaaagggccagcccaatagttgacccgtatccgctcagtaggttgagaaggtgggctaaagacaagaatatccctataaacatccatatcaatgggacaggaatgtaaaagcctatctaagccaaaccccagggtttgttgttaggcttgtaaatctataaatagcccgtaagaggaatttttctttgataaataggaaacttaagattaagatgctctaaaatggaaacgagagaatgaattcgagggattttgtagttcattaatcaaggcttggcagaagagcttgagaagtttccaacaattaaagatccagatcacggaatggatacgaaatctagtggcggcaagtaagatagggaaacagaaactattgtttttggtgaattattagtgtgcagatgaatttcatccactactattgaagaagcttttaactgtaagacgaattccaaaaaaaatgatacatacctcattgttttcgtactttccattaggacaagtgttcgtctttggacaacagctagcgccgtcgtcgggaaccgagcaaaagtcaatgccacccaagagaaggttgactaggaggaaaacggttccacagagcatcgcaggaactaccgaaggtgacgccgaagatggtgccaaagctgaagtccaaggggttcccgtcgaagctcagcctgagagtctttaggctcaggcatgtaggcttcagggggcgacgaagttgaggaccagtgagtgatgcctagcacggtttaaacaacatcggtcccaaggctggagtatgaggcagtgaagcaaaaacatggctaggctgtaggaaattcttcgccagatgcagcaacaacacacaacaacaacaacaacaacaacaagaagcggccatgcaggcaagagttggtgttgtgacgtgcgtggccgtgctgaatgtgttctatccaccctccggccccaccgcacgcctaagattgttccaagtctcggtggccccgacccttctaggaggtttgggtgctacttcagtaacacaagcttcgacatcgcactgacgattggacgtcgggtcgacactccatgcacaattccaagtcttcctccagcaaatgaatgttagtcttccatagaatactcaagtaccaccacaagcagcaacacctatgtttatgccaattgttggaggagcaactcaatggctggtggcatggcaattgacggtcattaagtataaactttaaccatcaattcctgcataaaagatatcaaatgtactagcaaaacttagtggtaggagtttactactaacaacttccactagttttggtaaatatatgtatgcatgttatttaaggagaaaatacaccagacatacaaggattggagggcccacaagtcattcataaccgacttaaagtttgaccaaaccatcctcaactgcaataggggcccacctatcagagactttagaaaggtggtggctaggggaggcttgctgtcatgcccagaaatttagcccaaatttctagactattttgtgtattaaatccttgtccaggaccagccagggtacacaaaacaacaagtaatatacagttccaacgtaaataaaagcgtaaaatacttacagaagaggcgcttagtcctcacaccgaaagagaacgacagcagcggaaaaaggcgatcctagcggggcttcagctccactccacaggcaaaactcaactggggtctgagccttggccttctaacttcgtcttcagctcagaagcactacacttctgaaaaagggaaataatagcaaggcagagtacaaccaccgtactcagcaagccacaccaatgatgcagacgtgcaaggggatacaaggacggtttgtggctatttgcataaaggcggttggaaaagattttattgagcaaaacagtaaaagtgttgagtaattaaagtaacattaaatctccactgatcaacgctacaccacgttgacaggcccaaccaacccacatgaactacaggcattgagtcgatttattaaggtgggactaatcacggtgaatctggtcgaccgcccataaccgtgggcacggctattcaaatagttttactctggccagaggtgtacaactgtacccacaagacacagccccacgacacgtttccgtgtgccgacatgccaccatgacatatcggaaagaggccgtgacaggacccttcgcataaccccctctaaccaagcacaccacacctcaggtttcacccccactcctcgcaaggcagcgggcaatcccctctcgtacctaggtgaatccggaagccgcataggccgtcgcagggcccatccaaactccatcacgcccacccttgcttggatgcgtcagctagaggaaagctacactacaagcccagccgttgcccacgctggcttgtggaaagtacgaggaaatcttccagggtttcccgcgaaccggtccttaactgccatgggtgcgactagcaaaaccatgcacccacagcccacaattcagtcgcattttagttggataattacgaccactgaaacatggccgggtgtctcgagcacgcagctcgttctgatgctaaaaaggtctaatactgcaattatcccatcaactgagctagtggtaattaagcatggctaagcatatagttctagctaggtcatcaaagtaacacaagctagtcgatttatcacccaaggttgacaaaggacatatatcaaataaacatggcacacacgagcagataggtaaaccctattcccatgtaattagcgaaacgatgcatatttatttgcaaacaataaaacatttataaattgggatcaacatgctcaaggggaatgtgtgacttgccttgcttcttcaaacaatcttctgaactcttttcctcgcaaccgcggacttccgaaacgacagattctacacgctggcatgcaaaatgaggaaaaactctaataaacaccaagcaaacattacataaaaagtaaacaaacaagtagagatcaattttagatgaattttgcaagttgaacggctcaattcagagttcgaatgaattagttatgaattttcgaagttttgagccatttaaatgaatttctagaattaaatacgatttatgacgcaattgttaattattctttcaaaggaaaaaggccgtcgctgacgtcatcaaagaggtcggcgccgacaggagggccccatgagtcagcggcgcaagaggagcggcccacggtggactcggtccaccgtggcacaggcgcgggcgcaccacgtggacggccatgtggcggccacggtggacaggcggcaaaggtggtgtcgacgtggcgccacgagggcaccgatgcggggcggcgccgaacggccatgtggacgacccagattcacccggggtgaatcaggcggccacaggcaggcgggagccggctcgccgaccggccggccgggaagcggcggcgtgcggcccgatggtcaccggcggcttccaccggcacggcggcatgtgcgagagagcggcgggaaaggggagggggagtagcacacggcggaaggaggtggccgtcggcgagatggcaacgggaggcggcgacggcggagctcggggcggacgaagacgacgatgctccggtgacgggcggcgctcgggaagaggcggacgagcagcagctgcatcctaggatgggaggggaggtgttagggaggacggggcggcgacatggcctgccggagcggaaaggaagggaggaagggctcaccggcacacgggaaaacggacgtccagtgagtttccggcgatgggaagaggtggccgaggttctcctcgtccttgtggagcagagggaggtgacggcgtgggtcggcatggaccgaagcggcgttgcgacgcggctggaggtggcaatggcgacggagagaggtggtgcacgtggcggcggcgttccggaggtggaatgggaaaatggagtaggggtcagggtggagatcgacacggcgatgccgatggtggtgtcgacgcggcttggtggtggctagtgcggcgggagacggcggctggagcacgccggtgagtggtggggagagggagcgccgtggggaggtggtttcggtgacacaatggggaagcggaggggatgctggggtatggcacgacgcggcgaacccgctggtggcggtcgcgcggagcggcggcggcaggagcagcggtggcggcaggctggaggatcgccggcgagcggcggcgagaggtgcgacggtggcgttgtggttttcgtgcatgggagggctcgggagagaggggaaaatggagagggaggtgcggggaatgtttttataggggagggtaggtcggaccgagcccgggagaggcggagtcggggcggcaaccgccggcggcgtgggcggcatcgtggggtgtgggtggcggttttggaggggagagatgggcgatgaggaggacgtggggcggcggggtcccacggccagtggactcgcgcgcggggtggagaaggagggcggaaacggcggcgtcgtggggaggctcgggtggccatggcggcggttggagccggaggaaggggatgacaggtggggccgccggtcccacctgtcggcgaagggagagaggaagggatgcaaagcagactttttgcgagggaggataggagggaggccgagcgggccgagggaggggaaagagaggctggcctggccgggaaagaggagggagggagttgggccgagcctaaaaagggaggaaagggatttaatttggtttttctttttctttaaatgagtttaatgaactttgtgactttaaaattacttcttgagctccgaaacttcacgggaaaatttcagagaatatttagggcccaaagaatattacaaaatattttcggccaatgattttttttaagggaaaattttaattctcccattatttcacttgattaagttactttaacttttatttaatttctagaaaatgcattattaattgatttttaatcccgaccgaaaattggggcgttacacttgcctggttcggtcgaaccagccttggagcccccggctcccaccttgcacgtggcagttccccattggtcctcaatgacgattaaggggtgttaccgacttttccaaccgcctacagccgtcattgacacactataaaaggaggtcctcactcacttggaagaacacacaactttgggctcaagtagagtactattcacttgtagtttcatatttagtctgtgaagggatgctccagaaggagtgccccgcaatttcgtagttcctcagagaattttacggaggagtgccagagtgtcgacattctcccaacggagttccggagaaagccaagattgtcaaccttcctctctcacttgtacctcagcggatgcttcctttatcaaagtaagtgttcaagtttctttatgttatttaattagtttatttaagtaagatatattctcatcggtgtgggttcgtcacttagtgtgcaactaaatgctctagtactaggactctggatgaagaaggaagtttctgcgcaagactagagtagtaattaataacttaggcttggtgtctaggttagaaattacctttgtttattgtgtgctccacggaaagtgaggtaggtggcaggtggtgacagccctatcaggccttcgtatttctccacattcgggtacatcatagagctaaagggtggactcagcttggcagtcctaggggggctgatgcccaaagcattcgatagagttttacattttacttaattaactaactaaaagacatacgaatcctctctagccaatttatcctaggctgttgttcttggattgaatcctgatcgtagataatacacacacgttcctcgtgttcaatacccttggaatactctaagggtaagtgttacaacagtatttcgtgtgcctgcagatttatttgttattgtaagaaatacgaaaattggccactggtggcagtggtgatcgcttcgccccatcttcaccgtgcatacgttgtgctctagccagccaccccagcggtgtaagtagctttggccgaaatcacccccacacacaaccacaatccatgatgccaccgccagcggttgcctttgtccaagctcaagtacaagcacaagtaccgacataaccgttcgtgccgcctgatgccctaggctttcgctcaagcatagacaacaaaaagatgttacctctgagttggagattacacaacaaccccataccaccttaattcatagaacccaacgattgccatgtacactggcaactttgactcaagtaaattcttgtcattttatgagttgacgtttgaagcaacacacggtgatgagaacaccaaggcgaaggtgattcacctggttctagacggttttgctaggtcatggtagctcaaccttcccccaagcagcatttactcatgggaacaatcgaggggcgttcccatcaccaactttagaggaactaataaaggataaaaaaaatgtaaaaagagctcttcggcatctggcagaagccaagctagtcagcttgtgaatttgtccgaaggttctcatatgcaaggtgcaagttcaaaacaccatcgtaacttcggtcatcaacgcggattcgacaaggcttcgcacaaggccgatcactgagaaaatcatgaggaaggagaagaaaatgcttgactacctctttcgcattactgaggattatgcatgagggaaagaagatacaaagcacagaagtgaaattcaagccaagtatgaccgagccacaaggcaggacggaagcctgagtcactaaaatagtcgcaccagttaacccaccacgataaactctgccacaactgtcatggaagaaatttcagaatgacaaggggaagcaagtgatgacggtcaaggaggtccaagcctcgcgcatgaactttcatgcaaggaaatgaagcgaacaggctcccgccaagaagaaaaagtgcagcatagataaatattgcttgtagcacgataaattcacacactcaatggataagtgccgaaatttgcagcagctgagccaaggatagtctcctcccctgaaccgccaatgggctgaagagggtgatcaaccgagagagcccgaaggccaatacaaattgaaggaccgcagatggccacaaataatcatagcagtcatcacgagcggatatgccgaaggattcacaccaacgaggcaaaaagacgtacatgaccaggcgatgattcatattgctgcaaaccccaaaaccaaggtgccgcaatactgtaacaccccaatttcttttgaccccgaggatgcgaaggggatctttgttgctcaccaagacccatgcgttatcacgacgggtatttttgggtgtgaagttccgtgagtgctggttgaaggagggagttccatggacataacattttttgatatgtactgcaagatgggccctattggtattccttacattcatagttaaatccgcaagtgcacagatagcgttgtatcatttcacccttgagtattcccaagggtattatatttatatttccgcagggaaggcaacggtgtaaagatatagtttatacatcattaatcaatccataattaaattatcatagtctaaacaggggttaagatgaatatgatcaaggggtagtgtgacacacacaggagattcgcctttgattaattactatagtgcaaagggcataagagaaatagaatgcagctgtgcttctatattaatcatgttttgtatatacttaatacatacatgttcaggctaggacttagttctagacacccaatagtaccgagagatcactctctactggtctaccagcgtgctatggcatttatgcactcttacgtcatatctaaacatggaggaatacaaaggacatacatggctatcagcacccgccgcctacctcccttttcgtgaggctaggccacccgcatccaacaacatttatctaacctaagcagcatgcttatgccaataaataatattactaactcccaaggggctcccacccttcggatggacaagttagagctagcaacttatcaaggcccttggagcgttaccgtagcatagatcgactaacctaatcaagtgaagcatataaatgaagtacatcatattcataaagcatataaatactaaaacaatatatcaattatgaacacaagaaggtaaagaagataattctattaattcgactatagtcttacaagaagagcaaaatagtaaaacataccagaatctccgagaagactataggaccgaagatactctaagcctactttcactaatattatagaagatacaatagagtacagagaatagctccttgaggtgtgacttgtgaagtgagagggctcctccttttatagctggtaatgatggttgcaatgttggttaaacacccatatcatcattaggagccaatggagagttgaaacgtgtaaggagatggcgaggtgggcttggcctgattcagccgaactagtggcaccgcctcttgctactgaccatctcccataggcttgcacggtgcatggtggattagcctccaattaagtcagtttgagctgacttctgggcccattaatccgtgtgcttgcacgtgattcaccacaggtgtgtttctttgcatgtttattctctgcatctatgttaattctccaagtatagtggaactacattatttattattgaactacgtgtaagaagtgctagttctccctttatttattatgataattggtggtcaaaattggtacttaacggtcatcaacaatagcctcaagctgaactttgctcctcctgagtaaagataaaacttaggttgttgatcatgtgttgctatcatgttttatttctcattagtacaatgcatacaacgtatccttctacctagaatttgaataagttggcaataatacttttacctttattacctatgggacttgtagcttctcctcatcttgggtggttgagagatagagcgaatcgtagagcatcaatcacttactcttttgttcaacttttctttctggaggttttcaagaacttttgcaattaaagccaaagttcctcaaatgatactctcgatcattcaatgtgtatgatactcctcaccaaggcatggtgtcgcctctttatcatcctacttctaaaggtttctatgtggagctcaaagtagagacaaaagatgttggtaatacgtatcacatatattgcaaaatcaaagagaggatccaagctaggagaaagcaaatcatacaatcttgatcaagtgtgcaaagtgtgtagctatatggtggaagcccaaccttgctgcatggtggtgttgatgttcgctaattggtcgttgatgtgctactgtcatgtgtgggtctcctggacatgctggtttagcatgttgtcatctcgctggtccggagattcaactctcccagttgccgagtgacatctgcacctcaacccgaagtcacgaaaattttgggacatgaaaaagtcacgtgcattggactgtgggggcattccactggagctggtggactggtcttcattgggaatatttccctagagtctgttgatgggatgttcccactgaccactactcgcacttgcccacgccgagctccctactccatatgttggcagcggttggttccagccaagtgtatacccaggctggctccaatctaagagcgggtattgcaactgttgttgctgctacttcgcgacggcattcctagacatgtttcgagttgtcctgccagaaacattgctccttcaagccccctcttgtggtacgagaggaatggttagcgcctggcacttatacaaatgaaattttgggttagttaacgaaatctcatttgtgtatctagggaaggaaaacaacatagaggcatttggaccatgtttcaatgcctgcccttgcacaagataatcctcgttaatgatggagtgaggttggggaatgtctatgattgcaccattctccaaagcttcgactttaacaacaatacgagtgattaaagaattgcaatctattggtcctatcat

SEQ ID NO: 3319 - DNA, 6615 bp, Oryza sativa
ttttccagtggcacacaagcacacaaccatcctacaattggtagtaaattattgcagattggcaatcccgggcccgccccccttgtgccaccttcagttcggcccgatcagtgtaataggtgggaggagaagggaaggccagctagcagtagctagttgggttgttcatgtcggggcagtcaaagtggtggtagccgatgtggacggcggtgtggataaggccgcagatggcggaggattccatccgccacatccccagccccaccgtcgacatctcgtgcctgctactcagtgttggtattttttaacgacattactagaaatatgaattcccagcaatggcgacagaaatggtcctagtatatatatggttacagaaggaatccgcaaacgcatggatataccattgtagcatttcacccgaaagtattccaaggtatggtatttatttaatccaaatcccaatggaagattgtaagagagaattatgctaatatatatatatatatatatatatatatatatatatatatatatatatatatatatatatatatatatgccacttgtatgatcagagtctaagcaggggttaatgtattcataaagagtagagtgacacaaagaaaataactcatatctctcattaatcaattctacgccatgtgtaagaagaaatagaaaagcaatcaatccctatacttctagtatacactcaatcttagtttacatctgctagtatacaattatgtggcctataccccctaacagtgccctcctggtgtttcgagagaccaccccgggttgtcatgttccttataacaacctgtcatggccgtccaactagggctacatatggaggagtacccgtactgagttgtcaccatcagcagtacacctcgaccgtcccgcaacatatatgcccaaataatgatacttaataatcgagacaccacgtctacaatattaaatactacgctatatcccccgagataacatagagcaaccgaatagtcggatattaaaccaacaccattgcacctctctggtaagctagctacacaactatatcgatacatgtataaagtaaagccgatactgagataaactaaagtaccgagagtatataaagaataatatcccattaattccgaaagtcttacaaaagaataaagaaaagctactagagccataccctaattcctccgaagactccaaggactccgagagttattctattctactccacttagcactagaatactaaactaaagtatagagagaaatgttgagcttgcttgagtgtgccttgaagtgaatgaggcctcctccttttataggtaggtaatgacggttacactatgtgaattgtccaaattgccctgtaaccgccattgaagaggagcgtccacgtggaaggccgggatgagaggagctcgctagggttcggctgaacccctggttcggccgaacctgggccggcccaacaagcctccaaacttcccaaggtcactgacaggtgggtccttaaggcggttatggcagttatggcggtttctgggacggttacacctgacatgtgggcccatcttatccttaaacttacttaggttgtgttcgtttccccttgttcccaactcctcattttcgtttttcacgcgcacgcttttcaaactactaaacggtgtgttttttaaaaaaagtttctatatgaaagtttcttaaaaaataatattgatccatttttgaaaaaaatagctaatacttaattaatcacacgctaatgaactgctccgtttgccatggggaggagtttggttcccaaccatccaaaacgaacacagccttaggagtgaagtttcatcatttcttctccatttatgtattaatctccacaaataaataatactccaggtacaagtggaactatattattctgaaaaatatatgcattgcaagcatagctagttctcctttattttatttagagtaaagtccatgtcacgcctagaaattcacaagtaatttccaaactaatttgtgcattaaatccttgtccagaaatcagccgaggtacacaaactgacaatataatatacagattcatcaaaataataactttacatacttacaaaagaaaagaaaacagcagcggaattacggtctagcgaagctccggctccactcccacaggcaactcaactggggtataagccaaacgtcttctcatttgcaacttgtcttcaactgaggtttaattgattattgcaaggtgagtacatggaatactccacaagccacacagcaaatatgcaagtgcacaaggataccaaagaatggcataatatagggctcatttgcaaaagcagcatttagtaaacatttgagaattgcaaaacagtagagtaattaatcatcaatattaatcaacactaaacagcacacccatgctgcacaggcctaaccatcctgaacaaccatacccggctgtacagatctatctccaaaccaggaatgtaccattccaaaccaggagctaatcaaattattaccagttatagcatcatttattatggtgagaagtgtgagactaatcacgaaagacattgttagacccgcccataatcgcgggcacggctattcgaatagttttactctggccagaggtgtaccactgtacctacaagacacagccccacgacatgtcaccatgcgcctcaataccaccacggtacctcgaaaaggagctgtgacagtacccctcgcataacacaatccaccacaacgcattgttcctggatcataatcaccctcttataaacaaggcatggactccccagcgacccccgtgggcttatctccgccacttctcagtctggtgccccgcaatgaaccatgttatacaaaaggtaaagccgttgcccatgctggcttatggttggcacggttaatgtttcacaactgaaactcgtgaaccggtccttaattgtcatgagcacgaccatcaaaaccatgtgctcacaacccaccattatcaagttttagttgaccaattattaattaaccaatcacgattgcccatcgtgagctaccattgaatatctatcattaggtaatagtgaaacattagttatcccaattgagtgctaatgtttctaagcatggctaagcaattatctctaatacatctagttgaaccattatataagtacaactagtcaaattgtaacccaaggtatcaaaggatagagtaatcaatgcaaagtggccataacaaaggaatagtttcacaccaccctgtgacattcgaaaataaatgtacaatagaaataaatagagaatttaaatataggatcaaaatgctcaaaagaattgtgtttgggatatgtgtgacttgtcttgcaataatcggtcttcaataagtctctggaatacttccgacgcacgcgcgaactttcgaaacgacatgaacgacaagctaacacgcaaaacgaggaaaaagactaagaaactccaaataaacacatataaagtaagcaaacatatagatcatgatttttgatgaatttagagactcgaacggcctcattccgacttcatatgaattatttacgaattttacaagatttaattccaattaaacctattaaagaaaagactattccaaattaattaaacaatttacaaatgatttataacggagataaaagattaaaacaacctccggaaaagattagatcatatttggtagatgacatatattaaaaagaaataatatgccactgaaaagagatagcacgacttatattaagattaattttgaccgagtcgactaagatcgaatggcttagattgatctgaaccggaggaaagagcacgacgaggggagctcaccgatgacttgaacgacagcaaacgacgacggatgacgacggcggcgaggttggagtggcgacggggtactgatcgacggtggcgatgactttccggcgatctttggcggagaagaggtggtggacggtcttctgcttgcagttgcgaatccaacggaggtggcggtgaagcttggcgatgacggaaggagcagcagggcctcgccggagatcaaaacgcgacggcaaacttcgggttgacggcgacgatggagctccagtggatttcagcttcggggaagtggaggacgatcttctcctcctcctcgcaaacccaacgacggcagcggcgaccgaaggcgacgaccacagcgacggcgctgggctgctagagacacggcggcgtcggcggctcacgggcttgcgcggaggcggctctaggtagaggacggctagggggtcctttatataggcacgggagctcgggtccgggcccaaatcgacgagtgaaactccgggaaagtttaggatattcgccggaaaaaggaaagattgatccgcgaaattggaaaggatttccatataaagttttggggatttcttggggaaattgaagaggagattgagaggattccattcccgtaactactttggaaagaggagcaacggggaggtcggatttggaaggaggaggcggcggcaacaggacacgagcactgctggctcggctctgcctgagctggaagatgaacagtggcgcagggagaaaaacagacttttggttgggcttctattgcacagcccgatagaaggagagatacaaactagacttcgggaagggataaggccggccgaatagaaggaagaatgggccgagaactaaaggtgaacttttcctgtttcggcccgaaaaggaaaaggggattttaattacttttcccaattaaattaatcactgaaatgatctttcagttgttaaaaatacttccaatgctcaaataattccaagaaaattcttgaacatacttggacactctaagtatttaaaaaaattaaaaccagctcatttaatgattaatttaatatgtgaataattactgaaatattctttgtattattaaaattaataattgagctctgaaaaatccaagaaaatttcagggagtataattaatcatggataatttaataaaaattaaatccaaccatgatttatatttaggaaattttatttcccacatttaacttcgcttgtaaattaatgaatatttaatataaattctattaataatttattaaataatttataaatcctgaaatgaaattcaggctgtgatagtccatcaccggtccctaaacttgtaccgatgtgttataccggtccttaaactcgcaaatcgaccgttcaggttctcaaacttgttcgactgtatcatttcggtccctaaactttcctaaacaggacggtctaaaaactttatatcaaaaaataattcataacttttttatgtgaactttaatgaagacaaactttatatcaaaattgtagccctcgaccgacctacaactttgtagttgaaaagtttttgaattaaatctatttagggtcccaaaatattgttgcatctttataaattttgaaattttaattttaaaattacattttgggacaaaaaatgacttaaaataaaaaagaatttcaactacaaagttgtatatcgcgtcgagggctacaagtttgatataaagtttgtcttcattagagttcacatggaaaagttatgaattatttttaaatataaagtttttagaccgtcctatttgacctagatgatattcaaatccaagtttagggaccggggtaacacaactgaacaagttggagaacctaaacgagtgatctacaagtttagggaccgggatgatacagtcgaacaagtttgaggacctaaacggtcaatttgcgagtttagggaccgggatgacacaacgatacaagtttagggatcggtgatggactttactcttttatttatattgaattggtctataacgaccatcaacactcagtgccaccgccgctagcaccgcgctcccctgtgccgttgtgccaccgtttccgatggcccccacctccatgccaactagatccggtggccaccgacctccacactgctggatccgccggcggccaccgaagacaagtggaggggagaggagagggcggtcgtagctaccgccgaaggaggagctgctgccgcgcgtggtggctggatccggcgcgacacggctcggagacggcgaggaggaggggcggcgtggctcctatatttatattataagtgtcggttctagggaaaaaacgggtacctcggttcttttaaaaattgacacctagagtattagaatcgatttttctttacaaccgatacctataatatttaaaagtgttggttgtatgttttttcattacggcggacatgggaaaaggtttataaatgccggttttaaataaaccgggacctatgagctgacatctatgaagagtttagtagtagtgctttattcagcatctaggatcgaagaacatctctgaaacttcgccaccacgtttggagtgccctaaacgacgtactgtacctaatttgcaaaaagccattgggatttgggaatatggcctcggtaggagcatcatgaccagttcagtcggatgagagccaaactatgaataaatgaaaatgct

SEQ ID NO: 3320 - DNA, 58692 bp, Oryza sativa
  unsure (1)..(58692): unsure at all n locations
aaaatgtgtcacatatattcagtattaggttgatttttaaggcaggaggagtacactgcaccagctgcatttacctacaaatcattgcctacctcggatctgcacaacgtactgacaacaattgctagctgtaccggctgttaattaaccgccctatgatcgcaaagtatagaagcataaagtatggcctcgatcggatttgaaaaaagaaatactatctagtaaactaatgcatgcagttgactcacctcacaatgacttttttgatttaatgcgtgactctttattcttccacacaagattggctacatggtcatcgagaaatgtaaatattaatgaatcgcttgtttacgaggaatgactagtagcatgtttaaatggatgataagtagaatcacttatccttggtctgtacgccaagatgaaatatgactataaaaaatagattagatggagagagagtataatataagatatggtaaaagttacacggtctccaaaactaatctttaacttataatttttcatatgctataaggtttgtagcaacaaaattataatcatataaaagtaaatttaaatgtcaatctaatgatataatttttaacaaataaaattcatttcatattacattaaatgttggtcaaatgttttaaaagttgaatcttgaatacgtgcacgccttgtattatgagatggagggagtactatggacctgtttagttgatgaaatgaaaatttttgggtgtcacattggacgtttgaccggatgtcgaaaatagttttcagacacgaatgaaaaaactaatttcataacttgtctggaaaccacgagacgaatcttttgagcctaattaatccgtcattagcacatgtgggttactctagcacttatggctaattattgactaattaggctcaaaagatttgtctcgcgatttacatgtaaactgtgcaattagtttttcgttttatctatatttaatgctcctacatatgtctaaagattcgatgtgatgtttttggaaaagtttttggaactaaacaggccctatctctatctcaatgtaacaacaggtataataatagactaaccaactataaatatatttcgataagataaaagagtatagagaagagcagtgggctacagatttgtagctagatgtagcacagactacaagatccaatgtgtgtatgataggtaggaccaggtattaacagtgtagtatatgtttataggtaactattgtatgaattaactaatttttaaattgattagagatgatttggagttagtagttggctatattattaaacttgttctaagtgcagttgtatgtttcggtgtccaacgtttgaccgtctgtcctatttaaaaaaatttactcccaccatttcattacaagacttacgcgatatttttctaacttaaagtttaaagtttagttaaatttatagaaacatagcaataacatcaaacatgcataatatcaaaatatattaaacgttaaatttagtggaactaatttggttccataggagttgctatattttctttaaatttagttaaatttataaaagtttgacttaaaataaagtcaaaacgtcatacaatataaaacggaaacgaaaggagtagctctttctagcttggggacttgtccagattattagtcacctgactaaagttatagccaaaaacaaatcaaaaagtttcagtgaaggcggaacttcgattgattcgaaaatgcacccgataataattggatttttcatgtaatctatatagtagaaataaaaacttgtccacatcatttagaaaacaatagcctttggacccgatacttgatctcaccattacattcaggttataacaaccatgcaagcatcaagcatatatacttgtacatacctacatggtttcatgctagaacaaccgatgtagaagtaaaacgaaaaccacaaatttgctggtcgctaaaatatatgtcacactttagtagaaatgtagaaacttttctctgaatccttcagtaccctccaatccaacttactccatttttcagtagctgatcaaaatacccatttttttaagttacttgagtctttagatcgcgctaagattcgtgaaagtagagcaaccccctaccccacccgtagcgccttccccggtacaccacatgtgtgaggcgaggtgctagttcacctcctccagtgccactctcctctcactgctcggcctcgctagtgccagaaggaaccaacagctttggtgaggacccccggttgtccctcctctcctacattccttcctaagtcatacacacagtggcgagtacccttaccatgttgttctctccatacgtttccctcagggtagatcccaccgtcatctatgcctcctaaccactccagatctaacgccccactgtcaatttcgcctaacgcctaaccctccctttcaaccccacaactccattagtggctccaccatcttgtcgcatgcctatgtcctctgcccattgctagttcgaccaccgtctgccggccatccctctaagtcttgggaaacccctcttcacccaacttaaatcctctccaaattgactcccatccaagtttctctgtcggagttttaacatcgtcaccaccagcaggatgtcactgctgccaccaccaataggaagtcactactgctctcgctatcgtggctggtgagtcttctacctctcctttggtcagagattaaagacgattccctagccgttggattctagggagcaatgtgatatgactaagaatttggtcacctgagcgccttaaaaaattttttaanaaattttttctcttcttctccaaatatgaagatggttagaaaacaatagagggattgctttttttatttaaagtactactaggccttgccggcttgcccaatagtaatatattaatataaaagagtattatttccaacacaaaacaggaattataaaagttgtaaccagctatgcacagaagagctgagggcctaattcatcctacaaacataaagaaaaatctcattcctaaaggcagcgaaccaatgatcttcatcacacaataaactatcaaaaactttctcatttcgttgttttcaaatttgccaacatgcaaaaagacatgatctcaagaaaaccttttctaaactgaagtcttatcaacaccaacatatggcgcatttccaaattagtattccacctaattccaagacgatcccaacaactcttgctaaagggacacatgaagaacaaatgtatcaaagtttattcttggacctttacaccaagcacaatgtagatacgcatcgtcaggggcacaatgccttttgtctaacaaatctctaatattcaatctgtcctatagaagtagccacataaacactttgattttttttacatatttagttttcttcattcaaatgaaaggccttgggaccgaaatacccataaagttagacatgtaagggttacgtattacttgtaagggttagttcttctcagcttatacactcggccacttgctcgtttatcgtgagcacacttactgaactgctaaatgatgtgtttcgtaaaaaaataatatgaaagtttcattcaaaaatcaaataaatatattttacatatttgacagaaaagcccacaaaagatcttgaaatttttctactgtcagattgctttagtgcacacccacttaaacctaacccacccttcctcttcctctcagcacagccatgatgaaggctcgagcactcgatgccaaaattgccaccacgccaccgctcagcctcgccggttggctggaagacatcaatggcaccggcgagccccctctcccctggtttggcttctccacccttcactccctcctcctcctcaagctggcgccacgggaggtgccctcggtctgccatcggatacgccaccaacagccgcggcctcctaaccacaaactcgttttgcccccatcaccaacgccggtccaccacccttctcgaccccatggctccggtgtctcaccgtctctgatggccatccctctaagtccggtattcttacccaaaccctcaccccttgccccacacccatcccaacccgagaccctaaatcctaactgcattgtcttcgtcgaggtcacgatgatgttgaagtggtcgttggagctggtgggagaaggatagtgggttaccggaacacaaattgcgaaacaaatcctaagataatatatttgcaagactctaaccctaaatttccgtcgaatgacatttagcaatttcaatatatttttaagtctataataattaatacttaattaatcgtgtgttaacccaacttcatttaacgtgccacaaaaatttcacatcattcgctgattcgaacgcagccatagtcactctttcactctcactctttcacttaacgacttagggtgtgtttagatcccaaaaaattttagtaaaaaatatcacatcaaatatttggacgcatacatagagcaataaatgtgaaaaaaaaacaattacacagtttgtatgtaaattgcaaaacgaatcttttaagcctaattgcgctatgatttgacaatgtgatggtacagtaaacatttgctaataacgaattaagtaggtttaataaatttgtctcgcaatttataggcggaatctgtaatttattttattattagtctatgtttaacactttaaatgtgtatccttatactttaaaaagtccatatactaacaaatttttggccgaactaaacacagccttaacgtacaaaaacctagttcgtctatggccatcggtcgctcatcaggccatggtgacaaacgcactacgcttacgctccacagtagcagtagatggcagtagtaatggcagctccagctacttggagttagagcagtgatggcgccagctcgggctcaaattgacccgattttaatgagcacgccaccattcgctgtcgatctctgcgtgcgtctttgagaaatgaaaacgagcctagacgtactactcgatccgtaccataataatttttagttttttttacaatgtattcaattttttttaaaatataaaaaacgaaaagttatacttaaagtattataaataataaagtaagtcacaaataaaataaataataattttaaaaaaatttaaataagacgagtggtcaaatgttataagtaaaaactcaaaatatggaactaaggagtatattccaggcaggcagccagcagcagttgaccctagcgatttattggcatccatgttccgatccctccacctcacgcagctcatgcattctcgctgaccatccttcccgccggtgcgcgccactgcactctcgccgtcgagcgataatggggagctgcgtgagcaagaaggccgcctccgcacgcgccggcgccgtggccgataaggaggcggcggcgccgctcccgcctgagaaggaggtcgtcgctctgccgccgcccgtggtggtggaggaggaggaggtgaaagaggtgctgtccgagacggccgtgcccgtgtcgcggcccaggccgccgccggagccggagaaggaggtggtgaagcggaaggaggaggaggaggaggaagtttcggagagcgcgtcggtggcgtcggccacggcggagaaggccaaggcgaagggagggggtgagggtgagcaggaggtggagaagaaggcgattggcgggatggagaaggggagggcgaggaggaggacgccggagcagaggaggcccaaggaggctgcaggcaacgggagggcgaggtcgccgtcgcccgcgtcggcgcagaggaggtatggcggcggcgaacacctggcgccgccgacgcggccacggcgggagcagcccgcggtggtgtccggcatcgggccgaagcggcaggttctctccgtccgcggcgaggagggccgccgagagcgccgtcaggcgaaccaactccgccagggaggccgacatgatgctgccgcattcttcccggacgccggcagccgccaagcggtccctcaacggcaatggcggcgcctacggaggaggcgcagccaaacgggaccccggcgagcgatccgggcggcggccggactccccaacatccaagcacatcccgcccgcctcgccggcagcgaacggcgccatctcccggcagcagagcctcaacggcggcgccacgcgcaagaccgcgaaggacgacaccaccctcgagcaaaccaagccgcaatgccacggcggcggcggcggtggccggtcaccggaagagggaagagacggctccgacgagtcggcattggaggaggaagggcacgagcaagagaagcagacggcggagggcggcgcgctgggaccgatcaacccctcggtggccatggagtgcttcatcttcctgtagccgcccaccatttccgatgtccaatgttctcttgctctctcagttagcgtctcgctaaccttgctctgtaattcgtggcaattattgccgtaccatagattggatgattggaatggaaggtagccattgtgtgtcactttgtttaacattcatccccctctgaatcacgtgtgttctgttcttgttttacctgcgacctgtgatatggagatgcgcggcggttggccggtcgggcggccggcaggcgtcgagccaggatcggtggagcccgatgttacagttttcacggtggtcggtcggcatcccattgcggtgccatactgccatactatacgttgatatataatttttgagggaacagggagtttctcttgcaattcattatcattatagaagaagagaattgatccaatttataaaggaaatcggacctaaaaaccttaaacggcacggttaatttgtgaaaaactggcgaaaaccctggtatcgacagattgaacctaataactaagtacagccgtccatcaagggaaaacttataaaacgatgccttcaagaaggacacgtcgactgaacagcgacatcgcccgatcctacaaatctaggttttcacccggagaacctcttgatatggagttgaatgaaagctccaatagcaactcctttaagaaggtgaacggcgcctgagagcgtcgccgttgcgcatcggtaaagccgagcaaaggttttcacctcgaagtcccatccaaacaaagcaaccgcaaacggaagctaccaaatgccacctgcacactgaatgtacatgttctatgcacacaaccacctgcacaccgttgatgacctgcatagccaccacgacggaccagctgagctcgctggcgccacctggactccaacgtcgttggtccgcactggcgtcacgccaggacgcggggagccgccggatctaggcctacgtgaccagatccagccatccccgtaaaaacttcgccgctgggctgggatgaggctgctggcgccggtccgaggacggagtccgccggcgccgggacgccccagatctggagataagaagggaaggagagaagagaggaggaagaaagggagaaaagagaggaggaagaaggggagggagggagacactgccatagctggcaccaccgtcgccggcggcctcgtcggcggctgcgacgcaagtggaacgcggccgaggccccgcgcgctcaggctatcgcctcccgtgtcacctagagcgagcggcacgggagtcaatcacccggtccctcccaaaaatgaagaggtcaccatcatccatgatccattgtcgtctcgtcgatgtaggttgctgacaaattaaggaacattgacagatatgtcattgctcgacccattggttcagggaaccggaggatgtattccctgttcaaagttcaaacaataaaatccaaacattcttctcttttaagttacttgttaattttatttaaagtcaaatatttctaactttataaccattagtttctaaaataattactacatagtttaacatcctaagatttttggtttccgattcaccataagaaatgttttcataatatataatttacatgttgttgcactacataatttatagaaaatgatagtaaaagttaggaatgtttgatttagaaaaaaaaataaatgataagcaatttgaaatgaagggagtagttagaaaaaaattaacaacatccatacagcataaatgtatcactctacaaaatattagaaaacgatttacctcgcacatccagtgcacgacaaaatatcagacgctccatttagtagatcccacctaacccttctcccccacttttttctccccaatgatcaatactacccactcatttttccctcttcttcccatagccaccagagcggctaagagacgaattgttgagaccatacctgatgaccagcaggacgcaacgcatcacatcatgaaactcgaagtggttgagggtgtcactataaggccttgtccttccaatcatactacttttgtgtcaacccttttacacgaagtgaggataaatgtgtaaatggggtgctttgtgtaagtaggtccgcttgtcttgaatggcagggttgcatggttctggagggcgggctgttatattcttcacaccttgcatgtaagcggaattgtagactactaccagagagcatgaagaaataaagaaatagatctattccgcctttttttttaatttagatgtttcagctcagcaaattaggatgtttcattagttagaacaaaatgatgtagtgggctttttaatggtgtttttttgcctattcaaagcattatgtgatgtttcaatacgtcataatgtttcatattaatctatgttgtcaagttttttttaattttttataactatttaaatgacatataaccaatgagaaaacatcccctcgagggataaaaatacatatcccgctcacatgtgacatgtcacagccttatctctttctcctgtctcttatctctttcttctctttcccacgaccacacataagcttctccctcgatctctcctacaagccacacatgagcaacgcagcggcctcggcccctacgagcaaccacaagccgacaacgatggtggcggcaaccccgtccgacgagcaacgacctcaggctcatcgagtagtgagagaagcaacggcctcggcccaacggcaagcagtggccttggcgagtaacgatctcggtctcattgagcagcaggagaggcgacaacctcggcaccgataagcaacggccccagtgagtagcgactttggcattgttgtgcggcaggagaggcaacggcctcggcacaggcagtggcgaccccagtgagttcaggcctcggcctcggcaggtagcaggagtggtggcgtcctcgtcctcagcctcgagcaagcaactaggtacggcggcattggtgacctcagcatgttggtgattttaatttctttggttgtcactgagacctgaatggttcacatattttcttttttatttagttttaaatgtttttttttatttaggtatgcatctgggcatgctgtgggtattgatttgggtatcaatatgtgatttggacagagccgactcgaattgagcttctttctgttttgtgatataaatcgaggcttaggagacactggcaatgtgatcctattaaggttggctggacttttggatttgtgtgattttttttctttccttgttttcccttttctaagtaactatagagcgtgcacgtgcaaggcacgttgatacatagaatgacagctcactgaaaattcagttcatccttagaccattctgtaaaggagaagcttagcaaaccgtttcttcagctatgaaatgataaatcaaaataaacagagtgatgtaagtttagattgatggacctagaagatttagaacagtgcatatttcgaattttaggaaaatatgaatatgaacacttttcttagaatgacagtaagtgaacatattgatttgataaaatattatagttacaccgtcaccatcatgctcaaaatgaagcaacaggggttgtgccagcaacaacccttccctaagcacatatccctgtgtcatcggtgtgccgattacaactggaaaaaaacaatgagcagctgcaatgctcgcgccacttgatctaaccttttttatgcagtctactccatataagttgacgtaaaagcagggtttcataaaccacttgaatttacctaaattactccccataatgaaaaacagtacccaaatgtatccaaacaattgatgtatttgataagctgcctatgggatcaacctttatgtagatggtttgcatctttacggttcatgtcctacaaggggaatcagactgataagttatcaattcaaggaacatgatcaacccaacgcaatccataaagtacactttcaagaaccccaatccatataaaagagccctttaagagaaacaagcaatccaacaacttcaatagtgccaaatctaaattcttgaggacagtggtggagccaggatctatactcgaggggagggggcaaattaagctaagtaccaggattgtgaaaaaaaatacatcaaatttcaagtaaaatcgaagcattttacgtgaataatcaatcatataaatatacctatattttttgaccatacagaagaatattttcatacatattatttattattcgttacatacatattttttttattattttagtgcttttatattaaagtggagcggtaaattaaaaattagagcttacgaggtaaaagacattagcagtcaacaacgatacgtgaccattggaagagctgacctttctaactgtccttgcattctaacatgttaaattgttgcctgcttgatttgctctaaagttctagcattgcagagaccatggaatgccgagccaactaccatgacaaaagacatgtagggttatacctccagcttgttttggactgcaaatctagcccaacacaccaaagtgcttaacataatcacctaatttaaggattacttagtagtaggtcctacaacagacacacattgaggccaggcccccctgtcttcgccgttgctcgagggagattagatagaaacacataataacacattcaaaaggttgttagattagaatagtgcttaatcaaacagaaattaattattgaatgcatgcatcttagagcaaaacaaggaaacataggtaattcttattattgaacaagatgtagtgaactcatgttggacaaggtacaacgtattggtactacggggaaactacatggtactacagggtatgcaacgcccataagcaatattaaacaaaatatgttgtgtaaccaagatcgtaggactaaagggataatttctgaaataagagcaaacatagcaagttcagaattccattccatttgtttcttcaatcagtttagccttttatgataacagtagctggacaatagcttagaagattgaagcttttttttaatccttccatcaatcttgaagatcacttgtccacatcacatattcacatatatatctaacttcctggcacaatcagattaaagtaagagaatagtacaagaaaagtagaaaaacatttaggaatttaatttccacttcagaaaacaaaaatatcatctaacagcaacactgacttcaacacctatgttcttatgtttgtcaagtaccgtatcaagaagcaatggaagtcattaggcccatacataacatgacatttaatgtatatatacaataaccatgcacatgcagtgcatgttataatctagtatataatttaaaccaaacatttccttatttaaacccatcaaaagttttgacatttataaggagaagatagaacccatgtcaattataggatctgaaaatggtgagtaccaagcacaagatccttacaaagccatatccattggtgtaatatcatccaaagctatttgacctgttgtttcttttccaaccatctttttgtttgatgaaagccctgtaaaaaaaaataattttagcattctagaagtgagatcgaaatttctttgtcactcaagcagtctgctgctatatggctaaaacatatatgagcaatgaaaacaatttcagatgagaatttctcgtagcagaagcataaaaagctaagcatacggaagtcctccaaccatacttttcaggactggaccggtaattgaaccagcgggggcatcaattcattggttcaaccattatgaatcagtaacaaacttacttaacagcatatacacattacacaattacagtctcattctccagacaaaagcacatagctactaccaaactcatctcaatctcaaaaaacacaagacaacaatgttaaattttaatttttggcagtattctgagagggcaagacgtacgtcacctgagagatatttggaattgatcttgcaaacatatacagtcaagaaacttggtatagccccagtaaatccaagccaatttcttgcagctagattcggaccgcaagctgcaaaagcaaaaatattttatgaaacattttttttgaaggcagcagtgtagttagaatctatattgatttatcttgtctgtctaatcttttcattactgaccaagaagctaaaaaccaattaccaacaaggttaggcgagcacttgaagaataatgttcaagtatgcctttgcacagacagcgtgggcgatggttgttgaaccaaaataccaaatacagccaagctctacagttttttgaaccaaaataccaaatactgtaaaactcgttcattgagcacctttggcaggtgcctgaccggccctgctcacttgtacagccggccgtgccagccgctcgcttgtagaacagctattgccgccactgctgcaggttcaacttgaaatcagcaaatcaggacccttcacctcaagttttgatgccaatttttttctacatatctgatatttcctacaatatactaatgtgagtatctcgattaaaaaatcaaacacacgcccaacgattttgcaatttcctctagaaatttcgattgccatttgggatttgtggagataagcaacaaatactgacctgtatccgtagtcggagttgtaggggaggttggagagcagcgtctcatccatgccgtcgtccccgacacgtgtgacccgcgcgtaggcggtcgctttctgcgcaaggacctcgaacaataggccaggccggtgaggaactcccgcacatagtcggcgaatcctcagacatggatttatatggtgctaggttgttcacctcacccgcctggctccaattaacgaaccacacatccgccaacacctcgccctcctccaccgttggtcgatgacgagcagccgcggtaggaactgcacctcctcagccgcctccacccctcggcccccaccatcgtgacgacaacggagaggagcgtggccaggaagaggagactgcacgatggagattacggaagtggcggttcagacgaagagagaagatctaggttcagcgcgccggcggtaggggaggcgcgagctggatggagagggcaggcgcgggaggtgaggaggcaagggcgcaggcgggcgccagcggcggggatgtgcgggcggggtggagggcgagtgcctgcggcggagaggcgcgggcggtgtggtgggcgggcgcggtctgtggtgggcgacgtttttttttttcgctgctattggttctttttcgctaactgctgattactccaggtgggatcgctaattgcaggggttgatctaacttttaatatgagccgttggatgaatagatctaagggtcaggagagagaggtatttgataaactagtgctttttatattgaatatagatgattatccgattggattttgtatcggtttccgattttgttcttttgtccgtcgtacacctaaaagaagttgagtgtactctcctctaaatattatagcataattgtcctgcttcagttattaatagacgaaatttatttatgaacaaggtaatattgaatctttcttcagtggcctgtttgcttttggtatgaccagcaaacattggttttgggttttgcacattgtttaccatggtgatccttctgaacttatggtctgaattgtaggttattttgtggagggtgagcttctttgcctctcaaggatctgatgttgcacgagataatgtgcttaggttgtacaagcaaactgtcgatgctgtcatgtgcattcttttgcacacgaaatatcatccttcgcaatctcatgttcatctaattcatctaatggtcgaatgaagcaaatgtgcagcagcatttcatgtggcttgcgatgatttgtttcagttgtgctgctacattgctgagtggaattcacttcagctgtcctgaacctggtgggcggtggcgtccgttttcctcgccacagtttttacagtgactacatgctgtccttgggaaagactgaactgagctgcagcaggaagagcttctcgctagccgacctacgtaaattcgccaagccgcaggtaacacttcaaacaagtagatcagtcataaccatctgtacttcaaagaaatggacaagttcagaattgagaggactaattcagagagaacagatatgttcagacttcagaacttagatgtgataactgagcagagttatgtttttgctaggctgattatgtgctgagatattaggccctattgatttaaaaaagtccacagacttttagaaacaagataaatggaatggctttttccattaacgtgtggcacattacaagggaaattcaaaatatgctcttcaaacatattactcttgaaaatattgacaaccagacctgttacactgctatgaaaatggaattttttgcattgtcaatagtctcctacaagttcttctggttgggtgattatttctagagtgcttctatatagtttattcagcaccttagtgaaagtacctgttgtctcttatggtggataatgtgcgaaaacacatttttcgggaatacgctagaagcgtatttttgcattaagaggagtaaaacagacatttacaaccaaaggcaaaaactgcaggggacaggggaaccggacaagagaaaacataccccgccacgtgcctacacaccaccacaccgagaggaacacacggccacctccaaaacgatgccttcaagaaggtcacgacattcaaaacgccgccatcgcccatcccgaaaggatgaggttttcacctagaggatccttgaagagggggagggaagcacctcaacaacgccctcaagagggttggaatgcccaaagacgtcgccgttgctgtccaagaattgggccggctttcgcctagcacctgccaatgcccctcttgccgctacctcaccgactcccaggcaatgtcaacacgtggcctctacagcaacaatgcccctccgtcggctggactccaagcgacctaacctgctgccagcgcgacccccatagctacacgttggaacgagcacgaccaaaccaccgctgcacttcggcgaccagctagccttcctcccatgccgtcacctccaaagagagtgcccgccaccgcccatcactatcgataacaacctggggcaaccttgctgccaccttcaccgtctcgcaaaggagctccccacgaccaggcggtcaagaaggggaggagctccaaggagatgagaaggcacccacatggcgtcttgtcacaccccgaagttctttcccaagcctaaattgaagttataaatggtctcaagaaaataccagtgtaaagcaagagtaaaccttaataaattaatgcaaataataatcggaattggcatgtggaatttttcttgagttctacacgtcgaaattcgctaacaagatttttagtggaattttcagagccctcgaaataattttaaccaattaaaattgagcacatgcaattttaaatcccagggaaaatcttttcctccttttctttttcttttccctccttttcctcttcttgggccgtcggcccagtccaccccgccgccgtgcgcgccctcctccttgtgggccggcccaagccgcccctccctctctccccgggacgccgacaggtgggccccacttgtcagggtcgtccccttcctccggtcgcccgccctacgtcgccaccaccgccgaaaccgccgccgcgcccacgtccccgcctcctccgggccacgtcggccacgcccgtgcatgtgccgcgtctcccgcacccactcccccctctctcccgctcgcgcccgcgcccgagatggccgggattcgaattccgaatcccgcctctctcgcctcccctactccccacgtcggccggcgattcccgcccctaccggccacgtccgagttccccctcccctatttaagctccaccgccaccccctctctctttttccccatctcgccgaactctcccgagctctccatcgctcccgcaccgtgcatccacccgccgccgcctttcccgccactccggccgcctctagccgccgctaggctcgccgccacaccgcgccgtcgccgacgttgggttcgagtggccgagatccaccccgttcacccctcctccgtcgaggttcgccgccggagcgccattcccgccgagcgatggtgagagccgccatgtccaccgccttcggccggcattcccgccttctatggcccctctctccctctctaatcttttccttttcgttctttaggtcgtcccggaccccgtccaccgcttgtcgacctccctccgtcgctcctcgtcgccggtcgtcgccgccccctccggtgaggactccctcccctttcctttccttccccgtttccccgtgcgcctccgccacccgcgctcgccatcgccttcggtcgtcgccgccgccggggtgccgtccgctgccgccgcccgcgccgccgcttgccgtcgccggtggacgcacgcgtgccgccgcccttgccatggctggccggtcggctttgtgccgagcagagccgagccaggtcgccgctgcaccgtccgatcggccccgggccaatctgggccgtcgatcccgtggaccggctgtggaccacccgcgtggttccggtccacggtagaccggccaccccgtgcgccactgacatgcgggccccgcctgtcggcgccacccccttgatgacgtcagccctgggatttattgcgcaataaatgatttaagggctttttgttatagtaataaacatagtgaatcttctaaaattcataactaattcatccgagctccgtttaagcccgttcaagtctcagtaaatcaagaaaaatgtgtagaatccattaaaaatggttttgttctctgtttcagtagtcttatagcctgtttgtattgtttgctttgtatgtcgcttagattccggttcttccgacgctccggtgtacttcgagatagtcgctgaggttcttccagtagtagagcaaggcaagtcatgcttgtcacttgaacatgttgatcctatattacaaatgctctattgtttttctttaaatactgcattgttttataatgttactatgggatgtttacctactgtcatagtcgtactattttgtaccatgttcctttgttagcttgggatataacatgactagagattggactagggattgcttagccatgcttagttcaactagcacacaatgagggagatcctattaatgtttagactgtaggttctaatggtaatgttggattagtgacaccgcttcggtgttggttaattaaaataaatcacatggtgggctgtgggtgcatggttttgttggtcgcacccatggcagttaaggactggttcgcgggatgccctggaagaacttatcgtacttaccacaagccagcgtgggcaacggctgggcttgtagtgtagctttcctctagctgacgcatccaggcaagggtgggcgtgatggagcgaggcgggccctacgacggcctctgtcgcttccggattcacctaggcacgagaggggactgcccgctgccttgcgaggagtgggggtgaaatctgaggtgtggtgtgcttggttagagggggttatgcgaagggtcctgtcacgacctctttccggtatgtcgtggtggcatgtcggcgcacggaaacgtgtcgtggggctgtgtcttgtgggtacagttgtacacctctgatctgagtaaaactattcgaatagccgtgcccgcggttatgggcggtcaaccagattcaccgtgattagtctcaccctagtttagtctaatgaaattggatagtttaggtggatggttgggcctgttgcaacgtgggatagcgttggacagcggatgattaatattgattaattattacaactgtttacttctttcaacttctgtttataaatgctcgctttaggcaaatgaactactctagctctcctttgataaatccctgcatcatacccctattccagtatgacttgctgagtacagtgggtagtactcagtcttgctctattttccccaaccccagagtacgagtatgtgtcagatggtggtttctccgaggagtaggcttcgtccgtgccgtcgaggatgcctgtggagtggtgttcccactgcagatcaagtcaaggcttagctccagttatctttcgtttttccgctgcatttatgtaagacttttatgatgtttgtaagacgtggatctgaatgtcaacaccccggccggtcctggacggggattttaatgcacattctacttggaattctatttgggaatttctgggcgtgacacgtcccctcgtcatcgccggtcgtgatggcagtgctgtgcggctgaatccgagctcgaccctagatccggcggcatctccaccggccaacacctgcagcgctgccacacgggcgacgcgcaacgaccccgccgccgccatgcaagccggcgtcccagtcgggtcccccacaacgcagccatccatctggcagcagcccccaccggtggtcatccatgaggtccggcggcaagcatcgccggtgccagccactgccacgtcagcccgctgcacggcgccgcacgcatcgacctcgacgtcggcgtcctctcgtcgcgcatgcgccgtccttccgcacgcgccgtcctcctgtcgccggcgacgccggccatcacgaccctggccatccgggagtcggatccggccgcggggacgccggatccgagcggggcgcctccggagccgccgccgccttgccaggtgctgctcccagccaccgggccgccgccgctgcccccagccgcattgcgccgccgggccaccgtcgccacccccagccgcgcaccaccgcgggctgcgctgccgcgccagatccggccatgggggtgccggatccaccgccaccccacaccgccccaccgcctccacttctcccagcggtggggtacctatcggcgtcgccccgtccacgtcgcgccgggagggagctgccaagaggaagaaggacctcgccgccgccttccatgctcgctgctggctttgccgccggcgagctccggcggcggcgaggcgggggagagggggaggaggcacgggcggctagggttttcgccccccgagccgcccacgcgagaggacgcggggtagtcttctgtgtgcgaaaacacattcacttcttttctatatatcgttgctcaaaattcttgctaattattgaaatacacaattgttcagctaatatatatttccagatatcggtaaaaacacatgttctttacttcttttcccaagttgtgactcctcatactacaatatctatatacttgaagttgcacgctgtccagctttgcacgagtaaatgccatctttgaatgtctgagcagtaaatttttattgtgtggaattgtttttttatatgtatcatgccttccatctgtccattactctttttgcagggaaagcaaaatcaaggccccatgaaatatgcatcaatttataatcttgcttaggtctgtcaatttataagcatcaatgaaatatgcatcaatttataagcaaaaacagctccagcacgggcttaggtctgtgttacatggttaacccgattaaagagaaggacctaaactgtttgcaaggtggtcaagaaccaactaacccaacccagcctagctagcagtctaacacaatgcaaacccagcaccgatgagacgcatcctccaaacttcccaaagccttgttcggattgaagggattaaagagggaataaattccacaccacaaatctacgataggtgtagaatagattcccttcaatagggccccaagggagaagagagagatcctagcgcggtggtggtgtcggtgccggtgccaggcagctttgtgggaatcaatggcagtgagggcttcctggactaccctgactcgactgcaaatgcaacttccttagcacaggaggtggcaatggtgacttgtgattacctgccacctggatgaatttggctcacttggcactttggcagtcaaccaattttattgattttattaaaacagaaataaagatgttgtgtgagatccagtcaacaacctaggccgtgtttagttccaaaataattcttcaaacttccaacttttctatcacattaaaacttttctacaaacacaggcttccaacttttccatcacattgttccaaattcaaccaaacttccaattttagtgtgaaataaacacagccctacaaaagtgatgatagtaagtattaccgcttcatcacaaagcaattgacttttgggatcaaaatatagctcttttcccaagcggcccgtttggttggagggagtttttaggagggattgggagtttagaaggatgaggctattaagagttttgtttagttgaaagacatgggaattttggtgggatgaggatggggaattgaggaaggaactccctccttttcaatacctgggtaggggcaggtaattgagagggaattcctcctttactttgtttaagcaaatctccatctatttttattaatgacctaatctccaactaaattccctatcaatttccatcacctctaccaaacaagatattgggattaaaaatcaaatttccatcttaatctcatcatcaattccctcatgtaaactcccaatcctcttccctcgagttaccaaacaagccgtagaggtttcactaacataaagcatatatggctgtgtttagttcagcgcaaagtttggattttgcttgaaattggagatgatgtgactgaaaagttgtgtgtgtatgacagattgatgcaatggaaaaagactgaagtttggatccaaactttagatctaaacacagcctatataaatcggctgctgcaaattccaagcaaaataaaaaaaaattaagtgcagacagccatgttgcgttgtgcgcttttggggtacaaagtataaggtgctctttaaacaacctatcgagaccgaaacaaagatcggatgtgtgggtgttgacgacaaaaggaggagaagaagaagaagaagaaattcgaagatgaagagaggagttgaagagccaaaagctctcacccatgcactgtagttgcggtgaccgggagcaccctcgccggccatccccatcagctgcgctcttcggatcatcgccgctgccatgatcactgcggtttttttgctccttcgattcgatccgctctcgctcgcgtcggcatcgcctgcttgctagggttagctctcgctctcttttcccttcttccctgatccccgattcccgacccgacccgacggtctccctccggattttgtttgggttccttttttttcttgggctaattaaatccataccattacaactgctgtatcgattcagataaatgccactacaattcgtttattcgtaagcgtgccatccgaatacacgataggggcgaaactcctaaggcgattgacggtcaggagcgatcgggttttcctctcctccacgtggtttccttttttagcaccgtattactttcctattttagtaaatttatgcacccaaagtttatacacctcaagtttacacatctaaagtttacaaacccaaaagtttatatatccgattcaaatttgaatttgaattcaaatatttttatatataatatttctatacatctaaagtttatacacctaaagtttataaatcaaaagtttatatacccgattcaaatttgaatttgaattatatccgattcaagtttgaatttgaattcaaatatattttatacatagtatttctatacatctaaagtttatacacctaaagtttataagtcaaaagtttatatacctgattcaaatttgaatttgaattatatccgattcaaatttgaatttgaattcaaatattttttatatatagtatttctatacatctaaagtttatacacctaaagttgtttaggtttatagacccaaagtttataagtcaaaagtttacgtacacaattcaaatttgaatttgaattcaaatattgtttatagacccaaagtttataagtcaaaagtttacatacccgtttcaaatttaaatttgaattcaaatatttttcatatatagtatttctatacataaattttttcaactttgtttttttttaatttatagtgtagtagaaagagaagaaggggatgagaggagaggtgtgtaaagggggcatggggatcgctcgcgatcgatcgcccattagccacaccccaataggggttccaattgctatccaaataaataatgttcgagcatccttagttggagaaggattatgatgatattggctgctggtatcctttttgaaaacctgtacattcagtcacctggtaatggtatgcatgcatgcttaatattttctcttaagacatctgatggcaaattaatcatgtccatctttttagtagtactcagttcagctttcttaatgatgagagcaaaattaatctgtggatttgatttcagtctactatttctttgactaacttgtgagcatctttgttttgctgagcagcatgaagagaatccttaagaatttataattgttccaaagatttttaattcccgtctataagtttgttgtttgtttatagtgattgtgagcatttgtgtttgaacaatatgaacacccaaagctttgttatagacatgtaactatgtaagaatatgttggtgcccttgcatgcagggtactgtacttcttgcaaattaagtagcaatgcttggttctggagccacatccatatatactgtactgatgagcaacagaggtatgtatacacactagtacatatccttccaccatctgtgatggcctctaatatgtttggaattaacgggccgtcacaagaaagtcatctcaattcgaaaaaacgtccgattgaaatatggtcatacagacatgttacatgttagatgggtgcaaaactcaagcccgtcacagatgacatctatccgtaacgggccgtagtttaggcctgattgagatatccgtcacggatgaccatcatccgtgacgggcgccaacttgggggccaattgagataacaactaggcctgtcacaggtgactcatccgtgacaggctctatactaatacccgattgagataacttaatctctatcgggttttaactaatgcccgtcaccgatgagtatttttatatgaaatatttatatttataagttgacatgtagtaaaataattaactgcaatataataattcattttattagtcaaaataatttttcggatagtaaatgatttcaaatcgaaaaattgtcaaaaacaaaagttgtataacttatcaagatttacaacttttagtttggtcatttttctatataagttttttttaacagtttgaatttgaatttgaaaatatggcaacttcaaaacaacattttcaaatactaaatgatttcaaatggaaaaattgtcaacaacaaagttgtataacttatcaagatttacaacttttagtttggtcatttttctatataactttttttttgaacagtttgaatttgaatttgaaaatatgacaacttcaaaataatattttcaaataataaatgatttcaactaaaaagtcattaacaaaaaaagttgtataactcatcaagatatataacttttatttttgttatttttttatctgataaaatattagtaacatttataaaaccagatgagagatatcatgtggttccaagttgaaggcattccttggactattctgtcaaggaagacgaaagaaaactgaaactaacgtcactgcacttttttgtgtgcaaatggaaccacgctacttttatcagaaatatcttcagaacttcttcagtgttcagtattcgtgtgtgcttctcctaatctcttcggagaaaacgttcctaatcatttacttgttcgtctcattatttttcttttacaagcttgcatgcaccggcggcctgacgctgccgagaagagcatattttgacgttagagatacaaacaacttgatggtgatgattgaaaaagcccagcatacagacatcatttccgttgagtatgtagtactaaaatcgagagaagcacggcacaatcatagtacgcaataacaaatcatcaattactcccaccgtttcatgtcataagacattttaactttaatcaaagtcaaactgttttaagtttgatcaagtttgtagaaaaaatagtaacatttttaacccaagacaaatttattatgaaaatatattcaattattgatttgatgaaactaatttagtattataaatattactgtatttgactataaacttaatcaaatttaaaacagtttgattttgaccaaagttgaaacgtcttataacctgaaatggtcgaagtaataacaaatcatagtatacgttgcctcatgttgcctcatgttgcactaaggacaatgtggtagccattccgataaaaaaaagttgtcgcaagttttttaagtggaaaactttcagatataaatataatataattggagtgtaactatattgtaattgtattataactacgggagcgtatcctatgtacacaggccctcgcgtgtacacaccgtgtacaccaactaaaaattatcacaaaaaattctaggaaaattcatacatgtactttcaataatattacatctacgtgcaaaatcgcatcttcaaattcattctacatagagaataacaaaaaagataaaattctgacaaaattacaaccttaaaactgtcagattttttgttttttttgttacggctaaaatataatgaatttgacgttaagattttaaccctaggtgtaatacaattgaaagtataggaataattttttctagattttttggtgacattttttagttggtgtacacgtgtgtacacgtgagggcctgtgtgcataggatatgttgcctataactacatcgcaactgtgcaactgtgttgtaacttatatgtactgctgtggaagacacagaaaagctgactggctagttgcacatgcttgtgtacgtgatcgcacggtgtcagatttttaatcaacttttttttcataaaaaccataatactgtgaaataacacgaagcaaccccttccactgctagctttcaccctgttataaattttgtagaaatcctatatacttttgagaaatgtaatatgaagaagagcaaattccgtttttaaaggtggcgatataatactaagaagcacaagggtcttttgcaaaaaatcatccaaatctaatctcctgtcctcctcttccgccgcccccgccttctaccgttctccaccaccgcctatccttgccccagccgccagcatactacccctcctccccctatctccattgcccacgctcgcccaaaacgttctcccctccacacggtgacggtggcggtgagacaataggggtgttgcggggccaggactgcagcctagactggtggtggctagtgccgcccagccaaacaagccggcactcgccctcccatccggtcctaggttgaacttatattttgggagagaggtagtactagtgcaccaccacatcaaacaaccaactcaaacgcataataaaccataaacacaatattttagccactattacaaatgcacatgcataaaacataaagataatattttagctacatgacatgatagtcagaaacacgagtcatcacaaagagttgtgtcaagtgcaggtatatttttttgtccctgacagcaacggtttgctttccacaactaaatagaagcatcagtagcaaactttgcatccttatgtggagcatctcttccagctttccatatcccaactgcactgaatgcagcaaataactcaactacatgacatccaaacactagcttatctcgaaatgcacccctgggcatcccgcaggaagtcaacagcctgtgtgaatgacaaaacatatgtgaagctgaaaccgagatggaaaacaaagatgatagtaattgtgagcaaccacataccggttgagcgcatttctatcttcattctccagcctttttaccttctccacatcttcaataattgccttcttcgtcttcgtcttcaattcatcaagttctttgaggatgttggcctttttgacgtgattaggattcacatgtttgaacacaaattaagacaagaatgatcaattactcatggtatcagaggacggaaagtcatcagcattgctaatgttgttagagcaggtacaatagcaggctataagccaactataaatatattttaaagagaaaaaataagatagagaagagcagcgggctgcagatctatagtcagctgcagcacggactccaagacgtaatgtgtgtatgataggtgtgaccatgtataatagtatagtaagcaactattgtatgaattgactatatattggctatacatgatttggagctagtagtgggctatactattaaacttgctctcagtgatatgcatttactcctcaacattgccagctaattaatttaatataataaaaaagtatagtggaccacctatttaattgacctattacatatagatggaccacctcgctattgtctccatattataatataatctccaaacaaagcaaacgcagaaaataaaacagatcgattcgactcccccaattagtgcagccgaagagaagagaaagatagccgagagagagggagattaaagagatgaatctccctcgatcgaaccacacaaggatgaactggaggcaggggcagcattgcagttacctcgtccgtggcgctgatggtggagaagggtcgacggctgcggagaagcatccgcgactgcatcagcacggcgtggcggagcgacatcagggaatccacctctctctctgtctctcgtctcgtagaggaagaacaaggctagggtttcgatcgtgcggaagaagaacgggaggatatagtactatttgtttcttttcctttttttccctttatctcttctttaaattaaataaaaaaatatataaaaacacttatccgtttcccgtccctaataggagtactaacaaacagctgtactgtcctatcctatatatttaatgtattactgctatattattaattactagaaaattatctgtgcgttgcaacgggtaaatacgttttcttagtgattgaaacattgcgatcactatactttatgattaaaaaatttaatgaaaatcctaacactgatattgctatccattataattaaaaatttaatgaaaatcattccttcgttttaaaccgaaaactcactcgttcattcctttaaatccctaggccattatgtaacctccactcaggctgcctccctttgaaccagccaacaagtagagccgcaggctcagaagactattgtcttttaacctcccaaagatagaccaatgcccatacgacgtcggagcagatctttcccatcaaatctgactgaattttgctcgatctcccaaaattggttgagggctttcgatccactcgatctactctttccgtcttccaaaatcagaggtaaaactcacgataaaaacaaccggggaagatcgtctatagtcggagattaaatctggtaaattaaaagtcgcatcaaaaggggaaatcatgtagaaaatgatgagagaagagcggggaatcgattttttaatcaattagagtagataatgcgcaatcgacatgaaggcggcatggcgctagggttcggcccgagcagcggcaggaggtgcgcggatggcgcggtggaatagatcggggaataaaacggtcaaaaaaaaacccagacagaaactgaaaaaaaaatggaccaaaaaaaaccagacggaaattgaaaaataaatggacaaaataaagcggtgcaatagatatcagttgggatcgggaaaaaaaagctgcaacaaaagaaaagatagaaaccgaaacaaaacaaacagaccgaaataaacagaagctgtgattgtggcgtgttcgccagtcggacaatgggcgggagtagataaaaaaaattaaaaacctaactcgatacctaatccaacacggatgacgtaccaaaattctggcaaaaatatctttaatttttataatagtaaagattaaaaaaaaactcgtggaaataaattatatacttgctcactgatatattagtacaatttttttatactagaaaaaatgcccgtgcgttgcaacagttaaaaacattttccagtggtacaaccgctattagaaactgagctatattagtaagttgtttggattcaagggttattttgagagctatttgacctttaatgtacctttccatggagagatatagagaaaagatatttttttagcgggcccacccaaaatagccccaattagcacctcttgggtgggatattttttgggtgggttatttccaaatagccctcaaatagctcatccttttggttctttttgggttatttgggctatttgagggagggctagccattatgtagtactagtgtactctctccgtccaaaaaaaacccaacctataatgaaatgagatatatttagcacaatgtgtcaacctcgttgtattagaatatgtcacaccacatcttaattttttttttactgagggagtaattagtagtagtactccaaatttgttttgttattattcttttgtgagagagaattaaattgctactagaacgaaagaggnagacgggtaagatgggccgtgctgagcctgggcctgtggcagagagagggagagagagatatatgcgtcagatggaaccctaactgaaaatccgaaatccatccatgtccatgtccatgtccaagtcgatgtcgttcgccggaacaaggatgatggccgcggcggcccggcgcgccttccactcccagcctccgtccggccccctcaccgacatcgcggaagaatcgcaggttgagatcgtctgtttgtttggttggttttggggatcgatcgatctttggttgctgctcatcagttgattaattgaattgatcgctaggtgatcagctccctttatgaggtggcaaaggcgaagaatctttcccgggtgccacggcagttggatccttcgacgcgggtgcacatcgctctagatatcgagcacaaaatcagcatgatcaggatcggggctagtccttccgaaccgcaaggatttatttatttcttaaaatatactaatactctctctattcctaaatatttaacgccgttgactttagattactagcaccctgcccgagattttatcgaggaaaaggggatggcgtcaacgaaatttcttgacatgggttaagataaacatcaatcttccgtgcgatattatgtaggaagttactaatctgacccaaaagaaataataatactccctccgtcccaaagaataaatcctagaaacggatgagatatttatttgtactacaaatctgtactgagaaatatcttatttgattataggttcttatattttgggacggatggagtaataaaaataagctttaatgactcactcaccgaagcaacaggttcaaatgatcgacagcatagatgaaacccatttgtgattgattccaaaatagaaacctgaataatagataaactgatcagtcattagcataatctactactattctaccttgaattatggcgctggtcaaggaccgctatataggtgtatgctagtactgatcgctgacatttacaaactaagtaaaatgatcaaactcctttctgaacctaagccagcaaaacagacaacgttgatcattttctgttgaatagcgtcctcaacaagcggtgcattttcggtcgagcatcttgagagaacgcaacacaagagagagcgatgtttcaggaccgacaaaatctgctgtggatagcaactgaatttctggagaccgaacgactgccccatctgatcaggggctgcctgaaagaccaagagcctgcttgcctaacatcgtggccgtgggccaagcagttttctctcatagataagaatatcctgctcttagcaccggttttcacttcgtgtagcagatgccatcactgaccgatggtttcccagtcaaaagctccagcaagttgtctccaaaactataaatactggcagccatcgccaacctcattgtgtatgcatattctgcaatcataattcaacagaatttagtttcagtacatatctgatatcccatagatttcggcaagtgttatccgctagatgacgggagggggatgggggaagaagaagggcgggagaggcgctgggagggggaggggattaggtgactggtgcgcgggtaggggtggcgctggcagcagaggacgtgatgtcatgataggaatcggatgcggatgaagctcagagaaacgacggacggaaaatctgtggcaattggaaaaatacgaatttttttaagtatatataggttagatatgcataataaaaatgatgatacgtatgatgaactaaaaattgatcttggtttgcgttgcagatcactccgtggggacatttggtttgacaactgttgggcaaacaatctttctttagtttgtcttttatccacattgtttggggtgtgtgaggctcgagccaaggagaatcaacagtctgaccatatgtcctcctcgtcaccaccctcgtaataaattattatgtgtaaaatcatgagttcaaatggattttattagattatagtataatatgtacgtcttgttatcttcattatgattttacctcttgtggtatttatgtactccctccttttcacaatgtaagtcattctaacatttttcacatttatatatatctagattcattaacatcaatatgaatatgggaaatgctagaatgacttacattgtgaaacggaggaagtattattagtaccaacctccttaatttaaaccttgtgtgttcttaatgcattactacctccttaaatttaagccttgtggtctttattattaatacctcagtaatttaagccttgtggtcttgatgtactaacctccttaatttaaaagccttgttgtcttgatccattagtacctccttactttaatttgtaggcagtgtcacaacttaaagagttaagagtaactttaagtggtacaactatatgtttgtctcgaacttttttatttgtgcatgactccatgcacccaaatacaacttgctcacttactttcatgatgccttgtggtgaactgtttgctatgttgttaagattgctgaaatatttgtggttaagacgcatctttgttcattgttaccgacagttaattgatgctttatgaacctcctattctcaaacagcttcctagcaagatgatatcttgttacttttttttttttgcctataagatgtgcttgttttcctaggtggctgggctggtgccaagcgcctagtcattcttggtggctgccaagcttcttgtttggtgttattcgtgttaagtgatgcataattgcgatgagcaggtgcttttgttcgaataatggttcatactgcaatttccatcgggtgtcctttcagcatatatttcagtgctattagttatgattacctgttattattttgctccgacgtgtacaataaaatcgccgaggctgagagcctttatgaggcgcaagcacaagtatagcaatcaccttatagtatcacccttatactaagtggaaaaacaaaacttgtacaccgtaataacccctcaatttttttctttaaaccgtctgctttatatcctaataactcaattttagtatcacgcttactatggcaaatgctgtgacgagaaaatgtggagtgaagctgagatttgtaggtcagtgcctgtttagcacagctccatctcttttaaagttagagctcaactaaacagtttcagctccacctaaaatgagaacggagttaggtagagctttatcataaaatgaactagagatgtgaagctagatttagacagctgtacaactccacttcaaaccaactcttatagctaaatttaaaaatttgagctctaccaaacaggctgtctgtactactacccgcttgattttgcaaatgcactgcacgctagctgctttctgttccggggttcgaacgcgagctgctcgatcagctgcgaatgactaatgtaattttggaaacggatgctgaattcttgtctgcgcgcatgccctttgcgccatgtactgcttcctagtactgtcctcggtcttgtaaacttggccaatgtttagattccacctaaaattttacatcatgttatatcgaacgtttgaacacctgtataaaatattaaatataggctaaaaataactaattgcatatattgtgaataatttgcgagatgaatcttttaaacctaattgctctatgatttgacaatgttgtgttacagtaaacatttgttaatgatgaattaattaggcttatatataattagtttttttattagtgcccaaacactctatgtgacatcctatacaatatccgatgtggcatgtcaaaactttacacccctaatctaaacaccccctttgtgtagcacatagttttgctgcatatggaatcatgtctgctgactcgcatgagtacaggcacccaactttgtatctgatcgtgtcttcagggattcacctggagttagtctctgtatacacggtgaatttgatgtttctatattaaattacagtgatttaagattttaaattttttatctatattaagattatttaaatattatccacgtaattgtaggaatacccagcttcaaaaaatcttgaaataaagttgtgtcaaagaggactctgtagtgatggttaacgaagggccattttggtttgataccaaaaacatgccctactaatttattggcaaatgtaaatagtttgtgtgttagtttagattgaggtcaaatatttggtagtgcctctatcctatttggttatattttagaagtttcttcactaaactataataatattactttatattggtagcaatccaaatgttagctaaataattttaccctatcaatattttggtagtgccaaaatttacctagagtgtgatattaccaatgaattgatagggtaaggaaccaaacaagcccaaaaacctcagcttcaaaagaaaaaaaaaagaagaatagacttcgcatacatgatgatcatcacctggtaatacaaatcgccaaaggattaaagcatcaccaacataatgtatataatccaccccaaaattttgttttggtttcttaaactgaaaatagaaagtgaactcatctctttaagagaaagcctaaataaaaactaaaaatggaccattcttttaaactaccaatagaaatctcccattccatcaaagatcaacgctgatctccctccccaacgccaatttcccccaccacaccatcccatgtcagttgttctttccctctcccctctattccccactgttgctgccccacctctccctacttgcagggacggatctagaaataaataatagtgggggctgaataaactacatcatcataaatcaaatctccagtccccacatcttatgaatctatggaaaaaaatagtgggggcttaagggggtctgcactgtcccgggggcggtagtggggtctcaagatccccccccccccaattgtgagtccgcccctgcctacttgccctcgttctgctaaaaaaataggaatatgagtcgtcgaaacaacttccttcaaatgctactagacgatgagtcttcgtcggatgacgacgatgaattaatttttgagatagttgaaacagagtatgatagtaacagttttacatttagatgcaaaattattttgcatctaaaatgttgaaaatgattttcataaattagaaataccaaaattttccaactaaagacctaggtgagtctaatataacttgtgcctatatgaaactttgtgaataatttaaacatttttcctttctaacccaaaataaaaaaattttggattttacttgcattgcataataggtcttataaataaaatgtagggagtggcaaagttcttcaatcatggccacacctaggaggggaagcaaggagttgaattgaagatgggggaagagaagctgtgaagtgttttacaaggatgtcgagcttgccaccgtagaggctggcgacctcgcggagcatgcgttccggctggtcccggacggagacgtcgcggactgagccggtgacgcggaaccccctgccctcccactccctgaggcgctcgcccagctcggcctcgttcctggagcaggtatgcacggccgcccccagcgccgccagctcgtccaccaccgcacgcctgcgcatgaattccccgcgttgatcgtagaagcaacagaaggctccgcggcggaggtctccctagccagcgagaaggggataagtgtgttggggtgagtatccgatgccgccggcagggttttaaatttcgaaattgctatttctgtcgaggacactgaaattttagaaatttcgaatttttttgaccgaaattatttaaaagtttaactgattttgaatgaatttgaatacaaattgacaaattgacaaaaaaattgtaaaaaaacgaaaatttcgggcgagatatgagcttgccggtgggagggcaaaattaacgaaatttcaaaccctagctgcaggtgtcgccggtaatgagggtcctcttgctggccgaggggccatcttcccgcatcgccgctggccatcgccttagtactgtggttcctctttgctctagctatggcaatcctgtcccatctgtttgcaggaaggatgggggtattttgcgaagaagtcctatatcggatctgttcttcggaaaaaactcttcgaaaatatatactgtaaagtttatatagtgtacaaacttagaaactaacattggataaaaattggacatataagatttattcacatcactcttagtaaatttttcactatttgtaatttttttattaagagtataaattttactcacgataatgtggagaaatttcatacgtctattttttcatataacgattgttttatatttacactacttatcggtagttattcggttgttttgtgaaaagatcagaacgcggtaagcctgtaatgatcaaaaattttcacataaggtctccagactcgggagtccggccgctatgatcgatagcggtccggtctctactactctctccgtttcacaatgtaagtcattctagcattttccacattcatattaatgttaaagaatctagacatatatatatatatatatatatatatatatatatatatatatacatacatatatatatatatatatatattcattaacatcaatatgaatatgaaaaatgttagaatgacttacattgtgaaacggagaaagtatcaagcttcctccggatgaaccgtgggatgctggtcagagagagttagcctggagcgttggccagttcggacttcggaggatacaaaaaagtatctaaattcacaacacaaccattctattcatgtcttcttcaccagcaacatctgttcaatctccaaataataataataataaagaaaaaaaacctaattaaacaacatcttcagttcacctgcctttagcgaggcttcggttggctttgtctgtaagagcttggtcgatcgctgctgtaatcgctgctagtgtttccctgactccccggcgctcttcttgatcgtggcccgatggactcacccgattccatgatggaactgtaggtatcttctgcgtacgtagtcctaaatatagagtttagatcttctccatgcgtttgtccttgcaagtgcttcaggatctgaaaggagaaaaggaacttcttgtcacatataggagtatcaaatatcagttatttggttatgtagttattgttctattttattctggaacaaggcactaccactacttgtacagttgtactgaaggtttagcagtttcgatgtttcaaactcaaaacttttcagggaaggaaacgaacctgaaccatggatggacgcagatgtgctgattggcgcacggcagcggcggcacactccatcattcgcatcattttgttttcatcataatcatctccaatatccggatcaacaaggatatcaaagttgccttcctccatagcttctgaaatcaagggttttgcctgaagaagcaaattcagaaatgttctatcaggctagacatcaaagttcctcttagaactacatttattggagtgaaggaaatgtattagatgtcaaggaatgaattttgtcaagattcaagaacttctttttgttagaaactgacccaaccaactaacgtgctgtccatgtaagactcagatgactgaaccggcagccttccagttatcagttccaagaggacgacaccaaaagcaaagacatcggctttgtcagtaagtttcccgctagacaggaactctggagcaatgtacctgcagaaaagaggatttgctatgaatacaatgagggataatatatacttgtgctatagatattcatgttcagaaattagaatgaacaaactcggaatacatagggaatgctgaagagaagtactgacccaaatgtgcccattattcttgtggaaacatgggtgtggtttcctggttgatactttgctagaccaaaatctgcaacctgcaaaggatcaagacatactgagtataggactgtgcaatataatggcatattgtttgcaattcaaacttgtcctgggattgcttcaaaaaaaaaacttgtcctgggaaaaccagatcttcttgaaacgttgaataatatgtgcagagagagtaccttgggctcaaaaccatgatccagaagaatattggatgccttgacatcacgatgtataattttaggagaacctgaatagtataaacggactttttcgtattaaatcacagttcaacactagatacgaaactgaatataagtgtataacgcgaaatggatgggtggagtagaactaacagtcatcgtgtagataggccaaaccccttgcagatcccacagcaattttccatctttgctgccaatccagaggtggccacttgtcccctgaattaagttcaacagtaacatgatcagatcagagtaaaaaaccaagactaaaaaaacattgactaaacagtcaacggatgcatttgacagaagaaaaaacaaatatgtaaaccattattttttttattcattttagatgtagacataggttttataccgtgtaaatgcgtgtcgagcgtcttgttggggacgaactcgtaaaccagcagcctgtcgttgccggagatgcagtatccgacgagggagacgaggttcctgtggtgcacgcgtgtgatgatgtccgcctcggcgcggaactcgcggtcgccctgcttgctctccgtcttgagcttcttgatcgccacctcggtgccgtcctgcagcctccccctgtacacgcacccgaatccgccctgcccgatgacgttgtcgggggagaacccgcccgtcgcggcggccagctggtcgtacgagagcgagccgccgtcgatggagatggagtgcgggcgctcggagccggcgtcggagaacgtgccgccgctggtctgcggcgccgtcgggtggtggtggtgctgctgcatgaagacgaatggcagcggcggctggtcacctgcaagcaccaaagtgtggtggatatctccgacgacgacgacgacatggacgtacgtacgtacacgacgtcgaacgtgacaagaatcacaagatgcgcgcacctttgtagtaggggttggggttgtataacattggcggtggtagcggaagcggctgggcctgttgccgccgccgccgccgcctccatcgccggatccagagcgcgagcacgcacaagcccaaaaccagaccgacaaccccagcggccactttgacggccacggaattcaagaacgagggcgagcccgtctggggtgccgcgggtgccgggtcggacgccggggccgtcgtgatgatctcggtcacggcacggcgtgctctctgcccgtggccggaggagatgacgacgacaccatgcaccgtcgtcggtccaccggtgatggtcaccagggcggccttggcgcgatccaccacgtcatagagcctcgcgaaagctgaaggctcttcagggggtacatactgaggcggtgggggtacgaacgctgccggccgtgccatctcggccggttgggaataccggaaacgcgcccacatcaccccgtctgcggttgtgcgtgtgcgcggctcggtgcgcgcgaaacggaggcttttatagtgggttatggcgagagatttttaggtaaaaatatgttaaatgtaattatagtataaatatagtgtaattacatactaactatgtttttaatagatcacatcgttgacttttgaagatatgtttaatcaattcgtcttattaaaaaatttatgcaaatgtataagatataaataatgtttaaaatactttcaatgataaaataactcgcaacataataaattataattatgtaatttttttattaagacgaatgataaatgtatggcaaaaagtcagcggcgtcttctattaaaaaacagaaataatatatatgtaatttagcttcttagggcatccacaatatagtctaaaagtggtccataagcaatacaatatttgtttcagccacctagcaatattgtggaactagtccatagcaaagaaataacaaaaactacccataagcatataagcatatgggctaccttccatactcgtaaaggaagtcgtttaggataatgtttaagtcaaacattgggaatataaatcatgaataactctcaagttgttgagtttgaaaatgtaaaaaatatatgaatagatttgtcttgaaaaatactttcataaaagtatacatatatcactttttaataaatatttttataaaaataataagtcaaagttgtattttggagactgtgtcgctgtccaaaaacgacttcctttatgagtacagagggagtattatttgtctctgtcctatctatatggactattttgatatatacattgttgttgccattacaatataaatacatgctgatacctttttcatgaaaaatttgatgacacagaactccgtttgtaagctctcactccttctgtctcgctgagctgggctggcggttttctcctcaactatgcggcgcgtcatgcctctgtttccgcgcgaaaacagagtgcaagttgccacgggctgcacacgaaagcggagacgaccactcggttttggaggtgggaacagcagagacccactggaggcatccaccaatctgcggtgttggtaacaccgtaagtactcctacgtaacaatgacagaaatgagcgtggcaaatccgtgggccgaacggctggagacggcagcacggaccgggacttgtgctatcatccaaagtctaggtttaatgtgttggctagtgtgtataggaatgaacagttgtcgctgtccagaacaatgagttgacgttcacttttcaagacattaaacgtgtaatgagtaatcagggcgctctatcgtgcgagggttaagtattaacaagtcaaattcaatgatgaccttcatcaacgttaaaaactggataagttaactagctggccattgtcagcccagcagttgtgccagtagatcagatattgccaatatgtagaagcgtgtgtttatactacgtcgtacaattgctcgtatatatatatatcttgagcagcccatcgttttacaatttaatatgttgatgaagtacaatactctctcaatcctaatataaatataactttgtattgatgtgactgtatgctcagatttataactatagaatataccatatttgtacaaggtttcacttgtattgagacggagggagtagagttcaactactttagtaggtaaaactatgagaataatatgtaggcctagaatgagataagttcatggggaaggattgggatcctttgcatcagagtacaaaaatttgcaccatccattcacaatcaattcactaaacgaagcattttcgagacttccgtgaaagtcttcttttagcttgagttcatcggcctgttggcgtcccattttttttccgcttattaccatcttctgaattaggtagagtgggagcactcgacgaggcatctacgacagtagaggctcttcctcgttttcggccggacaattccataaatagaataaaaaaaaagtaaataagatcaagtaaccagaagaattgtgagaaataaatcaatttattaagttgagacacatcgagggataaaacatttcatactatcatcataagttgattccatttacaattgaatttatttattttttttgtttctttttatgtgagtaaattttattttgggccatatatttttacccatgttgcagcttgggctaggttttagctgagtttttcaccttggaccacttaatataaccatttgtttcatcctggaccatagccgctcatcttctccgagtccaacaggcgataacccatcaccaacgtgctcatccgaacaagcgttggcggcagcggcggttactgatgcgcttatttgatttgatcacaacacattagcttggttgctccatgctccacaatcccagccggccagccaagttacacctacaaccaaatgggcaatggaacatggcttccgttcactgaagcaacaaaaattgatgcaacatcattaaaattagaacaactcaaaccatgcatttgtgttgcctctgtccctaatgtaagcatcaacaaattactagttgctatttgaatcgattcccttgcctcacctcgctgttgtcgccgatccgccatgagctcgccggcctcgccctcgtcgacggctggcgtagtgcatctcgacaacacggcagctgagagggacgtgatctagcaagccaaaatggccctcatggcctagagctaacctgccgtcggctgaacggagaagtgcgccgcagtgcgaatcagctgtgcgttgctgctaaactcccctcggataggactaggagctattggcattaatcaagcacttatcctcttgtgctcaccacatcctcctcccatcgatagcccaaaatgctattcatgatgatagtgatagcaactcaagcaatactaacgcactgcccctggtccaaactgctatattttgataaagttagatggtgttaagtgaaaagattggtaaatccctggtgcattgtacaactaggctaataaaaaggggtccaagataaaccgaatcgaacaccgaagaaaaaaaaccgatatttaggttcggtcctttgattttcgttttgtttttatttggcccaccacaagtcaatcgcgcccctttcttctccccaaagaagcacaagaagaggaagagcttggcgacgatggcgagcggcagcatcgtgaagaaggaggtcggcgagaaccacgacgtgctcctcttcggcgtcaacaacagcgtcaagggcgacctcgcgccgcagcacccgatccaggccaccgtccacaaggtacccgtcgctgattcccctctcctcgccccctcgaaaaccctaacgcgctgaatccgggtgattggtggtggggcttgcccgcgcgcaggaggccaagttctgggcggataagaagaggttcggggcggaagccatctacggatccgctttcaacatccgcaaggatctcgatgcccaaatcctctccaagtaatttcactatcctatccccccatatgatttcgctgggaaaacgatttgttcgagtaaataatcacttgcggttcatgttaacattagataactgtgtcggtattacatagcatatattggaattgttagggtcaatgacaattttgggtggaattcctcacactcaaatggccttattgtgggacgagatatgtttctttgaatttgatgatggcatgtattccccctgtgtttgtctgttagataaccctcgcagtacataaaaaaaaaacctcgcatttacataattttctgtaggcttcaattaaaaaataaactcaaggtctcgaaggatcaaattaaatatgtacaaatgaaaaaccccaaacaaccagacgttacgtaatcattagcatgcaaatcaaacgggaaattaggggatttcgtgggttagggaaaataatctcacccgatcgctcgctggctcattgttgcttctcatgagacaccagccatcgcacttgctgtgtttgtgcgtctacccgaggacagtacaaggcaaagagacaaaccaacaaacaagttagtttcaggttgcgataacaggcatgttagctgctgttgtgtcgggtactcggatgttgtttatgggttgagcaagagagcaaataatggaccaattatgtctgagtattggtgtcaaaagacaaggttctctggcgtcacccatgagagaatagaatagagcacttggaacaggccaaagccattggtatcatgtgacaccactgctataacgttggatccacccctgttttgtgtgtctagttgtaaatccgttagctctttgcatttactgcaactattttgctcttattgtcgtatgcatcaagtgtcagtgatgttatgtttagtggtcatcagcggtattctgctaactgttactccctccattctaaaatttaagtcacaaccacctttaacctaaagaccaaaaaacaataatcacctcattgtttgaatcatcataataaatactaatgcatgcaccctatagaattagagatcttgagggtgaaggatttaagaaataataatttagtggagaggaggtgctagttaacagcctcatcttttggcttatgcttatgtttataagccaaaaattgaattttcaaccttaaatttggaattgattttggggttttttcatcatagtttattttccagcctttgtcttttagatcgctaaaaacacggatataaaaaatttatttgcaaattattttctgtttgcaaatatgccatttcacttattctgtcaataagcaaaacgatgggggtcctaatttcaatgcatgcatgtacaccttgtataatgaaacgtgaaaaaaagtagttgtgccgtatattttggaatggaggtagtagtttgcaagttatttctgaaatttgttctcgtggctatgtgcagtattttgagcactgtttttaaggtgtttaattaggtcctgtttcttcaagagcatttccacaaatcaaatattaggactgctaagaatgtattaatgctttgagtatgctaacatggatggaatgtctggattccttggtctggttgaatacacaatcatatcttgaggttgctcttgtttgtctctccgtctctccgatgtagtaacaactaacaactagcacatcagcgcaactgtgcaaataagggaaaaacagcgtgcgcaactcatgcccaggctaacattcaagatgttttggttgatgatttatctgtttgcaggttccaaaggccccctggtgcattgccatcatctatgctaggatacgaggcgctgactggttccttggatgatttcgggtttgaagattatctcaactgtaaggcttgttgtcctttgatttcctatgaatcttcttgctggcctttcacatttacgtgcaactatttgctcaccaacttttgctgatttattagctgcatgtttgatgcttatgttcttcattggaattatggaatccagtgctatcaagttctcattacctttatattaattctagtttttttattttagtagaacaaaaccatgtagtcttatgattccttgggagtttagaagttcttgggaaaccaagggtcatgaaatgatacttgtttttcatttttcatacttctagtcggtacatcttgataaaattttgctattaggatatacttggaggaatgtataataattatcacaaagtggttattttattctgtcctcatgatatgatatattaacagcaaattacatattttgctttgtcatccaagcttggttggccttactttgcatggcaaaacatacatctcatcaccattttcagtgatgagatgtatcaccagaaatacagcctctatagactatatatatttcagtcccacttctgccctgggaacattttttttcttatttacactcgctgagtgttcttcctgttgttggaaatgttacttagccttgtgttaattttctttttaccttggatcatgttgcagtgccccaagattctgacagcttccatgctccagacatgcaccacggaatggaggttcgccttggtttgtcaaagggaccgatttgccctagtttcaattgatttcacaaaatgtatttctcgtcttgcactgttctcctcattcaatatctatgtcgctctttagactgagatttcgatgcttgttttggttcataaccacacttgtgacgagattccttatccatcatgtagacctcacatgtcattgagataaaagagtgtgacaagagtgtctcatgctagctaaagtgtggctccaattttgttagccacacattaggcaagttggtcaaaacattgtgtcaaccttgcataaatagaaatactcaaccaaacagtccattacgcttatacactgtcaaatcaaaatgggacagtttcagactttggccgtggcttccatccatcgtcaatgcttcaagtgtggggacttcttcaacagccccatccattgtcgtaccatgtggttgatctaatataaaggcattccgagttgagctatttaaacaacccaactaaaatagtactccctccatctacttttgatagacatatttccaaatctgaaaaatttacttttgataggcatatttcaattcaatcacctatcctattaatgactttctatgatttaatgcgtgactctccattcttccacacaagattggctacatgggcatcgagaaatgtaaatattaatgaatcgtttgtttacgaggaataactagtagcatgtttaaatggatgataaatagaattatttttccttggtcattgtgacaagataaaatatgactatcaaaagtagatgtaagtagatggagggaatagtattggtaaatctctctctgcgagtaaagttcggcggcatgagttcttgctttctttggaccctcgttggtacatgcaaatacagagcagcgagtaatgcaattctcgttccctcattgcatgaactacgttccaaaatcatctcgatcggtgcaggtgtaggcctaacctttctgaaaaatcatttgcgtctctgaaatactccactccaggcagcacccggcaaatgctagttaggtccatcatagttttcacttgaaaagaagcctgccgaaggttccaataatttgaacaagcaaacagaacactggaattgcatgtatgtctcaaaatcgcagagtattgactcctttttcggacacgttttatttgtcagttgcgactgaaaaggacacatagaagaatggatgtgctaaaaatgatcgtccgtcatatgaaagatacatttaatgtgaagagcacttggggcacattgagttgtttagagattttgcataacacaaggaaatatttagtggaaatcatcaaataaatgaaaacccatgaaagccatacttacatattctctaaattcaagaaaaatttgctaaagataggtatatgcaagaaatacattcatactagatctagaggcgatagtggaggccgcggggtgcggttgccaaatctagccccctctcgttcggatccggcttgtccggcgctggaggctgaccctcaagccaccaccagcggagaggtgacggcgcggacgtggaggtggcagagtgaggtagaaagggcgcgacgacgcgccatcgatggagggcatgcccgcgcggtgcgatcggtggagaagggaggaagtggggcaccagctaggagtggccagtggcggcggtaggctggcgtggtgctgctaggaagcccacctgacggtggtaggactatggaagtccaacgcggcgtggcgatgcaagaggtcgatgcaggcaggtcgatgcgggtggcaccagcggtagcagaaggctggcgtggacggcgtcgggaggttggcgcgacaacgacaaagaagccagcctgactgatggcgtgaaggtcgacgcacgcgccaacggcaaagaagctggcctgactgatggcatggaggtcaacacagtgatgacagggagtccaatgatggtggtgtgtgccacaaggcatgctgagactgactgacggggggtgtcggtgcagcagtggccacgtgcctacgaaggatggccggtggtgaaggaatggagcatagctatggatcgataggggtgagaggtaggtgtaaaatctagcttggtcttaacggcttgggaaaaacacaagggttaacgtgctcaagtgaattaattatacttctatctctcgataattcaactgaactgttgtcttccttgtaaaatcaaacttagttatgctactttctccattttaaaatataaaaatctagtaccgaatgatatattttctattactatgaatatgtatctatagaaaatgttttatttaaatttaggttattatattttaagacgtaggtgacatctaaataccgttagtatggatttattgcttgaagttgccaacgtgtggtacgtgtgtgccatatgcttacgtcctcgtctatttaggcgaacggaacagccaaaagaagcaaatggaagcccaaaatggaaggcagaaggaagattatacaaatccattgtgacttgggtttaatttgtgggagcgccggagtagcctgtcgatttcagtaatgccggccagggccagtgtgcactgtgcagcgatgaaactccatccatgggcgcggtcaaatccggggggagagagagagagggaatgggaatgcgtttacttggccgggacacgacgtgcagcctcgtccacgtacacgcgagcagagcagtaaaatcgcccgccgcgacaacgagtggatcggaggggagccaactgtgaagtactagtactactcaagtgcggtacacatgtactacctgccaggccgcgactctctcctttttttaaaaaaaaaattacacaactacaacagagacactcacaatacacgcgcactcacctttataaacacatacacgtaaaacctacccctatgagtatctttgaagactagaccatcaaatccttaagattgacgaagtcactacagacatctcgctatcgacaggtacgtcgcctaccactgaaagcacaacgccgataaatcctagaaaatttgctaccatggaaagttaaacccaggacctataagatactactgagtctctcgtaaccgtacaggttttttcgcgccgcgactctctccttcgcgaaagccgacgcttgtatgcatgacacgcgtttgtgacagcttacccaagtctaagtacgtctttctgcccttttaactagttcaatattctctcagttcttaaaaaaaaaaagacaaatcctaggtttccgtgtccaacgtttaactgttcgtcttatatgaaattattttataattagtatttttattgttgttagatgataaaacatgattaatactttatgtgtgacttgtttttttaatttttttcatataagacggacggtcaaacgttggatatgaaaacctaagtttgtcttttttggacggagggattattgaacagttctcatttccatacttgttatcgtgcaaaagaacttttcgcacttctaatcactagtttagtattcagaagtttggaataaattgaatttaagcttattaatagatatgaaaattagaattcttagacgtatgtactttgcttctaagttacacacaaaatatatcttaatgttttttattatattatatattgtggatttgatttttttggaattactcaatacaagattgtcatgtggagtcttaataactattattgttttattggctgtttttaaaatactccctctatttcaaaatacaagcatgtctaatttgtttaatagaaattaaggtttaatacaaaatactttgatgcccctcatgaatggttggggtgagagggtatttaaaggtaagctggaaagaaatttaaatgatagatgattgatggaataaatagtaatccgaacagtattagaattgtttatatttgataaatttaaaatgtgataagtgtttatatttttgaacagatgatgttagaaccaatatatacataaaaaaagtttctaggatatgattttaacaaatgattcattttaagaagtttgttttttcttggatgaaggggtagttaccatttactagagtttggattttctttttcatgttcaatatttacattactgatagtgtgagatggaatcttcatttatttttatgttgtgttcgaatgtgtcggttcggaacctatttctccaacatgaaaaatgagataggttgttagcacatgattaattgtattaaaacaacttaaatataatttttcaaaacaactttcctaaaagatgtataaaaacacatcgtttagctggaaagtgtacagccaaaaacttgagagcagaagttgagaaaggagacatttgaacgcagccttggtctccttggacaaatggccagatttactcaattttattcgattaacgtggacgttttaggaaatataagcatggatattatgcatataatgattggaatcagtccgctggctggcaggctgatgtgcttatctgcgctataagaggaggatggagcacaggtggaacagtgactggattcatctacagaaagaaaattcaagatttaacaatcaccaattttattctaaataacattcattttatgagacggagaagaaataatcccgcagatgcacacctgggcaccaccggaatctccgtcccccgctccgcggcgcttcagaagtctcgtccccactcccgtgccgcactggcccagccgcctgagacgacgtgaacatgtggcgctgagccgtcgcccgagttccacacgcccaccccatccacaataatatatccaatccacccatccatccgatcaaaatactgggagaaaattggagttgggacgcgagattctcaggcgagcacacgatctcgcggcgcgctcacgtccacgccctcgcatccacaagcgccgcggttaaaaaaccacgaggcaccgtgtgtgtttgtgttgctgtggtggttgccttggctgctttggagagttgggaggagcagcgagagagtgggggttgatggcggcgatggcggcggccgtggcctcgtccccctccccctcccccgcctccacccgcctcctccgcggccaccacccgcccccgtcgtgctcggcgccgtcgctgctccgcctgaccaggtcgtcgcggaggctacggctgcgcgccgcggcggcggcggaggaggccgacgtgctccccgggcctggggccgagggggagatggcgacgggcgggaggctggaggagcaacccgaggggccgatcgggggcagccaggtcgacatcggcgggctcgccttccagggcgacatgggcggaggagggttcgccggcgggagcgggggcgccggggccggcggcggggacggcaacaagatgctcgaccgcggcatcaacacggccatcgtgctcggcgccagcacctacgccctcaccaagctcctcaccgtcgaccacgactactggcatgtacgggaaccttcgtcgattccccccaaatcgttttgttccattttgtcttctcttctctgtgctgttcttgatttgattcgattcgaagctaacatcgttccgggcgggctgttgttcatgattggattgggtgcagggatggacgatctttgagatcttgcggtacatgcccgagcacaactggtcggcttacgaggaggccctcaagaccaacccggtgcttgccaagatgatgattagtggcgtcgtctactccctcggcgactggattgcgcaggtgtgcaaacgctttaattttcctcttatttagagtaatagcttttatgcagctgcgcttgcatatttgctgattctgttgctgttgatgcttgcagtgctacgaaggcaagccgatcttcgagttcgaccgtgctcggatgttccggtctggcctcgtcgggttcacgcttcacgggtccctttcacattactactaccatttctgcgaggtaaacatcgtggtcttccatgctctactgcctaaagctttgtgtcatgttcatatatggtgaatgatatgaagccaactgtttttcttggctcaggcactgtttccattcaaggattggtgggttgttcccgcaaaggttgtgttcgatcagacggcctggtctgcgatatggaacagtatctacttcgtggtcttggggttccttcgtttggaatcaccggccactatttccagtgagctcaaatccacgttttggcccatgcttactgtaagcactgatatttcctttgttataataatgccttaattgagttcccatattctatattcttcttttttttttaagaattgaaagtttatgaaaaagctgtagttgtgcagttgatttgttgtcttcagtgttcttgacagcaaaaccattgcctgtggtcatggtttttggtactatgatccttaatttgttgaagggattcgatgaattcattgctctgtatacaagtaaattttttaggttaatattaacattttgtcctccaattattcttgccacatctattttctcaaagttttaggtctagaagccactattattgaattaaactagtatacaattacaacaaagctatgagaagtcattcaaattttgaactttttaatgttcaaataattattcaattttcccttctaataattccatccataatctttctataatcactgaattatttcttaatttcaaaacggtttttacagtgttttactgctaacagagaccttatgctgggtttcaattattattataggccggctggaagttgtggccttttgcacacttggttacatatggcctagttcctgttgaacaaagacttctgtgggttgactgcgtggagttaatctgggttacaatactgtcaacgtaagcccaaacatgtcaatttcactttattactacggcagcctgattaaatcgcgaaagataaaaagagttcttcatttcttataacaagagttcttcatttcttgtttggcagttactccaacgagaaatctgaagcaaggaactccgaggacgcatccacatcaaatgcttccaatgtatggaacagtttaattaaaaattcattctgtcagacatgttatcgttcgttctaacacccaaaattcattgcctcttctacaggacaattcaatatagcgaacggtatagccagccaagctgccctttaccttcatcattttgggcttgtatatattgtacaatttgtagctgcagctctgcaggtgtaacctttttgcaaagataaattaaacatataagatgtgtagcaactgccaaaggcaatcagaacgaaattaccttgcactggatcaactgttgacgagattatgagctatgcaattttggtagctattcttttgatctttgaaaccccttttcagtgaaatcaaccgtcttgcattgaaccttatatgatcgacaacgcaagcaaggagcaaaacctatacaatattttggggtggttacaatttacacagtattctatagacgctagcaaacaaacagcttgctcatcatcagacagaacatcttaaaacaagttttcccttgatgcgaacaaaatgctgtctgtacattttttcgtttttgctggcatgctttctgtacaatctgatgctatgagtaatatacaactaatgctactatttcgaggaaaaaaaaaactactgcatggcatgggcaggtgtgctatgcccgtatttgtaatttacaaaattgcgatacttgtaagtttgaagcatgaaaacctaccagaattcatgaggccgttcacacgcatcgtttgcgagcacacaaaaaggagcatttccaaattacatgtatgaatccaaccaaaacttttctattgtgcgcaactatctatatcaattgttagctactgttgcacgcttaaatagttaagtatcactatactgcagcagcctctgtatctttgtgaccagcaatcagatctttaagcacagcctttgatgccaactttttcgccaccaacttgcagggacctgattttgttgcggagtatgtagtctctccagccttcacccgagcaatgaccgatgagactccatcaacatggtttttttcgtaggttattttgaatgatctacgatcacaaaattcttgcagccctttcaccgggtcaggctcgatggtttcgggggtggcaagaggttccaatagccgcttcatgcttctccaaacaacctccttgtcacacttgctgtcgagataaatggcaccagctattgattcaatcacatccccgagaacctgtttgtttgcaagtaaagcaatagatccagcttaagctattcgatggaaaatattacagaagtgcacaaaaataggttagtccaaacatataattctcctattccagtttacagtcagactaaagacattttgtggtcgtcatgctgtgatgcactatgcatcggaacctagttaagactatctttagttctttttataaattctctagcaactctttaatccaaactagaaataatggatctgatgcctggttaaattttgatgtcatcactatatggcatagactataatgtatccgaggtaatggtagacctaggaatactgagtaatgactaataagatttaaaataaaagacaaacaaattaactgatcaaattttaccataccagctaggtgcattttcttttgcagaaaaggagaaacaaactctgctatcagactttcagaatatatgcaatatagccacctacaccaattacaccgtagagaatacacacctttggtagaccaatgcccgcttcccagccataagatggacctgtaaatgactgcccaaattcctcaaggtagtagctcatcttcctatgcagttctgatgatgagtgaaggatatgcttgtttaatcctgatttaacagctgcatgcgcgtaacaattgttgttcacagaggcagatctaagatctgtcaacaattctggagtacagtcagggtatttgctgtagtaatattcagtgaaaagatgatccaaaatagcatctccaagaaactcgagcctctgcaagggacacaaacttgtcattcaactcaaaaaagatcccaaactaacaacagctacttgagaagtttgattcagataaaaaagaagctagacaaaaaggcaaaggcctcatcaaaaatcctaagccttcagagcttcaagccgatgcatgaggccatcaacggtcaccgcagtatgacgaaggttctccaaagcagcagcgcacccatggaggatgtgacgtgtaaacgccaccaccactcggcgtaagctgaagcaaggttttcacctggagatcagtatgggctaggtggaactacaccataacggcgcctccaaggaggggaacagtgcccaaaggtgacgctgtcattcaaccagccaatggctcgacaaggttttcaccagttgattctccatccagcccacacaaccaatccgcagcacaacggcagtcgccggatcaccacaccatccctctagcaaccatgcccatgccatagcccgacagctcaggcatgctcataggactaccctgtttccggccactccatcgacatctcctgatgatagccacaacttccaccctccaatcaaagctccccatgaccaaaactacagtctccagccatagaaggggaggagctccaagaagaggaagatgcttggccggcaaaaacggaagacacgccgtcaccactacccagctgcttcttgatcatcgcagatgcccagctttggtcgttgtcgtacctcgcacctccaccctgttgccaccatccatgcaccacaaggagctccaaaacgtccaagcggttgggaggagtcctctcgctgctcggatgctagcacgccccgtggctcggatccctacccctagcgaggacgcaccagatccagtcgctcaccacggcagggctgcggtcgccgttgatgccaacttgaatagccaggaacacagcctcaaccaccgcccacgcggcccacttttgcgactaggacgaccgccaaacgcccatgcagccgctccgccgactgcactcgagcaatcaccacagcgttccggcggatccaacccagaagccccgcatcctgcctaaccggtgccagccactgttgcagcctctcctagcgctgccggctttggctaccatccaaagccgtcccaccgctgccgtagcaaccaacgtcacgcttagatctagctgccatccatcgtccgtgcgagagcccaaggaaaggaggcccgccgccacacggtttccggcagccagctccagcggcggcaaggggtgggaaggaaggaggtggggtagggccggcggctggaagcgccgcccgagtcgctgaaggagcgaggctagtccttcagttttcaggtttcagataattctacagcaagttaaactcaaaaggaaatgaaacatatagaggattgctaacatagaaaaaaaatgttgttgcaatactgtttaatcatttgcactttgttgagtaaagatcaaaaggcataataaagccgtgacacatactaaatagagatgatagatgcttttatatcaacctgatagcatgaagtagggccagaagtctgatatgagccatgtgtcaatgcttcgagcaataataaagaatcattgaacttgtaaccaagcattccctctaagctcctcacattaatgaactcttcagctttcattgaaattttcctttcaactggaatttcagtgtgaaattctatattcatccctaatgatttcatcaaaagaaatgctgccttttccccagcagtactgaggtaagccccaattaaggcctcaactgaatccgcaatcctcttacttttaatagacattttcctttggctgtacataccattgggtgccagaaaggaaatttttttgttatcacgctcatcatagtccaagcaagggatgatccaatctcttggattaaactcctcagcatgaatgtaaccctgccaaccaaacataaagggcaagagtatcatctagtaccagtgataaaagacagataagtcttctttgaaacatgaaaaggtgaatagaaatattttctggtacttgaaaaataacacaattcattttgtgatgaacaaatttgtatgcaaagcattattttatttcatgacatagccctagccacatagcaccagaaacaaaaattagacctttaaaattgattggctgaaaggattacaagtcggttgagcggattaaagaaagctatttactatctcactgcacacgccgaagatagaatccgtttcaaggataggcagatgctaccattcttcccgccattcttgcttgccaggcaaagtaccgctgcttcaacggtcatgaaagcagaccacgtcaagccaacctcagatctgactacaggtgccatgtgacctgagggctaggtgttggcccaacaaggagtaatatggtctgagccacagccttgtattaacttagggtcagcaccacaaggttttggtcacctacaatagtctatattggcaacttggcaaacaattcaatgcaacaatagagttcccattttcctaaaaaggaaatatgtggaacattgcctaattgtgatatagcagttgcacaaaagaattgaaataggctgacatggtatgaaagatactgggagatgtaggactattaatattgcataaaattagcaaggatgtgcatgtaatcagttctgtagtgtgtaggtgtgtgtttctaaggtccttttacccttctttaacgcaatgatatgcagctgtcctgcgtgttcgataaaaaaaatttctacatgcctagctcaataagaaaaatacagttagcaacaggatctagagtaccacaagattactgctgcaggccagctggcacagagctgcattggagatcaagtttttcttcatttttgttaatatgccttcatgttgaagcctgtattcactaaaaaggtgccgagttgtaacatatttgaggaaagaatccccaagtgtttctaatgattcctgtgaaaattcttcttggcatttctttgttgttaatgcttccaggatctgcaactcatgaaaaaaatgcagagaaatacacatgtaagaaatatgcataggggaagtaatttattcaggtaacaggtaagaaaattcagattgacatgtacattgttaacagtggggcatccaaaatattaattagaaccataaaatactccacggattcaaatattcttatatcttatttttacaatataggaccatcaatccatacatggttctatagagtacaacacaccatcaagcacctccattggagtgttaatgaataatgcagacagctttttgtatgtgcttatatagttacattacgcattaattgaaggtatttatatgcataagaagttattaagtaccactgcctcatcaattgctacaaaaataaccaacttctacatggcaacaaaaggaattatttctttgctaagtgtccccgaaatatcttgcattatacatgacttaagacctgtcatgtttgcaagtagaaggaaccaaaacttatgtttgcctcattaatagatagtcacttcgaagtgctggacatattcttactaaggcactgttgctgcattaaacaactaaaaaaatcagaacctttagttttcactgtcaaatgtcatcactcttcctacaacacctactggtgtgcccaagaatgcacttatatccatttttattttaaattcttcaaaaaataagggaaatatgagttttcttatatgacgacatctagttgatctaggtacttcaataattcataaataggaaactattgatgagaaaatcaaccttcaaaaccggtacgtcaaactgctgcactgttgggcctaattggacctttaatttcacagaaagaagcatgcactggatgcggaacattatggaaggaacatatgagaagatgtgcaaattattggcggacactggtgacatgataattctgcagagttcaggtggcaactcaacactatatctatcaccaggttctgaaacaaggaaaaaagatgaccaaatcagtgatttatgcatatgtagctctgtaaagatagtacaggcagtacattagttggaccattgtctaagagttcagctataacccactgtaacatgcctcattgatagcgatgcaaaatacacatgtatgatcaagcccagcaatatgtgtgggatttaactgtccgattgaacatgaactcagggtatgtcaaatgtaatcttccaagtcccaaatacctcactgcctaattttatagaagctaagctacaagcaacccatcattctgtgctaatatactacaattttgatagtaatatgaaaagtacatttactgctcctgaaaacgaatatagtgtctggccaaataaagaaggattaaggaaaagatgatagagaagcaaaatatatttaaaaaaggcatagtactccaaaaggttattaaactagaaaaaggaaaatttaatagtagcaaaaaatatgtctacaattaa

SEQ ID NO: 3321 - DNA, 617 bp, Oryza sativa
acaggaatttgcatctaagtcaagaaacccactaataacataaaagatgttattatgaggggtacacgcaatggaatttttaaggatgcacctgcagaaaggaccatcttttgtctgcagtaaatcaatatctttacaagaatggcaatgtgtcatatgtttgttgttagcttcatatattggtgaggatgagaacttcatactgcaccaatcaattctgccagaaactaaaggcagaagtagatagactactccaataggcacttgcatctcatggaagtatttaataccattgctaacctccaaatggtcatcaccaataagaaacgaaagaatagttgtctgaaatcttctagcaataattacctggacaaacaaaagttatatattctcaatgaaatggtctaaacaacaatagcctagttatcaaagaattagagaacataaattgacaatttacctgttcttgattgagatggatgatgccaacatatttcatggtaacactagcattgtcttgcccacctggcaatttaaatgagctagaagtaaagtcagatcccaaatcacacttcaaagctaacagtatgtcagttggagaagctgttttgggacat

SEQ ID NO: 3322 - DNA, 631 bp, Oryza sativa
  unsure (1)..(631): unsure at all n locations
cgcaccgccctggcccagctgccggtgacccgcaaatacgaactgctggccacccagcaggcccaccgcgccagcagcccgttcggcggctttgccacccaggccttcggcgcacgcatgccccgcgtcttcgcagccccggcaccatctatgagcccgaaggcacgcgcccggactactggcgcatggcccgcgccatctacgcggcgggctttcgccccggcgaactgatccacaactgcttcagctaccacttcgtgcccgccggctcgatgatggaaaccggggcccacgccctgggctgcagcgtgttccccggcggcaccggccagaccgagcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3323 - DNA, 1745 bp, Oryza sativa
cccgccaaatgacactcgttccaggggtcggataaagagaattaaagggcacaatgacaaggagaaaaagcaaaacaagaagataaagaaaaaagagagagtaccacaaaggtgcaagaagtgcaaacaagtcgtgctgcacgattcgcgcaactgtcctaacaaagaaccacaacagtgatgcaaggttctatacatcatgcttccttaactatcagtcatcttataatagttgtcatacaatttcctggaagaagttagcgtttctctgtaaaagattgtgtgttgtcatccaaaattcaactaacggtgtatcgtaaagtctatagtgtgccaagaacattctggttctaatggacatactgtagatttccttggaacaaagtagcaattcatgtaaaagataataggtggccatataatatttaactaacagtaggtagtgaacacatgttgaaatataattagttgggaccattgtgaggtaataacatttttagtattgtcgtcgtgagtctaattaataatataaatcgcaaatgtacaattgtcctgttagctgatgtggtcccttgcatttttgcatgggttcttatttatagctctttaagtttttgactgtatgatttgggacctagtgttatcaacttggaacaaagtataaaaaaatatgggaaggattcgaggtgggcaagtgggcatgtaatatacagcgggatgtgtaggaagcacaatcattttggattgcattttcagtttggaatggttaagaattacatatggaaaatatttaaatatattgcgacaagttcggctcatatacaaatgtatattgcgacaaggacattttggacagctaatattcagcttgaaatggttaagagtacatatgggaagacaggaaaaaaatattagaacaaccattgtgttccaggaacattttgttatcttagtttggtccgtagtgtgaataaaactttgtatgtatctatgctcaccagtatatatgtccttaacaattttttatctatgctcacaagtatatatgtccttcttaacaatttttttcactatgcagtttgctgggtgcaggtttttttttgctgagagcagctggcgagaattcttttgctgagagtagttttttgttcaaagtagagccactgccatcatccagtgcacacgtgtgtgatctattaatagattttagccatttaatagcaaggttgcattttgattagacaacaccttgaaggggataactaatatttgtgcacaagtgttgtaacttatgaatgttattacctgccaaaactctgtgggatctaaattgtgtcagcagaagacatctgaatatcagaccatgtcggtatacattgatggactaggttgactctgccaattgtttgtggccacaatctggacctatgattttctaggaaaatcctaaatatacttgaactggataaattttctgtgtgctgtatttttctacttgaactagtaattttctgcacctgtgttcccacaaaccggtgtgctgcatttgcacaccatggtcatgaaagtttttcgtgtctctataacaatatattcatgttgagtttcttcagaattaagttccctgaatgttcagatgtcaattttttttcatgaaggtatatatctgttcaccctcgtccatatatgtggtctgtgtatgtggtgagggagatgccattttccaccctaggcacgatttcctg

SEQ ID NO: 3324 - DNA, 3498 bp, Oryza sativa
aacgtgaagaatgtgaatatattttgcgccgatggactcacatggttttgagctacaacatataaaatgagaaattattctgagctaaaacatggtgtaccataaagtggggcccacatgtcagcatcctgaagaaggctgtgggccaggggagccagccagggttcggccgaccccccagttggcccaatccaacccatcttcggccaggcggttactaccggcatcctatgacggttggagctaattctatctgaagaaatcgtcatggacacatagcaagaggagatgaaatatgctatttggatgcttgagtatgccacttgtcatgaggagagcaaagatgctcataggatgcttggagcatctccacactcccagagcacctctccacctataaatacccctcctctcattcattccctcacacacctcaagaaaaagatctagagctctctcaagtttagtttagtagttctagtgctagtggagtagaaaatagaatagtcttcatagtcctcgagtcttcaggagattgctggtatggctccagtagctttcctctcttcttttgtaagacatattgaattaatagaatattcttctttatacattttcggtattttattccattcatattacttgagtgccgactttacttcatacttgaatcaatatagccatgcaactagctttccagataggtgtattggtgtgggtttagtgtctgagtattcggttgctctatgtcggttgcaaggatgtagagtagtatttagtaatataagcacggtgcttagtttattagataccattaattggggtaatatacagtggttcagaggctggccgctgatggtgacggctcagtatgggtgtcctctgcatgtgtatattattctaagtgcaatttcctggggagggtactcctccgtatttagccccggttggatggccaggacaggttgtcgtaaggaactcagcaaccaggggtagtctcttgaaacaccaggaggacactaggtacggggtattggttgcatgactgtataatagcaagtatagactaaagatgtatgtatactagaagtacaggaatgatacttttcttattctttctccatttattttagactatattttagtgagagtatcttagttttttcttctgtgtgtcaccctaccctttgaactgaattaacctctgcataaactttcatgtatataagtaatatatgaattgttagtaaagttctctcttatcatatctttcattgggatcaaataaatacgacaccttggaatactcccgggtgaaatgctacaatggtatatccgtgcacttgcggatcacatatgtaaccataatataccaggattatttctagtgctattgctgggaattatatttctagtagtgtcgctaagaaataccaacaatactctccatggctccaaatcaggtattgtgttcttgtagtctaatttgaaatttgggatttagaaatttagtgatgagctttgctttaagaaattatgtcaatagcaacttataatttgtttaattgttcatcattcattaggaccctaaaaatggcacctagaaaaagaggtactaaagcaacagcagctgctgaaactagcatggttgcctcatcactagctccaactgaaggggtagaaaggtcatcaactgtgggcagtggcaaccaacactattgttgttgttcatgtggataacaatggtgcagatggggattgagaccatgaaactaatgatgaacatatagcaaaaaaagcaaagaagagatcctcgccagcttgggaacactacaatattgtttataaggtggttaagataaatggctagatggttaaaaagagtgggccaagttcaaatattgtgcctatttagctaggcgcaatagcaggaaatggtacttatgtgttcttgaaccacacaaaaacccacaatgtggttccaggatagcagtaactcaaaatggataagggttccggtacaacatcggttgaaacatacaggtatgatcaagagatctctttacaaaaattttatttggcaattatcatgcatgagtatcctttcaatattgttgagaatgagtattttgttgacttcataaaatctctttggcctacttttcctttgaagagtcgtatcacagttaggaaggatatacttggtatattttcagaagaatggaaaaggttgtatgagctttttaaaaatgttaatgctcactttagtgcaataatagacatatggacctctaaccaaaacaaggggtacatgtgtatcactgttcattgggtttatgacaattggtgtgttcaaaaaaggattatcaggttcatgcatgtaaagggaggcatattgggctaaatttagctgatgtattttctccatgcttgcataagtggttcatcgataaaaaaatgttttctcttactttggacaattaagcagcaaatgatgtttgtgttaaggatgttattaaggtgctgaatagaaaaagtcccctcatgtgtgatgaggcattctttcatatgagatatatgtcatatacttaatcttgttgctagagatggtttggcacatattggacaagctgtttttagtattcgatcattcgtgattcttgtgaagtgttctcctatacagaaggaggaatttataaaatgtgcatctgagagtggattggatatagcgaggggagtctcaaatgatgttttgacatggtggaattcaacgtactatatgttgtcagttgtcagatgccatatattatagaaagtctttcgagaggctttatgaaactaaaagagaaatttatgagggtcttgttccaaaagctgaagattggtataaggcaactaaacactttgcatgtgcttgaagaggtttgatgatatcactaagatttttttttcaggtacttcttatccaactgcaaatttattttaccacactttcgtgaaatcaaggctttaattactccatggatgacaagtgatgatgttgccatcaaaacaatggccacctcaatgaataagaaggttgagaagtactggaagaggtcaaatcttactcttgttgtggcatactttcttgaacctaggtttaagacaaaggcagtagagtataacatgctgaggtgtatggtaagcaatcatatcatgcacctatgcaaaagtttactagtgttgttaagcaattttatcaagaatatgcttctttttataagactactattgcaccaacaactagtgtcaatgttgaatcaaaagaaagccatactatagaagaagcagattatgattttatgaattatgtctatgcctcacatgtggatagtggaagtgatgcaagtgacttggataaataaatggcttagccatcactgttggttcctaatggagataaatctgatgtcttatcatggtggaaagctcaccaaagatgtatatcctgttcac

SEQ ID NO: 3325 - DNA, 3493 bp, Oryza sativa
gacgagattgatgatatggtatgacactgaccaacttaatcttgcattagtaggaacattttatttcatacattttgtagtcctattgtcaaaaaaatgtatattgattgctcataattacagaaaagcaacagagtagtgattgtcggtgatataggcctgggggtattgtgtctagagggaggaggccgcccccaaactcatgtggcactcccctgagggtggtcgggcccggggttgagcagcggctgccccctcccagttaggggtcaggccatcccgaccccctccacgcacccccccagcatgcgtgagttaggtgggcgcgctcaacgcccaactaacagcatttaaggctggtgctgcagccgcataacgccgcattattaaatgcggcgtgcaggcgtggctgacaggctgagtgacactcgattgaccggcgtggcagggtgagtgtgcctgcgcgctgaccgcctgtgcactggcccgctgtcaggtggcgtgtggccggtgccgtctagtcacatcaccatgatgagaaatcccttgccccgtgtgcaagccggggatgatttcctactccaatttaaattagggtatccattccttagtgggaacgggtacccaaagtcttcagatggttaatggggaatgacgcacacgtcccccgtgtcacccgcggtgatttgatagggccatgctggagcgtcgaaggcatgatttcctctgtcagagaaataagatgtgtaataaatgtaaaggatgtcttccttcttccctaggtagatcttttgggcccctgtggtaaccccttgaattataaaaggaggtctagacctagtgagagggggatcgatcactctctgattgaaccaactagtacacggtgttcctcatagaaatcaagcacacacaggagtagggtgttatgcttctcagtggcccgaacctgtataaacccattttatctcatcgttcttgaggggcccgaccccctccacatcactccttgcaccaaaccttgattctcacccgctgccccccgccgaactgaaaggggggccccttagtcccccgctccaggagttcaccctccgacagtaatgatgaagagtgagaagtgaagtctggatccttgcatgttgatgtgtgttgtatagatctagttcatatttgcaacttagtaaattgcaagagtaattgttgtacttctgcatggaattattgttaccatactgttatcttgatcttggatgtgttaatttgttaggacttgggactttacacctgatgttatggcattggcatggaggctggagccatggatggacttatattttcaagcaatgcctggaagggttttggattattcaagcacttgatgttatatattatgcaagctgcacttaagcacttaagcaaaattatactattatggatgtgttttggctggtttttccttgagagatcatgttcagatgttattttactatcgcattgctgcttattgtattgctgccttcttgttgtatgtaatgaatagggctctcgctaggctagaaatcgttaaagaaacatgccttcaacaacaccatgaatacaaacataacatccgacaattttatttcatttccgaaccgagtttgcactgactctgtaccaaatccgccgtccgaaataatccgatccacatctgcatccacatccacactagtccagatcccctagagttgggtataactctaccgggtggagttggccaaatatgtgccattccatatacttcaggggctgggattaagccacattaatttatactttaaaaaccagtaactgaccatgcaacaaataaactcgcatcaacaacttatcacgagatcatttttattgtataattagaacaaaaatttcatgcttcatcaattatctaaaaaaatcatacacattaatattgatatggttcactgtttgcatatatgtgaaagcactatgttggtatacactgcgagttgctttagagttgatcgactatatctgttgtttggggaataacaaaacgttgttctgttacttttttttttgggggtgagaacttaatcaaatcgctattatagagcaaacacatgaaaaaactaagtttcctcggaagccttaaccattaatttaaggagttaatttattaggtgaaattgatgatgaatgatctcagccgtaggaaacaatggatagtacagatttggccaactccactcggtagagttatactcaactccaggggatccagacccggtatactaactagtagctatatatcaggtgatacctaccagagtcatgcatgatacttgctaggtatactagctagtagctatatatcaggtgatacctaccagagtcatgcatgatacttgctaggtatcatatgataccccataggtatcggcacaattttcaattttgatttcggcccttttggtagaaccgaattctgggaattttggtaattttggactgaaatttactgaaattttgacacaatttaactgaatttgactaaattcacaaaaattggagaaaaaccaaaaatttcagccgagatattggcatgccggggggaggggggagggttctgaaatttcgaaaatttcgaaccaaaattttaatcccctggtatcagccgatactcgtcggtactagatattgatatccactgatatcgcccaatgctcattgtcttattggtaccaagaaaaaattgattcgtaccatacatgggcgtatagcttgaggatggtgagcagatcttcagtggcccgaggggaggagtgactgtgagatgaagaggacgtcagtgatggcgaagagctcatcagtgcccgtgaggagcatatctgcctccatcgcatgcttcgtgaaccgcttgtagttggtgaggtcgtgtggtgaggagcttcgatctccatgatctctagtcaactctcgccccatacagtcacttggatgcgggcctatcgggagtggcgggactaccttcacagtccaccgtacacaatctcatcatctcctggagaagtgtgtccatcctcatcggctccagcgattcatgtctgagggattggagcgtcccatgcaggggatgggggatggtatgtgtcgcctagcattcgcgagaagataatggaacacgagagcacgctacaccatgacctacatatggaagcacttagactgtcggtataaatggccattagagcaagtttaataatatagccaactactagctccaattcatctatagctaatctaatagctcattcatacaatagttatatactacactattaatacatagacccacctgtcatacacacactgcgtcttggagtgtgctacagctggctacaaatctgtagcccactgcttttctctcttctcatttatctccttaaaatatatttgcagctggcttatagcctgctattgtacctgctct

SEQ ID NO: 3326 - DNA, 5016 bp, Oryza sativa
  unsure (1)..(5016): unsure at all n locations
tcctgcagcccgacaaatgattttttactggtagatgtctatctaccatatatgaatgcatgcaaacaaacagagatgtatggcatatcctctgctccaccagcaaaattccatgtcaaaattaaagatatgtgaggaagacaaaaaaaaatctggaggagcgaagaatggagcaacaccatctcgaacttcaggagggtgaatctgtggaggccacagcacggtcagcaaagacgatggtgccggtgcttcctcgtaaatccataaagtcatttatagcacacaagaaaaaatgttagtaaaattttggaaaccgatatgctaaatcagtggcggacccaggatttataccctgggtgtgcccacaaatacaagccctacacattggtctagagcatatacacaaaaatataggcaaaccgagcattttatacaccaaaatgtagagccctgtacatggcctagacaaagcataatctgaattttctgatgccttgctaaaagaagacaatgcccttgttcctcttcgtattaactgatttcagaattttcaatttttcaaccaatctctagctctcctttaaaagaaaattcagggagacaaagaaactaaaaatagtgagagactaaaagtcccaaagagtatatctgtatctgaagttttagatagatgatgcgaagctggacctgcttgcttgccttggtcaatgtggttgctgctagctgcattccttgcgttgctcacagactcaccgggctcgcatcgacattgcttcgccatgtctctaaatgctagtggctgcggctctcgtctccaccgtcgacgctccacactcgccgtccagccaatatcggtgctctggcctgttgactgtcgtgctcttcggtgtcaccgccgccgctcgctgaatgtggaacaacgcctgatgccctgaccctagctacctttcacacgatgccaagtggatacgcgaatgcgaggtgaagcggggaacttgcacgatgcaaagcgcacaacacatcacacaggcatctatgatgggctggctcatgcgttcatactcatcaacttttgccccaaactaatacatgctatatactataagtttttcgtttttttggtgtgccggngcatacccggcacaccccctgggtccgcccctgtgctaaatgttccaaaaaataatcatacataatacaaatagatatgaaccgacacaatttttctcatcaatttaaggttatatggtttcaagtaattttacttttagtatagagtttatacgtttcaaggtaattagaaaaaaatcataaccaatgtccaaatcagttattaagcaaaacatgtttaaaatgaagtcagggaatatttcaacaatattattctaacataagcattcacaataaaaattaaagcaaaattaaacaaggtgtccgtgcatttctagttcgtattaataattgaaaccactcagtgctagaaaatcagtgcaatcggcaccaacgatcatcatagtcggaaagtcagtggcccttaaaaaccgggcactgacgaagtgtcctaagctattgaccttattttattttatttatttattttcaaaaacgtgataataaaaagaaaggatcatatcacagattcacagctactgctggcgcaggtatttccacattagttcggcaaatagtctagtgcagtcgtgcagacataatatgatgtgcacttgcaccttcttcaggtacaaacgtagttcaatgtaccatcagaatgtgcagtggcgaatgtacaacgtgatgaaaatattattggggctttatattaaagtcataatacataataattataatatactttttcaaaatcctacgcggatagggaaaaaaagaggattaaagactgaagtgaactgaaaaagattgaaattaataggtataagagcactgctacacatactagttttttcttactaaatctttactaataatcatctcaaccgtttgatttaggtagatggaagttatgaaaaatctagatgaactcgtagcatgacacttcagtgttagaatttagtaagaaaaagttagtacctatagtcttttccatgtataaaggccatgagctgcacactgcaacagctactagctagaacacaagagtaaaaataatctacaatataattaatgatcacaattcacaaatgatccagctagtaataaacagcctaatgttttttcatgcacatcatttctttcaccctgaacgtctccagccaactagccatcactgcttggccgtatgctggttgctgtgcaaattttgctggcactatgaactcactacgcaacagatatatgggattagattcctgccaaccagagagctggggctagagccccaaccaataacatgttcaatatgtaatttggtgttaaatctgtacggaatttctcaaaatatattttgtttcatgaaatttactcaattatatatatactccctccgtttcgaaatgtttgacactgttgactttttagcacatgtttgaccgttcgtcttattcaaaaacttttgtgaaagatgtaaaattatatgcctacataaaaatatatttaacaatgaatcaaatgataggaaaagaattaataattacttaaattttttgaataagacgaacggtcaaacatgttttcaaaagtcaacggcgtcaaatatttcgaaacagagagagtagtactgtacggtgactagggttgactagtccctctcgtccaatcctaaagttggcatagctttggacagccgctgccgtctttgtgtgcacaacaataggctataaatgtagctagctttggcgtcctccgatcctatggttgtgtttagatctaaagtttgcatccaaacttcagtccttttccatcacatcaacctgtcatatatacacaacttttcagtcacattatcttcaattttaaccaaaatccaaactttggatccaactaaacacagcctatatacactactcactccgtctcagaatataagaggttttagagttggacacgattattaaaaaagtagggtagaaataagtggtgaagggtcgtgattggatgggtagtggagacaggtgggaaaaatgaatggtgaatagttgtgattggttaggaagagaaatatttgtggagaagtagttatattttaagataaattctaagggctaaaagttgttatattttaggacggagagagtagctaggaggctttaatacacacgtcacactgtacgctgtgaaggaacaatgggtttctggcgccggtgcacaccgtcgacatcggcctgtgcaggcgtctgtgtcgtcgccctcctccttgtggctttggcttgctgcccgacgcgcgcacgcggcgctgccccggcggtgtacgtacttggcgactcgcaggcggacgtcgggaacaacaactacctgccagcgacgctgccgatgtacaaggccaactaccctcacaacggcgtcgactacccggggggcaagcccaccggcaggttcagcaacggctacaacttcgtcgactaccttggtgagtatttcatcaacgcgtacactgcgcactcttgggaattaaaattagaggctattgtattggctatgtatatacatgtgaccattgtcttaaggctcgttcgggttggagagggttgaaggggattggaggggtttgagggggaataatttcacaccacaataaatatgtaataaatttccgctgatctctttctctttgggattaaccgaagatggccttaagggaaaatatttttttcacggcaaatacttctcttgttgttccattaattgcagctgacagtctcggggtggccagccctcctccatacctctctataagcaacacctcggtatacctgaggggtgtcaacttttcttcaggaggatcaggggtgtctaatctcacaaacatggtaatattagctagaacttgaaactgtacgatcgagattaatgtctttcgaatacgtagtactctggtccatgattacgcgcaagtagtaattaattttgtatacttttgcgccatgcatgcagggtcagtgcatcagcttcgacgagcagatagatcagcactactccactgttcatgcaacactggtggagcagctcggcccgcgtcaggcctcgacccaccttgccgaatcgctcttcagcgtcgccatcggcggcaacgatataatcaatcgcgtcctgctgagccagctcgtgggcacccaagaccaattcatcagctcactggccaactccctgaaacgccagctgcaggtatgcatgtacacacaaatgacaaatatacaatccgtccagctgaatgtatatcgaacaaaccagaaattttgacaaactaaccattttagagaacttgtttgaataagaaaccgtgctaaaaactaattctaaaaatataccattcactcagtaccaaaagtccgatggcatcgtatcgcataagatctcggtgctcagacattatagctctcatggctgatcaaatagtttatttttagtaagtttttgggtcagttcaacctttaaataagtttttgatactgacctttaaatatgtgatgtgccataaatttcagaggatgtatgacctcgggacgcgaaggcttttatttgtgggcgcggcgccactggggtgttgcctgatgctgcgggagcagagccccaccaaggaatgccacgcggaggccaattacctatcagctcggtacaacaacgccgtcaccatgctcctccgcgacatgagcgcgatgcacccgggcatgagctacgccttcttcgacacgtacaccgcgttgctgcagtacatccggcagccagaggcatatggtactagtactactttacagtgtagactactccatccgtcctataaaaaaccaacctaatgattcctccgtattttaatattccctccgtattttaatgtatgacgcc

SEQ ID NO: 3327 - DNA, 14125 bp, Oryza sativa
gtcatacattaaaatacggagggagtatataataccgttgactttttttactaatgtttgactattcatcttattcaaaatttttgtgcaaatataaaaatatttatttcatgcttaaggaatatttgatgataaacaaagtcaaaataaaatgaatgataattacataatttttgtaaataaaacggataatcaaacgttggtcaaaaagtcaacagcgtcatacactaaaatacggaggaagtactacatatgacacattctaatactacgaatatagtagagatatatctgtccagattcatagtattaggatgtgtcacgtccgatcttagatttgatttttatgtgacggagaaaggatagagcaatcagtctatactaattaagagtgaatttcatagaactatggatactttaatcaaattatcataaaactataaatctaagatattgttatataaaaaaatatagatttaatgcgaaatttctcataaaattataaatttaagatgaagtgtcaaaaaataaatattaaatagcagatttttcatggaactatatgtgcccatttaatcatagaacgcagtacatagactaaagagcaatcagtgtatataccggaatatctgaacatatttagtacgtatgagtgctcacatgaaaatataattaagaatgaatattttcacaaagcttccgatgctttaatcaaataataataaagctataaaatttaaggtattgttgcatcacaaaattaaagatttcatacaaaatttcttataaaataactataaatttatgatgaagtgtcataaaaataaagattaaatagtagatttaccatagaactacatgtaccaattcaataacaaaactacaacttataactccaacatatataacggtagtggtaaggatttaaagattggaatccgtagttttgtagtaactttaatagtaaagatgtagtttgtgatatttggtctataatttgtaattttctgataaatttgtcactaaatctacggtccattttattgtgatacaaggttttaaatatgtaatttggtgtaatttactctataattaatattttatatttcatattaaaaatacatctcctatgaattaatccaatgccattttggtgttttttcttttattttttttaggttatactgaggtgaaagcagcatgctgcggcctaggggacaacaacgccatgttccagtgcactccggcaagctcgtactgcgccaaccgaacaagctacatgttctgggacatcgtccatccgacggagatcacggccaagagactcaccaaggttgcgtttgatggatccccgccgttggtttacccgataaacatcagccagctcactgcgagttaggcatcaagtatatatatagtacttttgcagtgctatcgatctaccgatgcatgattacctgcaaaaattatctaaactattagtttaattaaaaagtactctaccaccagtagaaataattataaatgactcattgaaggagaaatgatataagatcgtgattgattctactaacaataaccaccatggaaataaacataaaaggggtaagatggatagtatttttgtctaatccactagctctgaaaccgatgagaaaagtggctacgtaggggtgaaaatggagcggattcggacggacattggtcataccatatccaacatcatttttttaagcggatgtagagcgggtgtggatgggatccagatcccctagagttgggtataactctaccgggtgaagttggccaaatatgtgccattccatatatatttcaggggctaggattaagcggaaactattctaatccctcgaggggatgttccctcgtttgctcaaaaaacatctaaacggttatgaaaaattctggaaaaatttgacaacattcatacaacacatatatacaactccacaaaatcttaactccaaactcaactcacacgtcgagatataaaaaagacaaattcagcgtataaatagtagcgtactgtttatatctaaatttgtcttttttgtttctcgatgtgtagatcgaatttgaatatgaattttggtggacaagtaggtatcattatactctacattatcaattttttttagaatttttcacaactatttacatcgaatttggaagaaacaggtatacgaggggagatatcccctcgagggattagaatccacgattaagccacattaatttatactttaaaaaccagtaactgaccatgcaacaaataaactcgcatcaacaacttatcacgagatcatttttattgtataggtagtccccttgctcttccatttgtctcgcgcgcatcggacgctgtcctgcacgcccaaaaacctttgccctgccggctggcttcgctctcgatcgctacgtgcgtgcagctgccaccgccggccgccgccggcgcaacgcacgcacacacaccaacaagtacgtatttgtgcgcgcacgcatgcctccgttacagagacgtcgtgcgtgtttgttaataagctacgaacaagctagctagagatcaagcaacgcaggcatgtcgtcgtcgtcgtcgtcgaggcggtgggcgtcggcctccgttacggacctgtcgtccgccggccggtcgcctctccccgccgccgcgctctcccccgtccgcccgagcgcccgccgctcccccgccgtgtcgcgccccgatccggcgccatccatcgcccgcacgatatggccttcctcctcctcctctaacagtggcaacacgagcactaggaaggcgtcgccgtcgccctcgtcccctgcgccagccgcgtcaaccccctcctcctcctcgtctgtggccaccacgctcgccgaccacctcgccgaagactctctggacgcgccgcctgctgcgctctcgcggcagcggagctgcaccgagctcccgcgcttcgccgacgcggacgccgaggcgaggaaggtcgtcgtcgccaggtcgggcggccacgcgagcgcgatcggccgctccatgcggctcctcccgtccacgaggccagccggcgtcacactcaccccgggccgcgtcgcgccgtccgacctccgcaggctcgacgccggcgccgacgtcgccagctccgggtcggagtgcagcgacgcctccaggggcggcggcggctccacaccgaggacgacgacgaagctgcccaagccgccgccctcgccgttgatagcgcgaaccaactccacccgcctgctcgggtccagcaacacgcagtgggcgctgtcgccggggcgacggagcggctcgccgctgaagacgacgctggcgacggtgccggagctcaagggcaagacgaagagcctaataggccttggatggggccatctctttagccggaggaaggcggcggcggcggaaacggccaccggagcgcaagcaacggcaacactgtcctcgccggcgtcgcggcggagcggtggaggtggtaatagggagatcggccatcagatgaagatgatgcactgccggctgttgcagtggcgcttcgcaaatgccaaggcagaagccgtcagcaagaacaagctgtctattttcgaggtatatatatatcaagaatgcaccgttcacatcaatattataagtacccacacttataatttgtgagcctatataataactaaaatttgttcagtttggtgacatacctagtttgttggatttcagcccaaactctcagcgtcgaacacctgcagctcagtgaacagtgaaattctcaagtattcgacgaaatgaaaacgagcctaatagtgttttttcttaatgtgttaacaaaatttgcagtggttaattttttttcccaaattgagatacatggtatacctgcatatgcttaaatgtacgtatgtatgtgctttaggccgcctttggaaattaaacatcaattcatcaaatggtatattatgtcgttatgttttattttactcctaacctatgtgtatataggtggaattcatgggtgcatgggctaggatatcagagctgcaaggtaaagtggcaaggaggcgtgtacaactcgagaaagagaagctcaaaatcaagttgaattccgtactttcttctcaggttgatacataggagtacatgtttttgttcagttcgatatttgtccgtcaaaattgatcctttagtgattacttctctgacattatgatgcatccatgccatggtgaatatgtgcagatgagaggtttggaaagctgggggcagctggagagcaagcatgctgtggctttggattctaccgtagtttgcacccaggcagccatttgtaagctccctcttaccaatggcgcaaaggtttgtatttttttttcatttaaagctctatttcttaaaaatatgcacttccaacataaaaagacgttgatgaatacacttaggttgtgttcggtaggggagttgggaactctccctccaaacacgtaaaacgagatggttcattagcacgtgattaattaagtattagctattttttctgaaaaatagattaatatgattttttaaagcaacttttgtatagaattttttttgaaaaaacacaccgtttagcagtttgtgaagcatgtgcgtggaaaacagaggaggtgtagttgtgaacacaagctgccaaacgcacccttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttaggctgagtttttcgcacgcaccttaaggtgaggttgttattgcaactcgttaaaggtgtatgatattattggttacgacagctgatctgatacagataagtttttcacattattgatcattcatcaatgactagacccttcactatcacaaatgacggtttaagtacgacatagatgacatgttccgcaccagcatgatattgaattagcatgttataatatttcaaaaattcaaaaacatggattttatcatcgtttccttagtaggaatattccaaatatatatttttctgttttttctgacttttctatatatgacaaatatgaagcatttggaatcctctcactggccccatctacaatactccctccgtttcgaaatgtttgatactgttgactttttagcacatgtttgaccgttcgtcttattcaaaaacttttgtaaaatatgtaaaattatatgcctacataaaaatatatttaacaatgaatcaaatgataggaaaagaattaataattacttaaattttttgaataagacgaacggttaaacatatactaaaaagtcaatggcgtcaaacattttgaaacggatggagtattttactaaattcgcattttacttcttatcaagatctccctgccatcgatgggaatcatactacagcaggcgcttgacctcactatgaccaccaagacaatagttcggtcgtttactccaatggtaataaaaacacatcaaaataagttaatgtgttaactttatttttcgaaattcgatgcagcaatctgataaaaaaattgttaccattaatattaatgcagctaattaattactttttaattaaattgaagtattttccatgataccaggcccatgataccacattgctgatcacagagctagtagctgtggcaagagaagagcatgctctgttgcaagagtgtctcgagttgctgggccgagtgtctgcattgcaggtagctttgagtcaatatgttccatgaaagaaaacagcatatattcttttcccttatttttatttaacgcgatgcttatgctaatcttcattgatcgtgcaaatccgcaggttgaagaagagagcttgcgttgccatatgcttcagtcatagttactgaatcttatgtccgttgatacagtatgatgacagtagctaaatgttggcttgttcgctctgttatcatttttaaccttaccaaactaaaataggttgaataacagcagtaaattaatatttttaagctgattgcatcaatcagctgtagacatcacatttttgtcagtatacgtaggggctacctaatgcaatacaggaaaaaaaattgaaaatatactgtttattttttctaaaaaatactataagcaaactttattatatgaatagaccatcgtcgcgcttgagataaacgaacttgttaacgatatcatcgtgtcctatcgccgcggccactccgccctagccctcccgccgccaccagacctcacctaccgccgtcgtcgctgacatgtgagatgtgagagagaagaggaggggatagagagagaagagagataggagagctgacatataggtccaagggtatttttgacattccacatgatttctctctcctattcaaccgaaaattattattttaattggtgcagtgtccaccagcaaatatccaacttttgggagtattttccccaaagtcatttcgtgtcatgtcctacagttaaaaccgcaaactcacgatgtcatgtagcaaaatttgcctaataaaaaacaaacagtggatccgctgcatcgcgctcccgacaagcgaacttacacgattaataattagtatcattagtaattgattaattaactattatttttctaattattgttgtcgtgacccaaggtcacggacaaatagggggatagacgggagctaatccctttactcattttggcatttgagtcgtgccttttcgttttttgtgccccctcatctgcgcgtgctccctccacctcgcgcctatataaaacattgttggtcactatcagagagcctcacgtgctccagttttatctcgttctttgaccactttctctttctactcgaactttctatagttttcgagtttaaccatgggtaaaactgtcaagaaaatcgccacaagcctaagttcaaacagtcttcttcaagcttaccccctccgtccaaaaaaaaacccaatcctagctacgaacctggacacgcaacacaatcctccaaggcatccagcaacaggtggatagaagagtggtggctaacggccgtgtcatggaccccccgcgcgaagagcagctgagcatggcaagagcatggaaaagcgaagtaggaagggctcccgacatgtcatcccctcaaggcataccatcatgtcgttgcacggcagctcgcgcgtatccgtatcgtggtcacatgtcagccacaccatcgggattggcgagagaatctccaagagacaggagatggagtacattgtgatgcctgagcacgatcgcaagcaccaccagctccatgagtgtccatgcgtgcacacaaagagtcgctaaatcatgggagaggtgtgcggtggccggcgaccgacagggagaagggtggcggtggtaggtagaatcccgacggcgatgactggcgatgggtgggagaaggcttgcagctgtcgagaagcttcatagtgataggatgtggggagaagggcgtaggtgtcgaagacgatgcgaccacagtgtggagtagatggagttgacctcgaagacgatgtggcgaagccacgcgtgctcctcagtggaggagaggcagagctcagggacacttgaacacatcagcttttgagcagctcggcgggggtggctctgagcttgggggataggagcttggccagcgtgacaagacggaagccctagccctcacgcgcgtaggtaaagatgatattgtcgttgcagttgggacctgggcgcaccacgtgcgcgctcccggtcgttgggagccgcatcagccggtggcctccgctatcgagcttttccctatcggcccacaccattctccccatccattggcggctgccttggaggtttgggttgagatgggaagagaggtaagtgaggtggaagaagattgctggctgacatgtgtggtccacgtgggccccacactgactcggccgccacgtcaacaaaaccaaagagcataccttgggatcaaatgtgacccggttttgcaagattagggatacattatatcttcaagttcggaacagttaaaactcgacaacaagataagggaggttaggtgaactttttccgagatgaaaaatttccagcctcatgggcctgtgcatatgacccataggaggcggcagacctccggctcctcctcgcccgccgccctcgactcccgtctcctcgcctgccgccggcgccgatctccatcctgctagcagaggtggcgccggcgttctcctgctcccgccacatcatcgctaatccatcccatccggcctcggccaccccactgcttctacgagttccatacccagaccgccgccgccgccgccgccgccattggtgaagcccgtcgccatcgccgtcgccgcttccacgcaagtccgtagcagcggattcctgcagcgccccccgaaacatcccgaatccccagccatggcggccggagcagcagcagccacccgccgcagtctctccgcgctccttctctcctcccgcgctctgcaacgccgcttcgccccgctcgccgccgccgcctcctcagcctacctcgccccgtgggcgccgccgtcacgcggagcgaagaccgcgtcgtcgggtgggtctgggtactcgccgctgaacgacccgtccccaaactggagcaatcggccgcccaaggagactatcctgttggacggctgcgactacgagcactggctcatcgtcatggagttcccgaccgatcccaagccctccgaggaagatatggtcgccgcatatgttaagaccctcgccgccgtcgtgggaaggtatatgctcttcttctccaactatatttgagaaactccccttgaactgaagcagattagactaattacaatagtgggcctatacatcttagtgatcgaactgataataaccaaaacatggctgttgcatcaaatttgcatgatgagaaattagtaacaatatatatgatgaatgttgtatcaagtttgtactgttagttgtatgtttcaaaaagtcgagtttacattgtggttttttagcatggcaattaggtagggaaatgattgttcacagactatttttttggacatgagttgccatcagacattaaactgttaatttctgtcttaaaggcatgaagcaaaaatttcacccactgaaacatttgtgaaaattgagaaaaacctagcggcaaccacatggtgacatacagataaaacattttgagtagtagtatgcatatgcaacatctaaaactattcacttccagcaatatgcacgctttctgcaaacactgcaacttcagctacattcaggacaaacagtggcaacacttttaaagtctgactgtgccaactctcaaaaagttcaaggagtaatatatgtgacattatgaaacctgactgctcaacatttttgtttcacatgggcaacatcagcatacccaaaacacgtaagcatggctgcaagtaagcttgctgctgctccgcgttgctccggctgccacatcacactacccttgaccaagagccatgcaggcatcgagcttgctgcttggccctgagagccatgggttgtatcatccccttgctcactcctatggagacacctccatggagatccgctctgcgaatatcccccacccccactgctgttgtgttctcccatcaccttgctccctgcatttcattccccaccgactgtgtgagtccgattctcaagtcagagactggtgtggactgcatgcgtgcgtgcgtttgtgtgagtgtgtgtgtgtgtgtgtgtgtgtgtgtgtgtgtgtgtgtgtgtgtgagagagagagagagagagagagagagagagagagagagttgtgacttgtcaggtttggttcttgtgttgagctcctgaatcattgtggtggctgtggtcatgatttggccaagcagctgcaggcaggcacgagatctgcttaacaaaacacaggcctctggttgagcgtcagtatcagacatctgcagtctaattttctctaatatcatttggccccttcttcatagtttcatatatactcttagtgatctgcaatgttctaatagatgataataactaattgaatctttatcctcaagatcctaatattctatatttgggcatcatgtaggaattcaaatgtttatcataactttttttttgtgtgcagcgaggaggaagccaagaagaaaatctactctgtctgcactacaacttatactgggtttggcgcattgatttcggaggagttatcatacaaggttaaaggtgaaacttttgtggctctgcttttctgtaaggttcacaccatgaatccatgttggaaatatttttttcatttactttgctgctcttaaaggattgcctggagttctttgggtattgcctgactcatatttggatgtgccgaacaaggattatggaggttagtaataatagaccttgttcctgctctgtttgcgattgtgtaggattataatattcttatttggttggatttcttgtagatatttatttgtttcactagttttttattaatcaagtggcaacaaaatgtcttattgtgttccagaatatataatatgaaaatcaatggcaatctaggaaatctattttatttaacttcagttcgatatatgaaacataactatatagctccacgacagcttgaaaataagcaaaacacaacacaaccaccacaaacttattattttttggaaaagaaaagagtaacaaagtgctctactaacaaagattagacataaagagaaaaatactacatatggtgggagagtggagaaacaaaacactacaaggcaattaaccttgacaccaaacagggcctcgaccagaccacccaaggtggaatcttccccatccatgcataatgggaggaatcctttctaatatctttttatttcattgaaaccaaaggtgcaactaaccagagtgagcattttgttaacaattacagcttgtgactataacggtactaacatgccctaaaaagtatgtggtatattcaagtgaatatcagtcaaattccagcaattaatactaaattggcaaaatggcaagcacaaagaggtggagcaatcgtctgaggcattttcacaacagagaaacagataaagtggatttagctctaaatttattgtattgtaactgattctagtgttaattttctgttgtgcgacttgttagtatctctgactccttgggaagcattgtgtgtcatacatttactcttccaaacccagctataagttgatatggtttatttttctcaaaaaaaatgatctggtttatatgttgcctaaggctgtgttcaggaggggttgggaacccctcctctctggcacacaaaacgaagcagcagtttaaaaatggattattatgattttttaaagcaactttcatatagaagaacgaggaggaaaagttgcaaagtgtttagtagtttggaaagcgcgtgcgtgaaaaacaaggaggaaaagttgggagctcgtgctaaagaacaaagcctaacaatgaagatgagctttcatatagaagaactcatgaaaattccaaatacaactccaggagtcctgactcctgagtccagaccaggtttaattctgttaagggaattcttaattgtaattcctgaagtggatgatggaaactaaatggcatggattttgtcgtcatgcattttttggcaaatgaaaaaaaaagtgtggagctgctaactttaaagtattatttagcaatatatatgttgccttagctgttttgtttgtcctcgttacccacttgaggcttagttattgcctcgatggcttgaactatggcagctgttctaaaacatccaccagaaagagctcccttctatcttgcgaaaagaatggactctctcaaaatgacttttatgttgaagaacttgtgcagaaattttgactcctacgttgatttctttgccactagacacatccacctaaagcatccgtttgtggacttttgagaaaatagttcttttaagattagcaatcatagttcgtagttcagccagcaatagaaaaaacacttgtgtaaaagcatagacaccaattactcttgccagcgttccttctttagaaagactgacaaccttatgacctgagagtgtattaatacatcttcagtgctcagtctctggagttggttatgcagataggtagcctagataaatgaatggagaatattccttcttacagccaagaatcctagatagatgaagttgcttctgatcacacacactgaaaggaacaatgttgaattgtgtaaattgaattttagtcccgtggagttactgaaagaatcaggaaatccttttggcaaggtttagtattgccaaagtatggttggcatattggattatcagaaaatccaatgtaaaaatattgacccattcacccatatggcatagaataatagtatgccatttctacttcctgatctaaattctgtgaagaagatcagcatcagtctcagttcatgggtccccatcatttcctcatccagattttgatgttgaattatatgtgtgctattctcttatatacgcctgtctttcctgttttcaacttttggattatggatgatgttttgacaaattacattatgtgcttgtaataatttcatggcaccacttgtaccaggagatctattcgtagatggacaggtcatacatagaccacaattccgatttactgaaaggcaacaggtaaggagccggcctcgtcctcgctatgacaggagacgagtgactatgcaaactgaacagaaagaagcaatgcagaaaggaccttcaaatctgcagcagtagcatgaaaccatgccatatacactaaactgttgccagaatagcctaattatcctggatatgtttaagttctggagtgtgtccatttctggaaatttatctattgtcttgtcagtttagcgccgtggagcctatccgtggacatctctgcagttaagaaacatcatattgaccttgttatatgagaaatcctgcacttttatctccatggtacgcctccgaataaaaaatatccagtccatgccctctggttttaaaagagctccgaataaaaaatatccagtccatgccctctgatgttaaaagagctccgtgccacaaggcagctcttttatgaataattgaatatgtgccagcaccctttttggaaagggataaaatcgtaaaactgccctgtccctattccttataattcacatcagaagtcacttgaaatttggcattccacctcataattcattttgttgcaaatattcaccttcctacttggttttgtggtaaaaaccacaatagtgcaaacatgtttaatcggatcattatgttttcataaattgtgagctgtaaatacgatctataccaaaattaaatactttgtattaacaccttttcgaagattccataaaatagaattgctaaagacaattactaatgagagcctaaatgttggtgcactgactttcgttatatgataagataattgaatggaacacgaagaataaatctaatgtagcgatatcatgctgattcggttagcacgtgcacactgcgattgtttttgcaacaaacgactaggtggtgagtatttgcaataaaatgatttatgggatggaatgtcaatctttgatggtttttgcaatttttcatataagctgtgaatt

SEQ ID NO: 3328 - DNA, 2026 bp, Oryza sativa
ctgttccacgtgcacgtttttcaaacagctaaacggtgtgttttttgcaaaaaaaaaagttttatacaaaagttgcttaaaaaaatcatattgaccccttttgaaaaaaaaaagctaatacttcctctgtttcatattataagaatttctagcattgtccaaatttatatagatattaatgaatctatacacatataacatctatataaatgtaggcaatgctagaaagtcttataatatgaaacggagggaatacttaattaattacatgctaatggaccgctccattttctatgcgtggaagatcggttcccatcaagcccaagcgaactcagctttagagcagatacaatagcaggctattagccagctataaacatattataataagataaaacgatgagagaaaagagcagcgggctatagatctgtagccagctacagcacggactccaagacgcaatgtgtgtatgacaggtggaaccatatattaatagtatagtaagcaactattgtataaattgattattagattgactatcttattaaacttgctctagggcaaatactataatgtttgtttgatgtgttgcccctaaaaatacgtgctcccctggacagcccctgccctccccgcatgagtttgaaggatgtaaaaaaaggacacaggggtatttttgtcatttcggatgtcaagacatcggtggaatattgttaaatttctccaaattttcttccggtcggtctcgaaccttcgtctccagctctcctccgcaccgcagtccgcaaaccccagtttctcaagcatcgaagaatggaaagaggagatggcgctatacccttccgcgccaccaacatcgccgccgccgccggcacgcccacctctgcttctactgcggtattcctcttttttcccctcttgatgaaatatttcctaatttccttggcagtttgccatcttggaataaaaattttgtggaatcagggtattctcctgcttgtattctctgtagatgcggttactcagtttatcaatcgtctcatccacttagttgtatggggaaagcggaggctgaacagtttgcttggaacgggcaaggagcactgctacttctttgattgagatgccattagtgaatgtttctgggttgagagttgagtaggttctttgagggaaatgcttagtcttatggtttttgagaccgaatttatgcatatatgattttaagctcatttgttatgagtagcagtatcactaattttattcatcagattgtgatgtggatatgtggtgtgctgatcaaaagctgattttgtttgcgatcagggccgcccccagcaaggggatagggaaaatgctgtcagtgctgagattgagagggttaacaaactgccagccaatagttcctatgccatacaccgcttgaaggttctaaacaagcttcgccatctattatctatcaaggttagatttttttttgtgtattttcggaccaagataatttgagtcatcctgctatgcaattgtcctgtcaattggtcatctgtgcagtgaatttaaaattttcaacttattgctttttagttagtacatctcaaaaggcaattttcaattcttaacaagagaaaagaattgctattattatactatattctattaaagcctaatttaaagatagcaacattgctattacatgttgctggaggaatatcttaccatgttgattacgctgttggtttggaagaataattttcaaaaccaaatgcaaatttgaaggtcgtgagttattaaccatggtgtaattgtactatgtgctctttcaaggcatcaaagcaaaactattgcgatgtaaatgtggccacatgaaaaaaaacataaataaacccaaggaattgaaatattagattattggattccttgtcagttaagtaacaaaaagttgtgatagtttggtactttggttgctaatgtgcctagattgtaaaacccgatgaaaccctttttggcttagtgaatatgcaactg

SEQ ID NO: 3329 - DNA, 1424 bp, Oryza sativa
catgggaaaattttggcattactgaaacattggtagagtagggatgtttggtttgataccaaatagtgttaaagtttggtgctgccaagattccttggatattaccaaattttggtcgcaaaccgagtactcctagaaatcaaattcctgtggcaataccaaagttgacaatggttagaaatggctgcaaatcaaacaggcccaaagtacacaactaaatattcatattctcttatgtatatatttcttttttgtttgaactggcaaattgtatccagaactatttcatatgtaaatttagattttcttatctgcttctagtttgagcacgttgttaaatcaagtctttactggttatgtacctatgtggcttctgacctgtgtctcacatgttgaggtccgttgcatctagacttcactggtggtaggatggacttatgtcctgcttaagtactgtggcaggtggcatcatgatcaaattgaccaaatgcgtagtgcccagaagaacaaaaaataactgttaaaaagttcaatttattttttaaatcattgtagtttttactaattaaacttttaatcatgggcactgtcattcatttatgctgttaatgaggtggtgctctataaaccatgattttaagaaatcacaccttatggagtgacatgaaaagatggagttcctcttaaaagttaaatatttaacacgttaactaagggattatatgaatcttagtcccagcaaaaaaccaggttttcttaaattttctatggttaatatttgagttgtttgaaaaaacaactccaacttgattccagggaaaacaaaatagattatcgaaagtaatttactatttttcaccaaacaagatattcactaggtactatcctgattacttggttccagtaatcttagcagttcacacttcagtctgtagcccaaacttatgttgccagtacctatgaggaaatacgtcgcactcatgggagaatgtgtgcacattaccaatatcattcaacctccttagagattcatgctcagcaccatatccatggaagcgcatcgtctgccgtcgtaactataacggcatggtcatgccgttggcaaatcctggacgttcctcttttttggacgattaggatttagaagggctccaattactaggcctaccaaggctcacgatgctttttttttcttaactcggtatcgatttcactttccccatcttcatccctcctctctctctccacgcatctctcaatcactgcaaagcaagagggccgattcagtggcttcaaccatgaatttttgctggcaatgaccgcaatatgctccctgatattatccaggtttgcttcccatcatttttgtcaattaatttggcccctgttgctagcagcaatcagtcctggaagcattggcaaca

SEQ ID NO: 3330 - DNA, 8996 bp, Oryza sativa
ttgattaagaaacccaaaaataagattcccacttgaattggtttttcaagagctgatacctaaaaaacttaaaacttgagcttcaattttttttatgcaaacctaacgtaatgatcaatgaacccaaaaacctatgtacatcaactaaaagttgttgaacatgaatgagaaaaacctgcccacgaacttggattttactgcctccgacctggccgccactggcccactgccattttggaatgctctgcagcatgatcgggtcaccattgaccattagtcctactcctcaggaagtccttgcttaagtgaggctttggctctagcagcggcaggcatgctgtatttctttgattggatgcattcaattgtgtacaatctcacgagcagtgctggaggttccaaatagcacacgaacctatatatgcgagcaccaaaagcttgttcgatgcttatatctaatttattgtcctaacaagaacagaaacttcttggtgaaatgaaataaaagtgccatggagttgaatagcttaaggacatgttttctctgcattatgatttattttatgaagcttatattcagttttgactttttgtaaacctagactgattttattttattttattgtgcaccacagagaacaacatctcaagatgaggagcttgaacttctttttgcaagcctttcaatttaaacactatcggactatcctgtatcctccatatgttacatatggtaggtaagctgcaaattaatactgaactttttcattttggcagctgtgtccgtaatcactgctggtattatccatccacttctctttttattcaaatggatcctatattttgacttttttttttacagcaacctatattttgacatttgatttgtatataccattttatttgcagctgggtggctccgtttggcatttctgctgtccgtcgaacatgtttccagtacggttttctgaagttattggaaatcacccttctattttgtagaactttatgagtggatggtgttgaaactatgatgtatggagtatatgatcttccgtacgcaaatgtcactcttaaccataacggaacttctatagttctattgtagatgcccaaaactttaaaaattgtatgacattattaggtgttgctatgttggcaatggagcaaacattctgaatttatgctacacttggaagtgtagcataaattcaaatctaaccaccgtaacgcgtttcgttcgagtaaaattcctccacttggaagtgctctttttttttttttttggcgttgcgttgcatatggcattacaaaaagctatctgtttctatttgtttaagctgcagcctgccatagaggaacatttagcacagtacacgcttcgttccaagttaatttcaactatatacttgaaagttatttcgtcccaagaaataattattatcacctaatagtttagattaccctaataaataaaatgcacatccgataaaattagagatccggatgatggaggatttaaataataatattttagttgaaaagatacgatagttaatgacatgtatagatgtacatcttatattataaaacaacttattatattatggaacagagggagtataattttttttaaaaaaatgtataggaaagttgctgtaaagaaaatattgattcatttttaatttttttaagattacttattacttgatgtaatacttatttaatcatgtgttaataagcaacccgtattcggtgtacagcctaaaggggaacctaaagggtgttgtgagtaggaataagttcatctgaggtcccttaactttacaccgaatacaattttcgtccctcgaccggaaaaccagacacaacgggtctctcaactattaaaaccggtgtagattaggtcccttggcggttttgagggcggttttggctgacgtggcgcctacgtggctaatttgactcggtctttatccgacgtggcattgacgtggcgcttacgtggcaattcgatctgtcgaacccacatgtcagtctcacatagaaaataataaaaaaaatcatgggacccacgtgggtcccatgtgtcagtccaactcacccctcttcttcctcctttctccccatctctctctctcttcatctccctatctttgctctctccaggcgccatggaagacaacagcgcgcggcggcgcgcggccggcggtaggagaggagggagcaacatgtaaagaccggcgaggcgagcagggagggaggacgcagggaggccggcgatggccgagcgccgtgggcgggtgcttgatgacgatggacggagggagagatgtgcagccgacggcggccagcgggagagggagcggcgatcgccctccgccacaacccgcctccaccaccgagctcgtcagcgaccgcccaccggagcaaggaggatgacagccggcgacgggtgaagaggacgaaggcggcggtttggagtagaggtcggaggagggcccccaaccaccaggatggcgctcgatccgtcgcgtttcaccaccaccgagcttgtcagcggcagcccaccggagcgaggagcttccgcttccccttccccccattgacgccgccgctgcagcagctgaggcgccgctccctatgccaccggttctgtggcgcacgccggatgcggacggggacgccatggccgtggccgcggacgacgtcgacgtcgacctcagcatcctcggcgactcccagggcccccgcgccgccgccactaccggggggagtagcgcacagcagacgtcctcctcctccggctgccaccgccacgcctccccgcatggctgcatctcctcctcctctgacggccatcgccggccaccgccccttctccccgccggccaccgcccttctcccggccgccactaccggatctcgattgctggcgttgctccggggggacctgccgccgcccgggtcgatctgttccgcccaccgccgtcgccgatccccttttatcgccctggcttcctcctccagctcgctgctctcgccggtgggcgccggtctcgccgccccctccagctcgccgctctcaccgaaagaggagaggagatgggagagagatgaagagagggagatggggagagaggaggaagaagaggaagggtgagtttgactgacatgtggggggtccacgatttttttattatttcctatgtgagactgacatgtgggtcccacgaattttattatttttccgggtcaaattgccacgtaagcgccacgtcaatgccacgttggacgaagaccgagtcaaattaaccacgtaggcgccacgttagccaaaaccaccctcaaaaccgtcgagggacctaatctgcaccggttttgatagttgagggacccgttgtgtctggttttccgatagagggacgaaaatcggattcggtgtaaagttaagggacctcagatgaacttattccgttgtgagtaagcccatccggcccaaatgcttcttacagctggtccagcccgcaaaaagtcggagacagggaccctaggcctagaaacaaaagcgaggaacagcattcacccacctgcctgcctggaaggaagaaccaatccaagaagaagcgatggcatctcgtctcgttgcggcggcggcggcgtcctcctcgtcttccccgctcgcccgcctcgtctcccgccgtggcctcgccggcgctgcaggtatgcgcgccgccctcctcctcctccaccttcccagatccgcgggagtcgtagccgccggctgtctggatcggactgtcgtttcggtccattcttggatccacccttggcagattcggggccacgatttggtagcgggggtagttgtttgggggtaggggcattggctcgattctgattagggtttgttcggagttgtttccgctagctagaaacggggtgcctgtttttattttgttttgttttgttctatttatgttgctcctgctgtcttacattcttgattggttcgtcttctgtcgtttccagatcaccatgggcctccgaaggtcaacatttggcaagaaccgatgaacccggctaactggaaggaagagcaagtgagtattcccctggacattcctcctgttttccgtggggcacatgtggctcttgatcttgatgtcattctattctactagggtctctactttgcctgcagcaagtgtcatgtgatcttgtaggcatgactgtcgattttattttccctcattttgttttatggcattattccagttaggtacagttatattcagtttaatatgtcttgttttacaagattatggcaacgggtatgtggaaatggggattgaaaggggattgttgcaacttctatattacaatgaaataaaattgacactattgttgcaataattttgtggtttgttcatacatctgtattatgcttaggaggaatggtccaaaatctgcttgatcgaactgcaataattggttagggttctaagttctatgattatataggctgttatgaattttaactagtaaatatggctatgccttctctgcaatggctggaaagaatgtttttctttcttggtactcatgattattgtcttaggacaaagcttatatgtagcgtgaaattaacactattctattgttccagtgtgctattctgtaatgaagtaaatgtttgttctgtatgaaccatctaataattctcaggaaagttatcagagaagttttcagttaatttactccacttaatagatgtgcttatttgttaagctgaaattctagcctctttcataattttaaagttattttactacgaaccttgtgcttgtggctcatgcccagatcatactcatcacaatcatctttcaaaaatcatcatttaaaattatcatgcttgccatagcgagctcaaggtgaggccaagggcagaagtgtgacaatgtactggcagagtagttcagggatggggactagaaagaagttcagaatgagcagatttgagtcttagggataaggatgcagagatggtggatatggttgttggtgagaatgggggaggttgtgcaggcaacgttgagaaccaagatgtcatccctggttcatcacttgctggccaccactggaagccaggaacttgtcactctcctccgtgtcgctctgccacaacccataccgcttctgtgtacagttggctagttttaagatagggttgtacacatgagatgggacagctgtttttactcccctctcttctccatcctcaaaattttttcctccatccctgtgcagcacctatgcgcctgcttgcgggcggttggcaagcagacaaaagcttggctagacgaggtgaacgtcaatagtatccactttgaggagcatttgtttcaactgtcaaggaaacaatttggcaacaccgtgaaataatagtgaagtagccaataagaattaattcttgttgagctaaccttgataccactaaacacacaccttttcagaaactataattctacagctattatcatgtactctgtacacccaatttggaatatttttaagatgtgttttcaagctctgcattggtcttctccttatgtcatcaacctcgttaattgtacatgcagtttcttctaaatgactctgttctacataccttaggactttgctggaatcatattgttttgttaagaaagttttcttagcttggaactattgatactaattgattgatagaccctatctataagttgatttttttctggtttaatttagatcctgttttttagttgttattctttactttgtgcagtttgtgctagccagcttagctatgtggggaggtattttttatggtgtcggcaggctttttagtgggaagaaggaagacaaaactactgaggtattcattttttacttatatttcttatcttgaataatgctcttgttctcagagttctgatggtgcatgaaatatttaactaatactccgtatcaattaatcatgaaagttagagttagaagcacaaggcacaagtacatgatacaatgtgttcctttcttttgaagggctacctctcgtatttgcagctatattattatgtcagtatagtatagtgtcaagatattgaactacctatttcagtgtcatcagcagatctttttttaccaattagttttgatggtagttttaatgcttgcaagtatctaattatatgagtcgtgcactgtgacaaagaacatgtaaatcaaagagtacttggatttgtctgtttggatagatggtcaagttaaatagatactcccttcgtcccaaaatataagggatttgggttggatgggacacatcctagtactatgaatttggacaggctcccagtccagatttgtagtactagaatgtgttacatccaaccaaaatctcttatattttgggatgtaaggagtattttacaagcactgtgacaaagaacatgtaaaatcaaacagtgcttggatcatttgtctccttggatagatggtcaagttaaatagatattttacaatcatgtgccaatttcatgatgtggaaaacatatgaatgcacatatgatctgaaaattaagcattttttccctcaaaggcatgcaaacgaagtattgctgcattctgaataaattttaattatatctgattgaaatcctccagtagagtttctatatctgtgctcaaattccccagtccccaaaaattatgcagctaatatgtttgcttcaagtaattacattgtatcttggaaaactcagtactttttgccaggtggttttttttttgggggttttcatgtttgatatggtatttatgtagttttatggcgttaaatacttctgctaccatccactactagtcagtgtacaagtgagaagtgataataggtggatttgtggaagtgagaaaaactgaaaaaaaataattgaaatttaaatagcatttgctccatggaaaatggtttttcccatggacatgtgactacatgcacagcttccactatcaaatgtgccgcaagattgatggtaatttttataattcaaatagactaattaatgttccatgcagtcaaatctcccagtcagaaagaaatattgaggcagagggttctatgtgtttaactatatgtgatacatgagtgtcatttaaccaaaaacaatgattcatgatccatgttcaatttacatacatgattgtatacttgcttgctattatgtttctgtcagcacaaaacttatctccattttattgtaatgttttacaggcggcgccagcacaggcataataggatttaccagagccttatttcatgctgcagacgtgcaactgtatgaaataaagaagaattttatggtctgttttaagtttgtatcgctaatggtaaattgtggcgactagatgggtgattttgtaagaggcgagattttgtggacctacacttgtcagccagcatgaataatctttaccgcagtggaactttggttgagaaactgcaacagcgtcttgatattttgttgtcatcacatcaattcatgttttgtaatcaatattggtgcgattgatcatgatcttgcgttatcatactcaggttgattacgttaccgtctggggagtcgaattacttccatgttctaactaaattgatttgtctattttgactgtttggattagtcttgcaaggtatgattgtggttgtttcacgtttttattcacattatttatttttcattattactctccatccaaatcgctcattgtgccttgtggcggtgatcgtgatcaggttcacagaaccgatagaatttcgtgaaaaccggttggttttttgaaactgctgggtctcggtttttgaaaatcggatggaatttcatgaaaaccggttggtttttgtgaaactgctgggtctcggtttttgaaaatcagtcggtattagctagttttcatacagtgttttgactgaaagacatcggttttcaatggtttcggtcggatttcagtaaagttaaaccctgatcgctatacatgctcacaccggcgataagattagtcatcttcaatttgtcagacgagacgtttaccctcctcaatgaccagccataacatgagcatgagtacgccggcttcttcaacactaacgacgacacctcagttgggcctggatggatgccctgcacggcaatacgataaccatgactcacctgagggatggatgactgtgcgtcttctttcctgtactctgtgcctctgtgcttcgatctctacacaggccgagtttatttcgaaactttttcttcaaacttttaacttttccatcacatcaaaacttttctatacacgtaaacttctaacttttccgtcacatcgttccaatttcaactaaacttttaattttggcgtgaactaaacacacctacaaataagatattcagtttgtaaaacacgtttactactttcttcatgttcacatttttctatgtctgatgattgtcttttttttttctttcgacaacttgtggtgattgtctgaataatgcgtgcttctgagttttgaacaatggagcgtgccgaacaaaaagtattgtgtccaatatagtatatcttagtaacacacataatgagggtggttgggggtaagattaagtgaatacttcctttgtcccatatttaagttcatttctagcttcgtcccataataagcacatttttagagtaaccattgtatcggagtttgtagaagtagagaatagtcgtattacgagcagataaagtgatgaatagttacattgagattagataaagtagggaattctatcttttggtatttttattgatatatgtgtgagatggtgaaaaatgaacttgttttgaaacagaggtagtattaaagatgagtcgtggttggatgcaaatgtggatcccatatttgttaacaggatgtaaacaaaccccgggat

SEQ ID NO: 3331 - DNA, 501 bp, Oryza sativa
  unsure (1)..(501): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnatcctacaagctaagcaatcagcagcagctatgcaacttttgagggatgaactagttgtgcttggtgataaattaaatgagatggttcctgaaaaagagcttagccaaattgaggaatttgaatcatatcttggatgtagcattccaagtcaaattgaaatccacccgccaaatgacactcgttccaggggtcggataaagagaattaaagggcacaatgacaaggagaaaaagcaaaacaagaagataaagaaaaaagagagagtaccacaaaggtgcaagaagtgcaaacaagtcgtgctgcacgattcgcgcaactgtcctaacaaagaaccacaacagtgatgcaaggttctatacatcatgcttccttaactatcagtcatcttataatagttgtcatacaatttcctggaagaa

SEQ ID NO: 3332 - DNA, 4750 bp, Oryza sativa
tcttattttatttatcattcccaggggaatttttcaagcgatcaacgtgataggctacaatggtgcagtcggggtgagtttatactgtgacagcatttctcgattatgagatgggaacagaaaacaatagtgcaatttgcacatttcaaaatctaaaaataatttaatttaagcaattgctaacatcttcaagccatatctaaaagaaatctcaagctttaatactagcacccacaatttatacgcataaatgtggtcttacggtaggaagtttaaatatggtccatggagttatgctaacctaaatctattgaccatttgttgaacgagcacaatcgcgggtgagtgcttgcgggatgtgtgtgagtgtaagagtgttgatgtaccatgtgtggatggacatttttctcataatggaaggaaaaaatattatgatgttttcagactggaacaagtttttcaatatatatatgaaatgttagctacaatgaggtacctggagagttcagagagtagttgtatcaccttaatgtaattaacttagattaataaatcgttaattatctaaagaaaacaacttttggcaactcctcaagttagtaccataaaatcgttctttcaaatacagtttcacttgctatatttattttgatagaaattgttagccccgtcggttgccctaaaaagaataagccaatgcgaaactttgaattttcaaacttaagttgattttaacatattttcattgtaatttatttttcaacattaactgttaagtcgctaagaacacatatataaacaatttacacataaattattttatatcgctaataagccgttacaacttatagttagcttttggacaaccaacgaggccatacataatactcttttattacaagattagtcctcagtttacataacaagatttataaaaaaataagcttaattttttttatggatcggggcagtgtttcatacctgggtccttattatacttcagatactagttgtacgactgaagggatacaattgtgttagttgcactagttccctctttcaatgctttcataattacatgaactatttccgtctttcagatattattcttcatgggtttcgccatgttcgtccttgagacgttgctgagcatatgggtcatgcaggtaagcgcacacacacgcattaattaactttgcctacatatataaacccagtgatataacttccttcaagacagaatgttaatcatgggaaaacctctgcttctacttgcagaaagtatattggtatttccgcgggaaagggaaggaggccgagatgaggcctgatgctgcagcaggcggctcacggttctgacgacatagcaaccctgaacctgaagctgcagctaaggatagacaagatcaagcttgaaattgttgtgaagttgtaagtggatttgttggattgttgtggacttgtggttgatggaagtgcaagaactgatgatgtacttatagatcagaattgtttcacttgtcactcacatagatattttgtttgctcaacttactttccttgtctgatagtctgaaactacagttcctagaaaagaaagtagaagcccaatctgtgccttgttcagatgctagctagtagtagctgctacagagaaaatctttcggcaagcatatactactccatccaaaaaaaaaaacatttctagcaacgaactatatccaggttcataggtaagatagtttttttttagggagggggtatgttgttgcatcacgcatatatatactttctgtctttcttgacatcatgtcgcaatccaatggaaagaacagatacggggaaggccgttctcgcaaaatttcagctatgaactcgcgaaatcttgcaacatggatgaaattttgcgaatatctagtaaagtgtgtaatgtagaaacgtacgcggtcgctgtcagggtgggtaagggggcggcaaagtgagagaaaaacattaggccgagtctgagtcgttgcaaggctgaggtgtttgacggcaacaaaaaaagtaaacacgacgggctgagcctgagcctgccaaatccacgcggagtccgctaaaatttttccactggttctagatgatcgccatcgatgatgcaacgaccaactgcttcctctgcggaatagctgaataaattcagagttcaggtccatctaggctgctgctgctgctcttcgtctttgctgacctcggcacaggcagagagagaagccaagaaaagggaaaagagaggaagaagagagggaagaggagaagggagacgcgcggtgatcggaggttgatccatggctggcaggtcgagatacgacaaccccttcgaggagggcggcggcgacgaggtcaaccctttcgcggtaagctcgccggcgagctcgccatgtttttttgtttccccgtcagaaaatattcagacccatcttccgttcctccttgattcctcgagttgctttacttgtatatatagatatgctttacttgtagcaaaattgattcggtgatcatgtctgcttcgaatttagttgcacccataaaaacagctcggcaaaacaaaccaaaaaaagaaaaaggagagagagaatatggttttatgagaaaaaaaaatagcaggaacacaagtgacaaaaaaaaaattgtttgtaccttgactggtatgtgcagagctgcctttgatttaggtcctgtctgggatttttaaggaactacggatgatctaaaagtgattctgtgtcctcttcatgtgttgcaattttgcaactagggactttatttccggattcgactgtggcttgctagttgcttgcgaaccctgtttcttgtgtcatgggagttttatcatttttttagataatatgggagttttttttaacatatatacaatcaactgcatgttgagctcacttcatatattaaggtttgtaattctaattcattttttaaaaattttacttttactggagagaagtgcatctgtccaaaaatgtagagttcctttgaattgagtgaaaatttgctcaaattcagcaaaaatattttcagaatttaaaaattttatgaaagttatttttggtttttcatcacctccaaaatcaattttgcatttcgaaatgtaaaaccctgtatatatttaataactctcacagcagaaacatatgtttgtgcaaatggcaagttaatttttttttcttgcaattcagtatttctgctttgatattaggcggaacgctgtttacaaaattaaaaaaagggactacaaacaaataattcttcaggcaccaatcgcaataatcttactgatttatcttgctcaatgctcatctatcaggataaagcttctaaaggaggatcagcaggtcaatccagctattccggaggcgcattctatacaacagtgagtttgcactacacagaattttacttacagaaattataaaacgatttatttgctggttgatcatctgtacgttgacgcaatcatcttgatgcagcaatacgccctagtgctccaccggccacccacctttcgcctcttcctcctgagccagctgacttctacaatgacttctcgaccccggtggatattccaatggacactagcaaggttactacactactctgaatgatgtgatgaaatgttatttgacatgattcccaaaagtaatttacctgcgtgttaaatatgcataatataggatatgaaaacaagggagaaggaacttcttgcaaaggaagccgagctaaacaggcgagagaaggtaacctgaacatgatgcagaacagtgttagctgcatgtacttccttgaatttcaattctttccaactatgttggcaaagttgttgtgccaagatggatttgattatgtgtaacatgctgattgtcgcttacgctgtataggaaatcaaaaggagagaggaggctgcagcacgaggtagagcttctgttttgttgtcatcatttttttctttcttgttgccctttgccttcatccctgtagatttgcactgctgatcttactagttttgcagctggtattgtgttggaagacaaaaactggcctccatttttccccatcatccataatgatattggcaatgagatacctgtccacctgcaaagaacacagtatgtcgcatttgcgtcactcttaggtacgtgtttctttgatttgtcaatcctccaatttgctatgatcacaacagcaggaaaaagaaaacagatcataccaaaattattgtttcgtactgtactactaaaatgtacctgagttcattgaaaaaggatttcgtacacaatatacaagagctcatttcctcttttctgttttgtaggattggtcctgtgcttgttttggaacatcatctgtgttacggctgcttggattaaaggggaaggtgtgcagataaaagtccctttttttctgaaatatcattttgtgaaactacactatacaatttgaggtgttgtacgcactcaactgtatataattagaacttatttatatttactccttgtttcttaatgcaggtcccaagatctggtttcttgctgtcatctatttcattcttggatgcccaggtgcctactatctgtggtaccgaccactttaccgtgccatgaggtaaatgaaatattactacttgtcacacattataatttgcattttttgggatcattttttgtgaggttttctgttgtttagttcgaactaa

SEQ ID NO: 3333 - DNA, 18944 bp, Oryza sativa
acagtttcccgttttcttccctatatgtgctcagatagcaatctatctatctatctattctattatatactaaaaatccattaaacttcctataaacactctcaagccgccacgtggtcttctacaaacgcttctaagtcgccacgtggcactctactaaattagaaaaaatctaagaaaaaaaaaacatccatcactcaatttcacttaaaatttgtggacccatcattttcaaccattggatcaattaataaaataatcccaacaaactccacctctacctccgcgtacgtacgaatctccctcctgtacgtactcacgcatactccctctgtttcataatgtaagactttctagcattgcctacatacatatagatgttaatgaatctaaaaacatacatatgtctaaattcattaatatctaaatgaatatggacaatgctagaaagtcttacattatgaaacggaggaagtacaaaactacgcatggacagttcccttttctatctcttctttttctgcatcgtcctattttatatcaaacacttctatgaataactagatagttaaatgaacagaaactttaagcaatatctcctgtttttatttttaaaattgttttaaatttataattaaactaataatttgagattaatattgctcatattttgctatataggaaaatacgtagtttggacatagaaccctttctttgcatagcaaccaaacagcaataaaacatttaaattggtagaaattatatcttgttgtgaacattttacaagtctaaattagattgatagtatcgaagcagataaaaaaaataaattcaaccatgaataaatcaatataaaagaataacttgtctacgtaccatacttctacatttttgcatgttatccaagtttgcacttatgcaatccaagtggacatgaaaattatgaaaaatacaactccctccgtcccaaaatataacaacttttagtactcatgatttgtcccgaaatataacttcttcactaagggtgtgtttagttcacaccaaaattggaagtttggttgaaattagaacaaagtgacggaaaagttggaagtttgtgtataggaaagttttgatgtgttggaaaagttggaagtttgaagaaaaattttggaactaaactcggcccaacattcacttccaaaccaatcacaaccatccaccattcagttttctcacctacctccacttctcagccaataacatctctctatttaattccacctactttcttaataaccgtgtccagctctaaaacttcttatattctgggatggagagagtaaaatatggagtatattactatatactcattattagttcacaaatattcacggctaaattagatttattatgcgaacaagtaatatggcctatcttggtgctttacatgacattagagaattatgaaaaatcatgaaaaaaattaataacatggattatatcaccatatatatatatatatatatatatatgcttaaaaattaactaggatttttgatatgggtgatccaaattatacaattttttaaatactttaaatctaacatggttataactctaaattggtcaaatgtacatcataatatattaataatgaagttttttttctttttccaaaagtttcttttcacatatgtttatatgcattgggctagggttatttttggaccggaccaccccttgatctgcctgtctatatatgacaacttcgtaataataaattaccaacaaaagtgtacttgagtctgcaacacttaaacatttataaattttgtacatctaccaattatatttatttaattgtgctcttatttcaatttaaattcatttttcaaagaacatacgaaagcatataaaaaggatggagtaaaagtaaatagaagtctgcttttaattatatgaaatagtcttattaaccatatttttttaatagaaaatatcttcaagtaatacatcctaagatatgctaaatattccaaaaagatatacacatagtacgaatgttagtttcataggaactaactcaattgttctgacataatattttcttataaattcaagccggtacggttttaagtaattttagttcataattttatatgttgcaagggtaattagaagaaattaataatcaacatacaaattaattccaaacaaattattgataaagataaatttagaatagagttaacgaatattacaagaataagtcaaccacatgtaaccattcgtaataaaaatttcaagcaacattaaataaagcgcccgcgcatttgcgcgggttgccctcctagttaatatgaaatatttttgtgcacatggtataccttatgtcttgggcatagggatgcaaaagcgaaatttgatcatatattcttcttggatacgcaaagtgaaatttcgtataatcatcttagattgaattgtaagaatagtactccctccatccaaaatataaggcacaaccacccttaacccaaagaccaagaaataattattatcatcttgtagtttggatcattctaataaatacaatgcatgcatctaatagaattagaggatgtgagagtgaaggatttaaagaattaataatttaatggagaaaatatcatagttaattgtatgcatgcatgtatgtcttatattatggaacatatatataaaaaaaaagtggttggttgtgtcttgtattatggaatggagggagtatgtgtctagtaagatttttgacgaggtggagccgtggaggtgagagcaagaatgctttatatttttattctatatgtggataacctctcgtgttagtaacacttgagtctcctcacagcttctttcaaacatagaaatttcaccgaacttgtacgtaactacattaatcgaaaagcccccacaatctctttacttcaaaatagtcaattttcgatccaaatgaattgtaaacgatcgatctcgggctgaaaaaaatcttttgtcatagtaaaaatctaacgaaactgctacacatttatttgggacaaaatttgaaacattccgatcaacttgctcctcagttccagtttagacaagcttaagattctaagaattagttggctaatagctagtttttaaatatctggagaagttgggttttccaatttctaccatctaatttattttttagattttacaattctcaaaatctgataacaatttaaatggagttgcagttgctcccaaaacaggacctcacgtcctcagctagtccctgattcttcggaaaaggggagggatatttttccctccctccactccgcttgagcgccctccgttggtccgttgcttcccgagctcagaaatcggcggttcgagcttggcgtccttcccactaagtgcaaggtcaatagagagcccactgccatctccaattttctgtccagctcaggaagagctatcctatagcttatcaactacaatagattagctgtaaaatatcagagattaatgcattgaactatttaatgcatgcatggccattttgttgcaccacacatacacaatcacatcagagctagttaaatagaggattaataatcgaaacagtgaaacagttacgatgattcacaaatcttctggcaacatgccatcaaacaaaaggaccacagaaactagataaagttctttggtctgattagacattaataagccacacgaggcaactttttagggataacaaaataacagttaataaaaacatagatataaactgagatagttcttgatatccatggaccatcatcagccatcttgatttgttgccaccagcctgtagtggagagatggagcagaatataaattatgttatcagcagaacaatcacagtacaaatgcaatattaatgccagaaatctaactacttagtgatggtcaaatttctgccaattacagtaaacttttcctaaaactagaaaattagatgtgtctcattccaataaattttcttgaaagattgtcacagccgctacactatagtaacatagattctccaatcatatttttgaactgagatgtaaaaaaagatcaataatgccgctccttctccctcctcctcccacacccacaccaccatgcgcttcccgcgacccgctccacgctgcccctcgccggagccgcagcccgagcacgagccgaccaccaagccggcaccggcgcaccgcctccgcgcggtccaccctgccagccgccgcccgggacctcctcgccgacgaccccacgccccgcgccttctccgcgctcctcaaggccgcctcctcgtccgcctccccgcctcgacggccctcctccctgggcctgggcgcgcagctccacgcgcaggccgtcgtgcgcggcttcctcggcggcgacgacagcaccatcctggcgaccgccgtgctcagcttctacgcgtcgtgccgggagcccgacctcgcgcggaaggtgttcgacggaatgccgcgcaggaacgccgtcacctggaacgcgctcatcaaggggtacgcgcaggcggggcgcagggaggaggccattctgctgttccgagacatgaagagggagggcagccatgttgctccggacaggtatacgttcccggcgttgctttctggcatcggccgagagggtggctctggccgcacgctggagctcgggggagccctgcatgcgcatgtcatcaaagcagggctggagagagaccctttcgtgggggcttccctggtttccttgtatgcggctagaaggacattggaggatgcaaaggtcgcctttgatcaagtgggttcttccgatccaatcgtctggtcatccatgatctctgcgtatgtgaactgcgaggaggaagagggtgctctgttgattttcttcaatatgttgtgccaagacattaagccaactcagtttgtctactcgaccgtgttttctgtctgtggaagaatgggaatactggagatgggcaagcaagttcatgcccacagcctgaagagcaatactgaaaaggatgccgcaatgtttaacgcgcttttgaccatgtactcggattgcggatgcattaatgacgcacagaaagtattctcttcaaatgattgcgtgaatgtaatttcttacaattcaatgatttcagctcttggacagcacggatatccgaaagaagcacttgagcatttcaggcagatgaagtttgctggtcttatgcctgacgaggtaaccttgttaaatctgatctcttctttcaaccatgctggtcttgttcatgaaggcctgcagatgttcaattccatggtggatattgaaggcataaaaccaatgtatcaacattatgcctgtgttgttgacatgctggctcgatcaggagagattggcaaagccatgaaaacaatcaatgaaatgccctttgaagctgaagcaccgttatggaggattgttcttggtgcatgcagcaagcaccgtgacattgaaactggcaagcgcattgcagagatgctgtttgagatggaaccctatgaagccacaaattatatacttcttggtaatatttatgcaaggttaggaaggtggacagaagcagaaaaggttagaagtctgatgggtgagagaggtgtttataaggatgatgcatttagctggattgagatgggtcagagaacatatagatttggtgttgatgaccgatcacaccccatctccagagagatatataggaatttagatagattaataagtactatcaaggttgcaggctatgtgcctgatatcagttttgctgcacacaatatacaaagggatagaaaggaagaatcattgtattatcactgtgaaaaattggcatttgcttttggggacttggctgctccttctggaggcactctccgcatcatgaagaaccttcgtgtttgtggtgattgtcattgtgcgtacaaatacttctcccttgttacaggaagagaaataatattgagagacaatcaaaggtttcaccatttcaacagtggtttttgttcctgtggtgattactggtaatggatcaataagctattctgcaatttcgcatcctagcaatgatttaagagctctaatgacaccatatttgtttaggtatgtgttgagctttcacgcaaaacaaaatttccattcattacataggagcacaatataccttttttttttaccatgttcaatgcatgtcacataaaaatattaatgagtagagttgtaaatgatattcatgttgttttgctactttcattcgacatgtatgttccaaatttaggaaataacaaatcagtatatatttttagatcctgtagtaaagttcttaaagattcctcaaagatatgaaattctggtacttctacccagtacctttgctctctaaccatgctgtagaatgcttattttgggtccatttggataatgggatctgaggagtgggattgagatatggaaatgaatgaagggttcggaattagcatgaaatggggtggaagaatggatgactattgtcggtgacatgggaccgggagtatcatgactagaggcttgggcagccgcggtcacccacgtggcctgaccccctcgggggggtcgggcccgagggtgacatggccaccccttcctctgtctccccgaggggtcgggccgctcccgtttcggccccgagggctggggcgccccgaccccctgtggttttggcgccacgtgtatgggttaggtgagcccggcggggctcacctaaccgcatttattgcgggttggacgagcgcgccacgccgcatttaatgcaacgcagcgcgctcgtttatccggtccgtgaccggtcgcagtgtgtgaccggtcacagaccggtcagattgcgggttaggtggcagcaggcggcctgtcacacgcctcgccccgtcccgtcggaatgatgaatgcctccaggcacttgtccctagccggagccggcgtgctaactcctggagttagcacgccagtcccggccagatacgttctaggcttcatcgcaaccattgcaaggaagtcattgtatgaagagggacagacgtgcggcatgctaaactgacacgtggtggacaagaatgaccggtctgtgactggtctgacgccggtcacgtcatcggtagacaaactgtgctcccgcgttgcatccgttttcggcgaagtggaggtaggtatgacccatcccatcggaggggtcattcggacagcggccattgcaaatctccgcccattaatgaaggaatgacagggtgatcccctgtgtcaggcgagtgacagcgctggtccacactcaagaacaagctgtgttttagcttccaagcgaaggcgcgagccaagttttggtcaagatagggtgggtccccacccaaaagaaggggtaggtagaagtgttgcatgtggtatccccttgagatataaaaggaggaccttgcccactgaaaaggggggataaaaaaaaaagatcgtagcttggaggggggagagagaagatggtagctgggatcggagagaaagaagatcgtagcttgtagaggagagaaagaagaagagggtttctagagcctggactttctggttctccggctctctgtaaatccttcacacacagatccaccagaacacaggagtagggtattacgcttctcagcggcccgaacctgtctacatcgcccgtgtctcgtgcatttgctctctcgcgaatattccacagatcgagggtgaagaacctcacttagcgcccccggccgaaccggcaaaggggggcctgcgcggtctcccggtgaggagccccaagctccgtcatctggcgcgccaggtaggggtcgcgtgtgtctttctgagccctcaccctctttcgtgtgcgctaagcttctcccgcttagcccaatggctgaacgggcagtggcgcacaacccctctccgagcgctagcggtgacgacggggagcagaacccgcgccgtcgagctcgtactccaccgtccccctctcgcagaggtcttgggcgggaggaggcgcttgagggggtcgaaagatccgcgacttcgccgctcgcgggtgatggagaaggacggcgagacggggagcgtcgcctcctcgtctacggcgatggcagcacgccccagggcgcgctccaggccgcaggcgcgctcctgcgtcacccgcccgtcgtccctaatccagagactccagcccgacgttggctggatgacgtggccaacttggtcatgacggcgcagcagcgcctaggcgtcggcgggcggtcctccgccaacaaggcctctggcgctgctaccgccggctcagtgtcgtcgaggcggagggtgcggcgagcggcggccgttgcccgccgttcgttcgccattccctcgacaacgcctccgacccaagaagatgtgcgcgggaggccggatgcccgcctcaatatcgagcgccggcgcaatggttgtcgtgctgcccacgcaacggagggcgcttcctcgtccagagcgccacttcggtccgggcacgggggccagtcccccgtgtccccggttggcggtgccggctgtcgagccttcgtggcgagccttcgaaacgtccgttggcccccaaggttccggcccaccatcaccgaaaaatacgacggaagcgtcaaccccgctgagtttctccagatctacacgactgggatcgaggccgcagggggtgacgacagggtcatggcgaatttcttccccatggctctgaaaggtcaggcgcggggttggctaatgaacttgccacccgcgtcggtccactcttgggaggatttgtgccagcagttcactatgaacttccagggcacatatccacgcccaggtgaagaagcggacttgcatgcggtacagcgaagggacgatgagtctcttcgctcgtacattcagcggttctgtcaagtccgcaacactataccatgcatccccgcacacgcggtgatctacgcgttcagggggggcgtgcggcacaaccgcatgctcgagaagatcgcctccaaggagccccagaccaccgcggaggtttttcagctcgcggaccgtgtggctcgcaaggaggaggcctggacctggaactcccccggttccggtgtggcagcttcggccgcccccgggtccgccgctcggccagggcggcgggacaggaggaggaagaagaggtcggcctattccgacgacgagggtcacgtcctctccgtcgagggcgcttcgcgggccacccgaaaggggaagcctgcgagcgacaaaaagaaggaggcccgcgctcccagcagggaacgcccgtctggcaaatggtgttccgtgcacaacacctccctccacgacctcgcggactgccgcgcggtcaaaagtttggccgagcggacgaggaagtgggaggaggagaggaggcaggagcgccgtgagggcaaggccccggcggctcctgccggcaaccggcgaggtgaggccaagcagaaggccaccgccgaggacgttgatgatggcgacgatgacctggggttccaggagcccggggccaccgtcgccaccgtcgatgggggagcgtgcgctcacgtttctcgccggagcctcaaggccatgaagcgagagcttctggccacggcccctacccatgaggcgacgcagcgggcgcgatggtcggaggttgcccttaccttcgaccaaaccgaccacccgccgtgcgttgcccggggaggacagatcgcgatggtggtttcccccaccgtttgcaatgtgaagttggggcacgtcctcatagacggaggcgcagccctcaacatcctttcccccgcagcctttgacgccatcaaggccccggggatggtgctccggccgtcccagccgatcatcggtgtaacgccggggcacacttggccgctaggtcatatcgacctcccggtcactttcggtggttccgccaacttccgcacggagcgggtgaacttcgatgtggcggacctcagtctgccctacaacgcggtcctggggaggcccgcgttggtgaagttcatggcggcggtccactacgcctatctccagatgaagatgccgggccccggtggccccatcaccgtccacggcgacctcaaagtcgcgcttgcttgtatggagcagcgcgcggaccacctcgccgcgacgtccaagcccgcgggtggcgacgagaggctcagcacctccgtcccagccaccccgaggcaacggatggtcacgtgcgacgaggtcccagtcaaggaggttgccctgggcgacggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaagaccggtccggcagaaagtgcggcggcaggccccggaacgtcaagccttcatccgcgaggaggtggcgcgacttctggaggccggattcatccgtgaagtcattcatccggagtggctggcgaacccggtcgtcgtccccaaggcgaacggcaagcttcggatgtgcatcgactacaccgacctcaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacgatgcctttcgggttaaagaatgcaggtcctacttttcaacgtactactcgaatttctttgggtagccagttaggacgcaatgttgaggcctatgttgatgacttggttgtgaagacgcacaaccaagagaccttactctcagacctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcgctacccctatttaagctcctcaaatgctccgggccgtttacctggacggaggaggctgagcaggccttcactcagttgaaggcgtacctcagttctcccccagtcctggtcgccccggagccagatgagccgttgctactctacctggcggcaaccccgcaggtggtcagcgcggcgttggtcgtggagcgcgacgaggacaaccctcactccgcgcatccccaccctgtgtcgactcaacccgggagtgagcagggaggagaggcccccgagccgaacggtggcccaaggcccccgacggccggagctggccctccgcccacttgtccgacggtaccaggcgcccccgacccccaggaaggccccggggccactgcgggaaggccgcacctgtcgtcctctgaccccgaggttaaccctgtgtcgacccgacccgggagagagcagggaggagaagcccccgagtcggacggtggcccaaggcccccaatggcccccgaaccgaacggcggcccgaggcccccgacggccggagctggtcctccgcccgcttgtccgacggcgccaggcgcccccgacccccaggatggccccggggccactgagggaaggctgcgcctgtcgccctccgaccccgaggtcatcggcacagaagccgagtgcgcggcctctcggacgaagagcgccccgttgatgcggcccctagcgaagaggatcggccccgccgaaaggtgcagcggcccgtctaatttgttagcgaggcccttcgggacgccaagacccgataccctcaggcccagaaaatgctttacgctattctgatggcttcgaggaagttgcgccattatttccaggcgcatcgggtcacagtggttacgtcttaccccctcggccaaatcttgcataaccgagagggtactggacgagtggtgaaatggacgagagggtacttgcactttgaaccacgccacgcgatcaagagccaggccctcgccgactttgtggcagagtggaccccagctcccgagcccgtctccgtccccgaggccagctcgggccccgagcagctgcctcacaccgcctactgggtgatgcagttcgacggctccctgtctcttcagggcgccggtgcgggggtcacgttgacctcgccgagcggagacgtcctcagatacttggttcgcctcgattttcgggcgaccaataatatggcggagtacgagggactccttgcgggactcagggtggcagctggactggggatccgccgcctcatggtgttaggcgactcccagctggtcgttaaccaggtctgtaaggagtaccggtgctctgacccgcagatggacgcttacgtgcgccaggtgcggcgtatggagcgccatttcgacgggatagagcttcggcacgtgcccagacgggataacgcggtcgccgacgaactctcaaggctcgcttcttcgcgagcccagaccctaccgggcgcctttgaagaaaggcttgcccagccgtcagcgcgacccgaccccctaggggagacggatgcgcctgaacggcccccgaggcccgtcggagtccaggcctcgggacccgaggggagcgctcccagctcccctagatcgattgcttggattgctgagatccaggtgtacctcacagataagactctacctgagaaccgcgaagggagtgaacgcatccagcgcatctccaagcgctacgtgctggtagaagggaccctctatcggcgcgcggctaacggagtcctcctgaaatgcattcctcgggaacaaggtgtcgagcttcttgccgatatccatgaaggtgagtgcggagcccactccgcctcacgcaccttggttggcaaggcctttctccagggtttctattggccgacggccctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcgggtttgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggccttaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggttctcccgtctgagctcaccctgaggtcccctcgggccaccatgtattgcgaggctgatcaagatcagcttcgcagagacgacctcgactacttggaagagcgaaggcggcgcgcggccctccgagccacgcgctaccagcagagcctgcggcgctaccatcagcgccacgtccgggcccgatcactctgcgtcgacgacctcgtcctacgccacgtccaaacgcgtgccggattgagcaagctctcaccaatgtgggagggtccgtatcgagtgatcggtgtcccccggccgggctccattcggctggccacgggcgacggcacagagctgcctaacccatggaacatcgaacaccttcgtcgcttctacccctagtgggggtcgggtgtcacgtctcgggctcgggccaaccccgcaccccccctcgggcgtgcagggttggccgggggctaccacacatgcatattcttatctttttttatcttccgtatttcaataaaagcattttcgatttcctaaggactgtgtctgtgctgttgtttccttttgaagaatcttgacttgaattagctcgcttgtgctcgatcctgccctcggtggcccgggccggttaaaatcgccaaaaggggcccagaaccgagccgtgccctgggacgtggtgaactccgggggggaatcggcaaaggcccacaatcgggccatccataaccctcggtcatcacgctcccggcctggccagtctcgacatgtggatctccccaggcactagccccgacccgcgccgtttgaggctgggacctgggcacgagcccttgttcaagccaagacacagaaggaccgcggcacagaccatccttgtctcatacgcacaacaaatagaattgacacagaaatttcctctttatctaattgcagattaaattagtctatacaggaaaggggcccgaaggcctcggaagaagaagaaaaagctatttaagataggcatgggcctgggggctcattccgacgcgcccgggtcgccggcctcatcgccgctgtcgcccgcaccgccgtcaccgccctcctcgtcggagtcgagggcgaacgcgagccggggggctgtaccctcgaagctgtggacgatgtggtcggcggcgtcccggacctgcgcgcgcgcgtcgtcctcagtcccgggagggaactcgtccagcgccgcccacggggagaagtccggatccctggcctggtagcttgccagtacgagctccactgccccccgggcgaggtccctcgaggatgacttgatcgtctcctcgagctcctcggggagccgctggagagtcccggccatctcagagaggcgctgggcgaggcccccctggttggcggggtacttcgcggtccgcccgcccagaggcccgcctgccgcccagcgcggtctagacgggagtcggcgtcccgaagcatgccgggccctacctcgcctgccaagcggagggcctcgacctccccggcggacgagtccagcgcgccctgtagatcggcgatggtgtgttcggcagctgcgaggcgagcggctaggtcgccgtcgcccgcggtcgccccgccgttgtgcgccctcgcgtccagctccttcgcccgcgcctcgagctcagcggcccgctgatccagtgcggccctctcggcgcgggcgccttccagattacggcgcgcctgctcctcccgcgctgcctcgcagagggacaggctgtccgccagccgttgcgccgcggcctcggcctcctcgagagctcgctcccgctcggtgagcgcgtcctcgcggaggcggagtgcggactcctcttcggcgcaggcggcctcgtgcgccgccaacgttgcctcccggatggcaacggcggcctcgcggtccgccaggtccctctccctcgcgcgggcgtgctcttccagcgccgtggcgcgagcctcaagggcctcttcgcgccgccgggacgctgcctcattctccgccgcccgacgttcccgggtagcggcggcgtcaaggattccccgggcggtgtcgagcttcttctctagctccgccgcccggctcctgtattggaggcggaggtcgtcccgcacctcgtcgagcacagcggtggcgatgagggcagtctcccgctcctcctccacctccctggcgatctccgccaggtccctccgacgggcctcgagctctgaggtatgccggcggtgagccttgcggcccgcctccaccatggcctccactgagcgccgcccctcttcaacgcgcgtccaagccgcgtcgagctccgcccgctccgcctgcaggatctccatctgggcacttagcccgtccagcaccgtgctgttcgcggtggctaaggcctgcagtaggggctccgcgctcagtggggcagtggaaggcaaaggggagagccgcctcggtgtgggtgccgcgcggctcggtccgccgatagacgtgccggactcgggggcggcctcgccccgaggccggctcgtcctgagcgccgcccgaggggtcgggcccgagcggtgcgcccgcggcctcgtcgtgggtggcctcggaagtcgtcgtcgcttcgggcggagtcgggtcgggggctcggtgggccgcctgacgtgcgtgcgccgtctccgcctcccggacggactcctcggcccagcgcggtctggcctcctcccgagtggcttcctcagcctggcgagcccggacagcctcctgggcaccctcctcggattcccggaggcggtccgcggcttctcgccggtcagcttcccgcctccgggtctccgcggtcgccgtctcctcggcctcagaccgaccggacttggaagggcgaagggggcgcgacgggatctcgctgaaacagaagaagaaccagaaggcaaaaagaagcgggtaagtgaaaacttgccttggggatgggagaatgaatacggccgcggtgggcgcgggaacgaacctgcagggaggtcggctaaacgaccaccttgggggagagatgaggtttccccggcatggttccgtctcccccatcttgcggagccgcttcttctttcgccccccctcgggctgcgacatcggcgcggcaccctccgggcgcctgctgctggcgcgcaccgccccgccccctcggggaggagatggggaaggggtaccctcctgcttcctcttcccccgggcgtcggcagggcggctgccccccggacccccgtcgcggggcccagaagcacgaccccctcccggggtagattgttcccccctgcggctcccgcctgcgccttcgtggcctcgaggagcccgctcctccgacgccccgaccgcctgcatgatggacaggatgctggcgcgatctggatcgctgcagagggggaggacaccttggggaataagggatgcctccacggagctgagattcagcacccgttggaccaccatcctcaggtcctcagggacccaatcccatttgtgcccctgatgggtcctcatgtagtcctcggacccggtgtactcccaggcgccccgggcgcgccgctggagcggcgcaatccggcgacgaaggtagtcgccgtacaccatggcccccgtcagcccctgggatcgcagacccgccaggcggtcaagaacggcgtcgtagccgtctcccagatctactggcgcccgccagctggaggcctgcgccgggggctggctcggaagtcggaggcgcacttcatcggcgaggggggtgtagaaccagtcgctcttccaatcgtcccacttcttgcggaggacgcagggaatgtagcggttcagcaccggcccccgcggctggaagtagcagccaccgactaccgacggcggcgacaccggctgtacggtgaagaaccaccggaacagccgaagagatgggcgcaccccgataaacatctcgcacaggtgcgcgaagatggccaacgtcattaccgcgttgggggtgaggtgcgccatctggagatcataaaactccagaacatccatgaagaaagaagagaatggcgggaccagtcctgccattgcgaaagagagaaagaagacggaccgctccgggtagtgtggcgccgggcgtccctcacccagcgcgaccacctcccggccggtggcagattccggcatgaatcggcgcggcagcccggcctgcctctcgctcacaatgcgggaaggcggcagcacgctaccgtcgagcggtgcggagccccgtgccataacaccggcggaggaggagcttgagaacgagtgagtgcggcaagggtagggcacaggaaacgaggagttagggcgtaagcggcgaaggcaagggggataatggcgagaggaaggaagcaaatatcttcctcggcgtctttatacccttgccaacgctatgcccggttcctcgcttcccgcgcccactatctcgccccctcgtttctcgcgcccacacctccactaatcccactcgctcgtttgcggcgcacgaggcggatgtgcggccgtggcagtcgagatgggacatatcgtgcgcgcgttaactacgctcgccgaccaaagcgccatcatcatatctccaggcgaaacgaaccggctcgtcccgattcgcgtgctactcgagtaatgtagcggtcttgaagagaccgctcattatagacagtcggttttccgttgccgatgtgcgcgatttgcgactgctgggttcctgcccgcctgtagagaccggccccacctgtcaccaggcctaaggagtggcgtcacgcccgagcgtttccctcgaggggggcgatcgccctggcataacgccgggggctactgtcggtgacatgggaccgggagtatcatgactagaggcttgggcagccgcggtcacccacgtggcctgaccccctcgggggggtcgggcccgagggtgacatggccaccccttcctctgtctccccgaggggtcgggccgctcccgtttcggccccgagggctggggcgccccgaccccctgtggttttggcgccacgtgtatgggttaggtgagcacggcggggctcacctaaccgcatttattgcgggttggacgagcgcgccacgccgcatttaatgcaacgcagcgcgctcgtttatccggtccgtgaccggtcgcagtgtgtgaccggtcacagaccggtcagattgcgggttaggtggcagcaggcggcctgtcacacgcctcgccccgt

SEQ ID NO: 3334 - DNA, 9355 bp, Oryza sativa
ttggtcaagatagggtgggtccccacccaaaaaaaggggtaggtagaagtgttgcatgtggtatccccttgagatataaaaggaggaccttgcccactgaaaaggggggatcaaaaaaaaaagatcgtagcttggagggggtagagagaagatggtagctgggatcggagagaaagaagatcgtagcttgtagaggagagaaagaagaagagggtttctagagcctggactttctggttctccggctctctataaatccttcacacacagatccaccagaacacaggagtagggtattacgcttctcagcggcccgaacctgtctacatcgcccgtgtctcgtgcatttgctctctcgcgaatattccacagatcgagggtgaagaacctcacttagcgcccccggccgaaccggcaaaggggggcctgcgcggtctcccggtgaggagccctaagctccgtcaactatgattaaaagttactccttcatggattggaaattatttccatttcccattatccaaacaaggcctttaggttaatgatgttgggatcccacattgtttgtttgctcattatctatgcatttcctttcgctgtcaatagtaactagtcagtacttggtctatttggtcttttctcccccttttcaaaactttataaggggaagatgctaatcactcatggttttatttattcatcaaccatatgcttgatgcagtccccataaacatttctaaggtgacttgaatcattcctttcccatgcccttctaacagaaaataaccttctcatacaatattcaactgtttagtttatagtaactgtaacgtgccactgatctaaatggtccagaacccaagcagcacgaggccgcaccacaagggcaggggtaggagaaggggactaggataatagattaatttgcttctttcttcattccttcaaatgactgccgtacctctctttatatagggccggctcctaacatccttatatctaacaatgcctaccaactaactgccgcccataacagtaacacgataacccagactgcaaagtaaacaatatttaagacatttttaagttgacgtggaagataatttacaggctcacacaattatcagatgtatcatctggtgattaagttcctggaaactatcttctgcacagatgttgcgggcaaatctggaagcgggaaaaaaaaaggaaagtttgctatatacacaatgttagataaaattggttattgtttttcatgcatcattacacaggtatgaatcatctgtgcaaaaacaataacgcatgcgtgacatttggccatagaagactatgcacatgttaatcaacagacaacacaatcttgaagtatttttcaagcattgcatcctttgagaagtcagtgaagtaccccttttcaacctcaagtccttgctctgctgctatctgttccacctgctgctgaacctgatcggcactgacatgatctggatccaggaagcatgcaatctctgtgcagtcatcaccatgggaaagggcaagcgcttgcactgtcgggagtcctccaccacgaccagtcacccttcgggtgatccttcttatggttgggatatccttcgatagtaccggcacattatagttcaggggtaaaggtgcagcaccgatcattatggcacctctttcacgagaaacatgatctgggccctcatctggcttcaccggcagaatatcagggagtacctgacccatccattggatgcccatgtaatttggctggaagtagcccagttcacgccgtactgcagtcacaggtttgccagtggggtgtgctgctccatacaagaatactgggactgcatacagggagaatgaatgaatgatcagaagtttttgatactacatctgttatttaagtaaagtagttgaaaatttaacgaaccttgtaagaagttgccaatgtcagaggccacagtcttagccagttgagcagcatcttccattgtggcttgattcaaggggtggaaggacatgtcatcaatgactccaatccttgggtgagttccagtgtgcgtttcaaggtttatggttgaaaacgctttctcaatcatctccaacaatactcgcctcattgggctaaatttcacttcaccagttgagttctcgttgatgatataagacgcaagcgtgtaacggacacggttgtagtggtcatcttcgaacttgctgagcaaaacaacctcagggtctttctggccaatgcgagtgattgcatcaacaaccttggcattctggctttcagaaatgtagagcttgcagcagatcacctttgatttcaacatgctgagctttgcctttgccttttgcaagaggtggacaagaaggtgaggatggaatatttgcaaggtttcgttactgtacagttcaaatccaagtggagtataggcatccaatgcctacttgcataattgatcggtaatctgaccagaaactggctggttttacctgatttctttcagagcttcgaaaaaacagtaagtcatggcttttctcacatatttataaaaattatattgtgtttaaaaagcataatcctttgttggatcaacaggtattgaaaaaatgttgtttgcttatagcccctgcactggattgtttttacttagatgtatttcgtgttaccaacgttactcagaccagatatcaagaaagaaaatgtcatgaatgtctcagaagattttctttttttaactgaactatgaggttgatatagattgaaatatgggattttccacattgattgttctagcatttatccaagaagatagattttatcatcagggagtcaggactgtggagattaggttctggaaacataccttgtctgtgtgcttttgctcctccatgccttcttcagctctccctctccttccctccctcttcctctgtgtgcgtctgcggagtggtggagtggacctatgccttctctctctctctctctctctctctctctctctctctctctctctctggttctatgtgtgcagctgacccagctgttcctctgagaagcggtggagctatgccttcttatagaggtaagcgtcatgacaattacttgaaagaaagccttttgtccttttatttcttgttttcctctgagtaaataagtgccaaaccatgaaaaaagaaatgcagcatgtgctcatcagctttatgactcatcagtcccctgcatcttgtcccaggcggcaacttaaaagagttaaggtcagttccacttcagcatccccaccactccaaaccattactttgaagcacatggtaatatcttatttgcctcttaaaccgtgtcatccattaaatcccttggttcatcatccattaatctttgtattcttgtctcttgctctctggctcaaacctccctctttttttcattattcatgaaatcttgtctgttaccatctagtggccagtacaatgtcattgtccgcattgcagcacacagttttggtgaaaaccaaaataaatatctagaagagaggataattggtccgtgcatctcagatcatttcgattttgctgcatatgaaaatatcttgtggaatcaggctgcgacgcccagcttttgtacactagtctagcaatcaattcccatacagtgacatgtaagtgaaactagttggatcagtgtgtacatccatgcccatcctgcattctactcagattggaaggatagtgactcagagcaacccacaccccccctattattgcttgccaacattactaatagttgaattgttttcctctttcaggtcatggatgcatcttgcttgtcatcttatcaaaaagatcataatctggaaggctctgaactgaagtagttagttacaaaggtacgttacttagcctagactagctgtgtgcatcacaaaagcgtgaaggtgaagatgagtcgatgagatggaagttgtgattaacgaaagcaaaccacttgcacgaggctctgattgaaaatctgatctgtattaggcggtgcagtgacatgcatacgctactaatccgtttcgctccctttgtggataggactgacattgcagctagtggctgtgcgcgcgtacgtggggatcacgtgcatttgcattataaaaggcattgagatctggcacggaaggagcggtcgttttccacgttgccgcgtgctacactgattggagctcgtgattaatctgagacttgatacgattgtctggattaatgggtttacgttacttgaactggattattctatagtctatatgcaacgagagaggtggtttgtgtgttcactcaaattaatgagtcagctcatgtgaacttgcttttcacattaacaagcgacccgacgttgagaactgcgttttatttcacatcagtgtgctaagctgttattgttcatcatcttggcaatttgccattgacttgtttggttggttgcttaataggggcctaagcagaactttattccacttcccatcaaactattcggattgccattgatggaaaaactagtcactgcaactaaatatggagtagttatctattccttctgtttctttttaacttttttcttcattaaacttttttttaattttaatcaaacttgtagataaatttagtaccatgtataacaacaaaattagtagaactaacttttattaaaactaacttttaatatatttgattatgtctttgttttgtgttaaaaatgttgctatatattttataagcttaattaaacttcaaaaaattaattaggaaaaagttaaataatatataatatgaaagtagggagtacgtataaaataccctcaagtgagtccttaccgtatgtactgtagaaacactatatagcattaatctgtaagtgtggcgttgatcaagggtatcttcgttcctgccgcacctcaacatgagtagggcgcacgaaaaacggagcaatttattagcgcataattaattaagtattagcttttaaataaaaatagattaatatgattttttaaagtaactttcgtatacaaactgttttaaaaaaacacactatttaacggtttgaaaaacgtgcgagtggaaaacgagaggggagacttggaaccggctggaacaaacacagccatagcacaaagttatcctctattcctcgagatttacaccgtgtttagataaagtttttcttcaaacttccaacttttccatcacatcaaaattttccaatacacataaacttcaaacttttccatcacatcattccaatttcaaccaaacttccaatttcggcataaactaaacacagcccaaagtaggtcctctatttaaaactaacaaattgatcttgtatacacgtggctcgtcttaatgtacgcgcagaagtggcaactaagtgccaatattgaattttgagggtccaggactggaaccgtgtttaacaatatcagaatatccaaagcatgatcgatatggagtactgtattatactacatctttggctaatagtagtgaggcgtaccgcgtatgtatgtcccgtttttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccggggccgatccccagctgacgtggcagctacctcagcgccagccggactggcgctgaggtgggacttggccgcaaccccaaggcccagaccagcaagccttctggatggcttgcgggctgggacctcagcgccagccataatggcgctgacggtgggaaactcagcgccagccaacctggcgctgaggtggcacttggccgtttcggccgtggcccagcccagcaagccgtctggatggcttgcgggctaggacctcagcgccatccataatggcgctgaccgtgggacactcggtgggacttggccgtttcggccgtggcccagcccagcaagccttctggatggcttgcgggctgggacctcagcgccagccaaaatggcgctgaccgtgggacactcagcgccagcccacctggcgctgaggtgggacttggccgtttcggccgtggcccagcccagcaagccttctggatggcttgcgggctaggacctcagcgccagccataatggcgctgaccgtgggacactcagcgccagcccacctggcgctgaggtaggacttggccgtttcggccgtggcccagcccagcaagccttctggatggctgggctgggacctaagcgccaggtgcactggcgctgagtttggacatgtcagcgccattctgcatggcgctgacgtcccagccctgctaaactttagcaaaactttgcacacaacacaggcaaacatcaaatgacagaaatttacaggcagtaatatatccagagaaccatacaaaatatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtatgtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgtagcaacaaaaataaaacacattgaagcacagttagtactatatagtaagaaaccatcttcatctgtcatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaacagcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgcagggtgtctatcagaaattatacacacttctctattaggaccgatcaacttgtttctcaacatgttgatgaaccactcccagttgtatgtattctccttctctaccagagcaaaagccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcatggacttctcgggatgagcctcaacacggaaatgcatggtagggttctttgctttgatggcacgcatcagtgtaggcaaccgaacatacgcctcgtcccaatctccccaaatgac

SEQ ID NO: 3335 - DNA, 582 bp, Oryza sativa
gttacttattgaatgatcaaaagaacaaaaagttttagtacaagaaagtagaagcataagcatctcttacaatcaccaagttacttattgaatgtcgttttgcccgcgcggtttggtctttaatccagtttgcttcgaatattagtttacctaatagtacaactcatatgtttgggcattggataagaagacaaccacacaatttgagatctttggtcttattaggggcaactaccactatttggtctatttggctttgcagaaatgatgtggtttttgaaaggaaaaacatatcttcccctttgcaggttatcttttttattacacattggctctgctcatgggctatccttcagaaggtcaatttgcggggtactatcattgcggcttgtcaacacttggagctagtggccatggagttttctaccccggcgcatgggtggcgttctaggctacggttagagggctcctgaagttctttttgtccctgctattttggatgatgagtttatcttttgtttctttcttgttggctgtgtgcactctttgggtgcagaagccagaggtgctctcagaataatt

SEQ ID NO: 3336 - DNA, 2468 bp, Oryza sativa
cacgagcgcctgcaccattattctggtgcaacaaagggaaatctcctgttcttattgaaccagcatacagagagaaatgcatgaatgagttttctcctgttttctctcctataaggcctgcgattgttcgccgtcaagtgtactttcctgacaggcgtttgatccagtttgactgtggaaagttgcaggaacttgctattttgttgaggcgtttgaagtcagaaggacacagggccttgatatttactcagatgactaagatgcttgatatactggaggagttcattaatctatatgggtatacgtatttgcggttagatggatcaacccagccagaagagaggcagacactgatgcagaggtttaatactaacccaaagttttttctttttatcttatccactcgtagtggtggtgtgggaatcaacctagtaggtgcagacactgtcattttctatgatagtgactggaatcctgcaatggaccaacaggcccaagacagatgccacaggataggtcaaactcgtgaagttcacatctatagactgatcagtgagagcactatagaggagaatatactcaagaaagccaatccagaagcgagctcttgatgatctagtgatacaacgcggtagctacaatacagagttcttcaagaagcttgatcctatggaattcttttctgggcactcatcacttcatgcagagaatcacagaaggattgctctctgtctgctggaccctcaaacggaactaatctggcgctgtcaaatgttgatgttgaagcagctattagacaggcagaagatgaagctgactatatggctctcaagaggctggagcaggaagaggccgtggacaatcaagagttcagcgaggaggctgctggaagacttgaggaggatgatcttgtaaacgaggatgacactaaacctgatgaacacaccaatgaagagcataaatatcagtgttctgatttggtcaaggacaagcatgttgctttatctataaatcaattgatgaagaaaaggctataactttggctggaggagatggagatattgacatgcttgctgatgttaagcagatggctgctgcagctgctgcagcaggtcaagcaagttcgtcttttgaaaatcagctccggccattgatagatatgccatgcggtttttggaactctgggatccaataattgataaagctgctataaactatcaggtcaatgttgaagagcaagaatgggaacttgaacgcattgaaagactcaaagaagatttagaagcagaaattgatgaagaccaggaaccactttcttatgagtgtaagtgtttttatgtttatgttgacccaacagcccatagcacttacgaaaaaagtttcatctcatatttgatttatgcaacttagttttaggtagttgtctctgctatactcacccttccttgtattatgctttgttgtgttgacacatcatcttaactgcagcatgggatgttgattttgctactacagcatatcggcaacatgttgaggctctagctcaaaaacaggtcagttcatacttctattcttgtgttttcctcttggggctagtggctaattatgtcacctgatgtgatacccacagttgtttgaggaacaagaaagacaagcccgtgaagcagcaaaagagttggaggaaaagaatgataataggtatagactgagaaattgtgctctcactttggtgttcattgtttttggctcttaggccctgttcgatagtggggataacctgagcttattagctccacgcaaaatgatgcagatgattagggtatgattaattgagtattaactaccataaacttaaaaatagatttatttgttttttaagaaactttgatatagaaagtttttgcaaaaacacaccgtttagcagttcgggaagcgtgctcatgataaacgagggagtagctccccctagaagcacattagaatggggccttagtgggtagatgcatatactccctctgcttttttattatctaacagcgggcactattcattttcacactgtgatcactcatcttttttcaataattttacaaatgaaaagatgtcatgttattaaagtgtactgtatcgtaagcataaacaagaaagttcaattcaccattaattctttaatcctaaacttcaacaagaaactttaatcctaaactattaatcattttaataattttgaccattaatagttcctcgcaaaaaaaaaaaggtcaaagtagaaacagtagtagtcaatgttgacagtcatgaaaacagagggagcttttgtgctgttttgcacttcactttggtgctcatctgtagggttacatggtatgcctgcattttctttccaattggttttagatgtgtccatatgctttcatctatttactgtatcctaaaagaataacttttgtcaatctttgacagcactc

SEQ ID NO: 3337 - DNA, 1884 bp, Oryza sativa
tccatgacaagcttcagaccaaactttaatctagtaaggacagccctcgcagatgctcaggttcaatgtccaagaatggtagttccaacaagcaatcatgagtcccgccgtaactttttggaattggaattggatttcttgacagatcgagatgattatgaggcggactttccatctgttgttaacgtgtccatactagaaccggaaccattaaaacatgctgtggagccagtggagcactcactactgtccacactttcttatagacatgctgagaacagattcaggtaattgttgacacagatattttgtgtatttattggagctagtggttattagcaccggaaaaatcctcttcatgatgatacagttctgctttgcattttttatttatttatttttgcttctgatcttcctaacgtgtcattgcattcatttacacaggatggtatcagaaacttgttttgaaggggaaggttctcactgggcctcatctgctttccacacatacgatgccggtcggcataaatctggtcctaagtccataggaaagcacaaagcatcatcagaatctggaaggcctcccaaatccaaaattcaaaggaccactgaaccacaggaagtgccggttacaaataattttcataggattccggggcaacttctgcataactcagcagagttccacattacccagtccctatctgaccttggcatcagtgattctgaattcacctactttgataatcttcctcaagaggctgaaacagagtttgttccgtaccagtatgactctgatgtcctttctggcattgaggagttggatcctcttacagatttcacagacatcggatgagaacaaatgaacatattgctctggatgtcatgccctttcttttaaagaggacattagattgtcaacggtaggagcccaaggatacacagattgagtcgctcgccacacagaattgatgcaagcttgatggcgattggtgggagcgaagctatttgcttgatgtggtcacaatgaccttacaagcttggagggttggttagcactaatggaggcattgggtactttctatacatgtatgtatattggtagcgtaggctctttaatgtagaattgtattccctcatttatgttgagggaagactttgtaacttggaaattttgtttagcagatgccaacagagaagggaaaagaggaaggccctcggcaccacccaaatcattatttctcgtgtgttgctcattggcccgttcaatccagcctttttggctaccagttgcctgtttggcactgaatttttttcagatgtttaccttcgtggtggttgtccccacttggtcatcaaaatcaggagtttagaaatgacattcgcggttaaatccctcgtgaaattcgatattctaatttcactggaggaaaaattattttgtttgtgtaatcctgaagtcttgactccatggtatccaagagaggtaagaccacatataggtacatctgtacatgcatgctacgcgctgtataaaatgttttggtgagtcgtgttatggattttgtgcatcggtgttcttttgtattgtgggcaactgggtggggtgaactggagtgtatcagtaagagcgagtacaataacgggctacaagttagctgtaagcacgcacatgtggagtaagaacgagtacaataacaggctacaagtcacctgtaagcacatgtggagaaaagagagagaagaagtaaagcgagctacagatttctagaagagagaagaaaagagagaagaaaagcgaagaagaccgggctacagagctatagatttatagccaattgaggagagaagaacagcagatttatagccagctggaggagagaa

SEQ ID NO: 3338 - DNA, 6583 bp, Oryza sativa
  unsure (1)..(6583): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctccttccaatggaggcgggagcccttgccctgcatattggattttatagtccaacagtcgggaacctacatgtacatagatagggatgcaatagagaccccctggatctttcacagctaacactaagtagggtttactattttggttcgtaaatttctatcggggggatcaggaatttcggaatggaatgattcaacatttgatcaaattccaaatttgaataaatttgctaagttcacaaaaataaataaattttaatgttttttgaactttttctatccggtggaaatagtttcatgccatggcccatgggttgccctagaaaccgtgttggaggccatgcagaggatgtccacatagactggtcggggagggtttacaagtttaggatggaggcggttaattaaggaggctaacggttagaatgagaagatgagagtgcctgtcaccgaagtaagtgtggataagtgactttctgaaggtgagtggctaggagcacgattgactagactatcagatgaaattagagaaaatacatatatcaatagagaatgagtaattttgaccatttacgtggtttaaaaaaaccatttgtagtgagttacgttgacaaattgatatgtaagttaaaagatagttgcagggcttacaatcacggcttaattattattttataagagcataaagatttatgttcttgagctcttaattatagttttgtatgtgattcattaatgacaattgtattgtgcttcaggaattgaagaaatgcgtcatccaatcattaatttaaaggttgtattttctagtgtgcagataatcacttagatgacaaaatagaaattatatatgtatctagcttgttaactcttgttgcttttattcagggttatctagtcggcaatcctagtgcaggagataagattgatgtgaactctagggttccatactctcattcatttggagtgatatctgaccaattgtatgaggtaatcttatatttttttactgaagtgtagcccactaaaatcctaacgatgtaatgtcagtgaagatacttattcttttccccttctatttatcaaaaggctgccctggcaaattgtaaaggggattatgaaaacccaacgaacaaaccatgcactgacgtaatgcagaccattaacaatgtaagctttgacatctatatatatctatatatatattgcccttattgtctgaacttaccgtctagctagctttgtcatctatatatataccttctccacagctcatgtcagaagtattggaaccagcatgtccctttgactggccatggccaatgccaggaagagatgcttccaataggaagtctctaaccgaggagcactattggttaggtgacccacctgttgaacctcctttcagttgttttgctgtaagtcactatttattgtgttttggatttttaatttcttgcaaatgtaattcgaatgaggagaaagcacctacatttccattgagttttctttacaaacgattgccaaattttgcttttaggcataccgatactacctgtcttacttctgggcaaacgacaatgccaccagagctgctctcgggataaaggaggtaaacttccttatctcttggtcgtgagccttttactattctctctttgtcaaaaattactaactttgactagcaatttttaaaaatttatatagtttaacaacataatactatgtttccagattcaccatgagaaatgttttcagaatatatagttcatatgttgctaaactattattgattttttataaattgatagtcaaaattagaaatgtttaacttagaacaaaattaaagcgataaataatttaaaacggaggggctaattaatctacaagtcaataataaatcaccttccaaatagggaacggtgacggaatggataaggtgccctacgggtcttccttacacacgtgatcttccaagcagcatagaatgccatttcaacgtcaccaccaggggttaccgtgctcttgtgtacaggttcaattagcataatcaatattttcagcaggctcatttcttatttacatattgttttgaatcttcctgatcgcttacgcttaatgctctgtaaaaaaaaaaaaacttatgtgggtgcagcggagaccacgaccctattgtgccattctcaggcacgcaggcatggataagatcattaaacttttccattgttgatgattggagagcatggcaccttgatggccaggctgcagggttaagtgattttcctatcgtcttgcatccccatctggtcttatctctgaaaacaatcgattgcatcatcatttattagtcactttcatttttaatatgaacgaaattagacataaaattgacactatgtttaacaaaatatgaagatgaaaaaagagaatgggaaaaaaatagtacttcttacaattggtagcttagtttgctaaaatttcttcttgacctgattagaggtgaatgttgttttcttacaccagattcacaatcaagtatgctaacaacctgacctttgcgacaataaaggtttgtctcgttctctaccccttcgttgggtccattcaccatttttgttcatacattaaatggagaattagatgtcactggtattcatgcctaacacaagactatttggttgttttcctatggatgtagggtggttgccatattcctcccgaaaatcggcccaaggaatccttcattatggcaaaacggtggctggctggtggacccctctaatgtgccgtcgcgcacaatacggcatctctgaattcagattccgatcatcatcaacatatgtaatgtgctcattatattgagtaaatcaatataactagctggatggcccgtgcaattgcgcggctagcacccaaacaaaattatatattttttatatgattttacttaaaatttattagatagctatcttattatcttaagactttgaaagaccaacccttatcatctcgtgtttctaattatatagtttttaaaagtcacaccagttgctaccccttatgtcatctccttctttatttgcttgcttgatctaccactatttctttttattcttcttgaaacctttaaaaattggattttatagtttttagagtttagtgtcatgttgggtttcatttttataatttctagatgtcttgtcaaacgttgtcattatactcctctacggcccgtctaatgtctcttctctttattgtcattgagattttaaaaatcgaacataattattgtctgggttcaattttactttcaagaagtctcgccaaaatgtctatggctttgccattgtactcctctatagctcgcccgcagcattccttctttattgtcattgagattttaaaatcgaacatgattattagtgttttttttttactttttagaagtttcgaacctttaaaaattggacttgtagttccattttttatattttttagaagtcccatcaaacgatgccactatgcccctctatagcccgtccgccgtctattctttattgtcattatgattctaaaaatcgaacataaatatcgttggaattcattttttattttctagaagtcccgtcagccgtcggcggctctgcaagtatactcttatgcaccccgcccgctgcttctcctttttattgtcattgagatttaaaaatcgaatatgattatcaatggggtttgttttttttttctttctagacgtcccggcaaccgccttactcgtttgcttcacggcctgcttgacgtccctccttttaatcgtcattaggattctatttggtgttttattaacaatttttatatgtcgtatcaaccgccaccactctactcttttataggcatgttatttaatttatctcgttatgtgttttagatggttttttatttcaataatctttatttttatcaaaaaatttagttatttataaattgtattactaattgaaatcttttttttctttttctaatttcagatttttttaaaaaaaatagttattaccgtattgtgttcttttaatgtttttattttttattttcaatttcagttgtttcaaaattgtattcctacttgaactctcttttaaattttctaattttggatattattttattttttattctaaattttaattaatctcgtattgggtttttatatggattcttctttcaatattgcttatttttaatttcgaatttcagctaattttaaattgtatttctacttgaactcttcttttattttcttttgctaatttcggatttatttatttttattccaaatttttattaatctcatattgagctcttatatgcactcttcttttaatattccttattaatctcatattttttattaatctcatactgtgtctatatgaattattcttctaatatttcttatttttttattcctaatttcagttgttcgtaaaatgtatttttacttgaactcttatatttgatttttctagtttctaaatctattttattttttattacggatttcaattaatctttaattgtgttctacatgaactcttctttcattttttattgtgttattatttcaaaatcaaataaaaatccgtgcacatgccatcatgcttttctggttgctgacgtgtgcatcacccaaatacggctcactgtgcagccgcacggcttgacccgctgcttcggatttccgtcgctcgccgctagcatctatcttcatatcaacaaaaacgcatccaaattacggttctacagtggttcgttgcccgctgctttatttatatatgtgtattatagcctaattcatctctaactctagttaattggtttaggaaatcggacaaaactcttttgagtctgtttgcatgtaaaggccctagctagagattgattctaattctacacgcgtacggtactccgtatctcttaattaacatgccaagtttgtcttaaatcttactttatatgtaaatttgcttggatcttgcgaggcacgggctgcagcaagcatacaaagaattgtactttaatcatacaaagaagaaacaactcccacggttagtttagcataggatgagctagatgttaatagataagaaagaaagttttatgaaccaaagtgccacgtagtaaaattaacaagtcaaaagtgaaaagtcaggataaagggtggtccaaaactgataaaaggtcacatgttgcactagggaaaaattaggcctaaactgtaatttactcaataatcattaatcgaggtggcacaataacgatgtcacgtgtttattcttcgctagattagagattgagttataggtaaaacaaaatgcatcttaaatcaaaatcacaataacgatatcacgtgtttattcttcgctagatatattagagaatgagttctaggtaaaacaaaatgcatcttaaatcaaattcactattagtcggtcaaatgttaacaccataatcacatttgtcccttgcagaaaggatgattttttttgttagtgctatccacctattaaaaagctccattaggagttagctagacaataatttgcaacttatcgtgttgacaacttgacatgcatacctttcatgtactggcctctttagcacaagatacaacaacctaaccgaaccagcatctagcgactagcgtcggggaaagaaggatcagatcagttgtttcagcttaatttagacgctaagaagagaaacctaacacatttgatggcggttagttgcatgcaggcacatggcttcattcatgggtcataaatgtaatcaagcattcaagcctatatatagttgtgtggcaagaatatatgggctgccgcggttgaaggaatagaaggccgaagagttggatctgcaatctgcaggccgcatgaaagtgggaagggaaaaagtacaccaaaggttcctcaactttgtcatcgagttacaaaatcatcctctaaccgcaaaatcggatatccggcgtcccttaactaatcaaaaccagtcacaatagctccttcgatggttttgaccccggttttattctacgtggcggctgagtcagcgtggacccacgtggtcatctctttttttcccttttcttctcttttctcttttattttcttcacttctcttgtcttcttcagcgcgtaagcgacggggccaagacgggcgcgcgggcgaagcgtgctgagatgcgc

SEQ ID NO: 3339 - DNA, 6827 bp, Oryza sativa
ccgccgcacgctcgctcgacagggcggcgatggctttatggagacgtgacggcagcaggacggaatgtgagggaggccccgagcgagacggtgttcacggactccgtcgacgggagcagctccagctctgacgccgcatccaccgacgagtggccggtgacgatgtcgccgcccaggcgcccatgaagacggtaggcagcgccgctgcgggttcatcagccactgcgtccttctgcaactggcgtccctagaaacgacgctggcgaggctcgaccgacaatcgatccaagcgagaatatcttgagctgaaggaatggccacccgaaccgtccacgtgggaatggctccggaacggtggggacgtagagcgtgagctcctcggtgaggttggacaggctagtcatctcgttgacggcgtcgccggatttcctcgggtagctcagcagcgaattggcaatgacagtgccgtagttgaaccgcttcgctggaggaactcgccgaccagctagaccttggtgtagcggacgccaagctcagctgctcaccgccggagacgccgaaccagctccacaactcgatggggtgcaccgtccattggaatgtcagcggcggaaagcggcgctgccgccatcgccgtggggtgatctggcccatcatgatgctgccgtggtgccggagaaggtggtatgtgttaaataaatgaacttatgtcagttgggatttgatcttgccttgatcttatactcttatttactttctgttagtttgttagctattttccctcctcccatggttttctgctcgctctgttttgagtcagcgtgaccgcgatttgttcggtcaagtagtggagcttgacgagcgggagagtatcgagctgagaaaatgaacagcaccatgaactagcgtcggtgagcaccacctcccttctgctcgagctcggttgagggctgggagcttgaccttcgtgcccaccgcccaccgccggccgccgtcgcgccgccgtcctcctcctctcccgcctcgccctgtcgatgcccgcgtcgttcgcgccttccagccgcccgcgacgcctgcacacgcctgcgcctccctgtcgacgcccgcgcaaggtcgctgcacgcccgcgtcgtggagctccgccgggctgccgtcgggcatccccactgtggccgccgccggcggccgccatcgcggcgccgcgctcctccttttccccctcgctccgccaaccgacctacaggtgcagagagagaggaggaaccgaggaagagaagaaggggaagatagatgactcagcctgacatggctgaatcagccgccacgtaggataaaaccggtgtcaaaaccaccaaaggacctattgtggccggtttttattagttaagggacgctagatatctggttttatggttggaggacgattttgtaactccatgacaagttgggggaccttcggtgtactttttccaagtgggaagtggctctgggcttttggatttgtctatgtatgcagccattgggctctactatgcttatacgagtgcgatgaggcctgatgtgcttactctaagaataagttcactttgactaccttaactagtcactgtgtcgaccccaactattaaaatcgatgttatttgactccctcgatgattttgaaaggccgtttcgctatcgtggcaactacgtggtggtgtagacattgtctttgtcctacgtggcgttgacgtggtgcttatgtggtattagaatgaaaaaaatatatgggacccatttatcgctcacaacaaggaatattgcgggagccgggagacactaacatgtgagacccacacatcatcctccctttctccttaccttcttcctctctctctctctctctcatcgtctcctctatgaggttgttgcttggataggcggcagcagcatcggcatcgccatagaggtggtgtctcttcggcgctggctcgtgcccacctgccgccaccgcacaagaacgcacggttcccggaccccgtcgctggtagagtcgaccacagaagggggaacaccaccatggcgcacagacggtgcagtgcaggaggcagcaaccaggaagggagtaagagcatgccacttgtcgtcgtcgccacgggcgtcgcgctgtccgacgcggtgttggtgctccttcgttgtcctcatggtgttcctggcgtgcgggaggttccagaggagggccatgccgggtgcttaccaaagcggcacaacacaaggttagcttcgatcctggcccggacctgttctacctggacgtcgttaagccgtacgtcgaggccgaccatggcgacgacgagcggtgttgtaaagacgttgccagagttggtcgggctgaggaaagagcccaggtgggaggataagacaacggagttgctatgtccgacaatggcaccaagccgtcgactttgttccattcctcgtgctacttccactcgtcgcacttctcataccccgagctccgggacatgaaggcagcggggagcaatggcatgtcaccatcgccatccggtcggtcaagatgtcggagcttcgccgctgctccagctctccctgcaaaaggcgaaaggggagagaaatagaaagagagagaagggagagagagagggaggaggaagaagggaaggagaaagagaggatgacgtgtgggtcccacaatatttcttttgtgaatgacaaatgggtctcacatattttttttaattctaatactccattcgttcaaaaatataacaatttttagcattcaaagtttgtccaaaagtatataactttttcacctacattcattctcaaccaatcataacctttcaccattcaaattcttcacatactttctcttctcaactaatcacaaccctcttccatttaatcaaacctacttttttaatgctcgtgcccaagcctaaaacttcttatattttaggacggaggtagtatcacataagcgtcacgtcaacgtcacgtaagatgaagaccaagtcaatgccgctacgtagtcaccacgtcaaggaaaccaccctccaaccgccgacagagtcaaattgcaccggttttaatagttaggacttaggagggtcaacatatctgatattgtggtttaaggatacgaatcagattatgccactaggtaagggaatcaaagtgaacttatttccttactctactatgcatgtgggccgtcaggtagccacggttcaagcgagaatgttgttcggcgatcgatcgccctggggatggggcagcgatcgatcccctcccccctccctccctccacccctccacctggtttccttttttggcaccgcattacttttctattttagtaaatttatacacctaaagtttatacacctcaagtttacacatataaagtttagagaccaaaagtttataagtcaaaagtttatatatccgattcaaatttgaatttgaattcaaatatttttttatatatagtatttctatacatctaaagtttatacacctaaagtttatagacctaaagtttataagtcaaaagtttatatacccgttcaaatttgaatttgaattatatctgattcaaatttaaatttgaattcaaatattttctatatatagtatttctatacatctaaagtttatacacctaaagtttatagatccaaaatttataagtcaaaagtttacatacccgattcaaatttgaatttgaattatatccgattcaaatttgaatttgaattcaaatattttctatatatagtatttctatacatctaaagtttatacacctaaagtttatagacccaaagtttataagttaaaagtttacatacccgattcaaatttgaatttgaattcaaatttttttatatagtatttctatatataaatttttctaacttttgtttttttaaaaaaattgtgtggtgcactgcagtggaaagagaagaaggggaggaggaagggaacaagagggaggagtatagggggaggggggaaaccgatcactgggcaatcgccctggcgatcgatcgcccattagcctcccccggttcaagtggcctccatgagtttttttttatgaaatctgcttcacaaggaaattagtaaaatactatactcctgcgttaaatatgattcaaatctataatttcatgtttgctgtaaatgagtactaagtctgattttccaataatgctatatgggttttctccccctgaacttataaatgtcactcttgcacgatgcgtggggagcaggcaggagagcacgtaggcacgtactagagcgaagggtcgcacgaggggatgttctgtttcacgtgcggacgtttgcacgcggcacaaacacatttgtgattattcacaatgtacacccatttaaaggaggtggcaatttattgaggaaagaattggaatatagccggaagtacattaaagagtcgattttcatgatcaatcgcattgaatttagaatttattacattgatcagtttccttttgaaggtcctttctcttctataaatctcagtgtacctggaggagccaaaccacaaaaaagcatcattagcttctccccggcctgagaattcccgatgcatcccatcatcgctacactcctcctcgccgccgcaatagcccccggtctcacggtgggttccccatctctcatcaacgagacatgcaccgcaacttccaactatggctactgcttgggcgtgctctcggctgatccggcaggcgcctccgccacggacaagcgtggcctcgccatcgccgcggccaacatcacgatgcgcaacgtgacgtccacggtacgcgtcctcaccgagctggtagaggagctcaagctctgcatcaagtactaccaggacatggacgatctcgtggccagcgccatcgacgacctgcgtgtcgggcgccccgccgttacctcgttctacaaactgcaccgggcctcggacgagcccggcaactgtgatataatgttgtttgagggaagcgcccacaagaacccggtgagctcggagaacatgtacaacgaggccatttcaaagttaaccagcgacatcgtgtaccagttggtacattaatacaattagcctaagttgcatggataggtccacctccccctcctcctccttaatcttactctacccatgtattgtattgggaggctgtgggtagcatcatgccatttccaggcatcagctaatacagtttgctggcaaggctgcgtctgattgtttctatgaattctgttgctattgttgtgcttaacaaaatgttaaatgcccatagtccatatttgggggtgggtgggttctgatgcgcgactgttcggagccccaaaaagatactgctgagaatttgagagacctcggccactccagcttttgcgaatctccgctacagtcgcctcgttcattctccgacccctcttcctcctctccggtggatcaccaccaacgatggatgaaaggggggtcggatgtctcttctcatctagtagtgtaagtagtagtcttgctttctcgtttggtcaggtcatcgtgttagttcgagttcttctcgttatcatccatcttttactgctcaaggtgtccgtcggcttcgacgctcctcgtcttggtggtgtggtgagcatcaccggttttttagccagtgattggtcacctctttgccgggtttcttctcccagccgttggatgagatacttttagatctgggaaaaaaaggttgcgccaacctttctcgatttctccgacgagttctatacaaaggaggtggtcttcttcttgacctccagtgaagatcaattacacggctgaaggtttcaagttttgctgagatggtctcaacctcccatgcgtggaggccctaatcggggatgcccctcagtttcttttgcagttagtggtgttactcttgctatccttgccggtggtatggatggggctggcttctttggattatctgctttggcgtcgacccctatcaaaacttctggtgggtttcttattcggcgtagctttttagataatggaatataatatctcggcctttgctcaaaaagagctacagccaattattacaaaattccactccagaagagagtgtagttcaagacaagttgaacacaccaaacaggaaaagagaggacacaaactaagaaaagcaaaacaaaaagtggagctagaaggcctcgtcaaagcctaggactgaagttcgaagccaatgcatagaccattgacaatccttgcacgaagaggtttctccaaagcggtgcccccaaggaggacgcgacgtggatcgccgccaccgctcgttcggaaggaagcaaggttttcacccggagaatatggttagaaaaggagaggggtaatctaaaatgacgcctccaaggaggggaacgatgccaaacggcgtcgccgtcgtcagccggccaaacggctcggcaaggctttcgcccgcgattccctgtccaaacccacaccactaatccgcacaagaaggatcttcatcgatcaacaacattgtccctttagaaattcggccaaggccaccgcccacagttcttgacagcgcgcccgcacccggactcctccttccccgtctccacatgccgctgccgacgatgacgcaccgtcagcctcggatgatggccttgcaccaccgtcgacagccgccactgccagcgccacagccaccaccgtcgccagccgccatcgccagccaccatcgccaccgccaccaccaccgccaccgtcacccccgtccagccgccaccatcagccaccaccg

SEQ ID NO: 3340 - DNA, 7271 bp, Oryza sativa
cggcaaggttcttgacgagggccggcgtcgcggcacgcgccgtagtccgccgccttcgtcgccaacttcgtcgccgctacatccgccaccatcgccgccgccagccacccccctgccaggtccgtggagcggcgccggcatcgaccgagcccgtcgccggtcgcctcggccaagcggggcgaccggatctggcgcctgcccgtcgccggagccgcggacctctaccccaccaccttcgcatgggcgtctcccgcggcgctgccgcggccgccgcctccgtgcactctgccgcctccgcgtggcccacgcgccacaccgccgccgacccgcgcgtcccaacccagatctggccaaggggccggatccaaaccgaacggcgccggatttggctgtcgttgccaggaccacgctctcgctctttggtgtcgtcggcgccccaaccggctgaccgggagtgagggagaagggagccccgccgccgccatcttcgcagtcgcccggctttgccggcggctgctcaggcggcggcaaggtgggggagaggaggagagtgaggaggcgacggcgaggtttcgccgcccgcgtcgcccttcggcgtagctgaagttgttatttgtttgccatctcctcaacctccatctatcatctatgagaggccccgttaaggattgtgcggtggcgtcatcttgtggagctcacttggagctcacttggatccaacctccgccgatgttaggattcaaagtttcgtcgtcgacgttgaagacagaggcagttcgagcaggactcaattgttttttttttcttttcttcttaagtcctttactacaaaatgttgagctaaagtgtaatctgcccattgttaaggggctcctttgcaaaactggatgggacggaaggagtatattgttcttctgaacttctttaaataaataaatacattgtttttcaaagagaaagaaagaaagatgcacgactgttcagcagctgtggacgagacaaggaaatccaaagctgggctgccccttgaaattctggcccacgtgtaaatgaggaagggaccgaacggaaaaccaattctctcctcaaggcccggaaggcccaacctgcaccgtcaatttttgaagaagtgctagcaaagggcgcgcgctcgggaggaagaagtgcaccatggattgatccgtggtctttcagattggaatcggactcccattgccgtctactactaacaaacactttgttctgaaaacacggcaggagagatgaggttatgggtggtatggatcacaccaacgtgatgacaaagagtgtacgttgtagtgaaccaagacaacacgtgccatgggcgcgcacgagcccttgtgatgcgattatggattatgtgggattgccactcgcccactcgccttctcctgttatgcttcttcgtgctgatttagtaagacgagatgcaggacggctgatggacatgatcaagcaagttccacgtataggttatattttagtatacgccaccggcttctcctacttcttcagttaatttagtaagatttgacgccacaggctgaagatatgcatcatcaagtaattgggaagaagatgcagacctgaacatgctatatatatatatggtcatgggcggtgaacaatttttattttcgagggaattggccggtgaacaacctaatgtgatcttacttcttaagtatatgcaatactatcttactttcacggcttgatttctcatatcgggctacgggatcgaacaaaaatgaagcaatggctgtttagcatgcctgcaagttaacgttgttttttttttcatccaatatttcacttataaaaacctcccacgcataacaccaacaacaccatctgttctctgttgacacgtaaaattgattcacgcaacaacaatgaaaaccgttgtgctttcgtgacgacgaacgactagttttcaagcaaactagcaaagatcttcactttcgtggaagaacccgactgattttcagcgcaaaccagtaaagatcatctgcaccctagataactaggatttggccaaagaaacaagagtaaaagtacgatgaaaacagtagaagaaaataatataggatgataattgttccagagccctaccaagtgcaaaatccatagtatatagtaaaggaatacactgtactgcatatatagaaaactctaggtaaatccgtgattaattctatctaatcaaaaccgtcatttttaaacgacagcttccatgcagacgtatacacgcctcagccgaaagtcgcctctatcctgcaacgctgctccagcccaagtttcagaatttgtctccccttactctggcaacaatgtgatcctgtgtggctagacttcaacaggcatatcatcaaacatagccatgcatccaaccccagccacataaaatcaaccactgaagcctcacatccattgaatcggcaaaagctccatcgctgcatgctagctgcttgaactgacaaaatctgagaattgcagcctcccaagtcctaaccttcttctctagtttctgcagctccccagcaactcgtacacctcccgatgcatcacaaattcctgcccttgtcaagctaaccaattcttaagcaaaccactaaaacaattacaccaactattctatataatttggcctgtctaaaatgacctaaccaaaagccaaattatgctactaacattctccaagaaaaaagacaccaagaccataccacatgttctctatggcgtgtaacacactttctgtctctacttcatgttagtgatatgccctagaggcaatcatagagatgattgtatcacatattatgtttacatatttatccgacattgttccttgaaatagataactccttattggttaatgaatatgtgattctttcatgagactttttatgttgtttgttactatttctaaaggatccctgatcaaatatcatatgtggaacaaatatgtttatatgatcagcacatgtattaattgatgattatgtctcatggatcatggtatagagataccaaattaataatgtggacatatgttggtgaacatgttgttaggtagacccaacatgagacactgcaagagccatatgtgttgtgtcatcagtgatctcattgagtgttgatgttgaatccttagacctgagattatcatggttctcaacatgtgtagtagcttacttagggactgctaaacgctactccgtaattgggtagttataaaagtagttttcgagtatgctatgaaacatgtatagtgggatatgaataatcaagatgggatttgcccctcctatggagagatatctctggacccctcgatgttgcagattatggaagtgcatggccataccaaaggtgattgaggagtcaatcacaagttatataatctatcaacaggttcgagtgaatgattgagctattagaggatggcacatatctagccttgagcttaatcgatatcgtgaggcaaaggggttcatacaactatacactagaggttcagccgatatgatctttatgtatgcccggtgggtatacactagaggttcagccgatatgatctttatgtatgcccggtgggttaataagttctgctggagtgtgttgcatagtagttatagttgctatactctgcttacctgttttcactgattcttcggttaggaataacccatgtgctaatttccagcctcctagtgatgcagctgctttatctatttattgcgttgattccaatggatgctgcaacttcagctgtgtgcaatcagccgtcgatgcgattcccgaaaatagattgacaagaagtgtcgtttgaatcaactccggcacatacatgtaagtgttttgcattatttattggactgctaattctggtgggatacattcatgcatggtttaagggatgtacactttcttttgcacagtgaaaaggtgacagtgaacttttcaaagcctaatgtaacattccaaggacaaggttttgagtcgacgatcatcgtttggaacaatagcgcaaaaaatacaggcacattttacagcgccaccgttgatgtttttgctacaggatttgtaacgaacaacatcagttttaaggtatgttcttgtgctcacaaaacttaatttgcttaattatgtatacggcagaagggtttagtttatctactgattcattctgtgtagaatgcatccccagctccaaagccgggtgatcgtgacggacaggctgtagcaattagagtttcaggtgatcaagcagcgttttgggttgcggcatgtatagctaccaagatacattatttgatgatttaggccgtcattactttagtgattgttttattgaaggttcgattgattttatctttggcaacggcagatcattttatgaggtacgtaccacacaaatcttcgatggttctagttacgttttattttcattgagtgagtaacaaacttgccatgcatctaaccaagtttctgtgcgtttttcagaagtgtattttgaactcggtagctacaagcgatgggatcaacggtgcaatatgtgcacaaggccgtgaatacgcggccgatgacacgggctttgcctttgtcaattgtcgcatcaccggcagtgggctgattttattgggccgtgcatggaggccctactcccgcgtggtcttcgcgcacacggacatgcccggtatcattgtgccgagggttggagcgactgggacgacccgcaacgagatgcgtacgtattctttctactactacttccgtttcattttatattagctgtatgtttctaaacatgtatactacggttttatttgttttaacagcacgatgttctacggtgaatacatgtgtacgggtgtgggcgccaacatgaccggtagagtaccatatgccaaaccgctgacggagcagcaggcgcagatatacctggacgcttcctacgtggacgcggatggctggttaaaaccgttcaacgattctcttatagttaattgagtacaataccatgtaaataatggcgggggtgcaattctttgtacttaacacggttgtttagtactactaagggaccacctatatattcgtcgataaattttctccaaaaaatttgacagatgtaattatagtacaatcgtaatgtaattacactgtaacttatatgtaattacactgtaacttgcatgtaactacagtgtaacttgtaaataagtttcatttaattttgaatctttaaatctattacaagatttgttttggtaaggaagaaaaataaaatcacagcacacatatatgtgtaaggatttgtttccacaatctctattttaccgaaataacatattacagagacatttttgaaagttacatacaagttacactatagttacagtgtaattacatgcaagttacagtgtaattatattacgattgtactgtaattacatctgtcaaatttttaggagaaaatttgtcgacaaatatatagcaaaatcgtactactaatatgtatatatctggtatccggagtactccctctgtttcaaaatgtttgacaccgttgactttttagcacatgtttgaccgttcatcttattaaaaaaaatttgtgaaatatataaaactatatgtgtacatgaaagtatatttaacaatgaatcaaatgatatgaaaagaataaataattacttaaattttttaaataagatgaatggttaaacacgtacttaaaaaattaacggtgtcaaacattttgaaacggagggagtacttatttactcacaatttggcgataaatgaaaatgagtaaccagtaacgatcctgtgtactaccacaaagggggtgtttagatggggctaaaactttttagaccatgtcacatcggatgtttggacgctaatttagagtattaaacatggactaataaaaaaactaatttcataaataagagatgatccacgagacgaattttttaagcctaattaatctataattatcaaaagtttactgtagcatcatattatcaaaatcatggcgtaattagacttaaaagattcgtctcgcgagttagtccaagctcatgaaatgaattttgtaattagtgtatatttaatactctaaattaatgttcaaatatccgatatgacagggatttaaaataagtctccggaaaccaaacagccctaaagttacgaattttctgaagtctcatcaccgcaaccacccgaaacgcaacccctctctggagatcaccagatctactcgtccccaatggcggccgccgccgccacctccccggcgcgggcggcggcctggaccttcgccgccgccacatgcgtcaagctcctgctcgtccccacctaccgctccaccgacttcgacgtgcaccgctactggctcgccctcacccacgccctccccgcgcggcggtggtacaccgacgcctcgtcgcagtggacgctcgactacccgcccttcttcgcctacttctcccgcctcctcgccctcccggcgcccctcgtcgacgcctccctcgtctccctccccgtccccgacgcgccgccctccttcgcctacctcctctacctccgcctcaccgtcgccttctccgacctcctcctcctcctctcctccgtcctcctgctggccacggacgcgctcacgcggcggcggcggcggccgttcctctccctcgcgctcgtcctctggtcgccggcgctgctcgccgtggaccacgtacacttccagtacaacgggttcctgatggggctgctgctgctgtcgctgcacttccttgagcaggggagggatctcgccggcggagtcgtttttgctgctctgctgtgctcgaagcacctgttcctagtggcggcgccggtctacttcgtgtatcttttccggcattattgctgtggccggggtgtggtgaggggattgggaaggttggtgctgatgggggctggtgtggctgctgtgtttgctgctgcatttgtgcccttcctgtactatgggcaggtgagttttgctcggttaatttacctttggaatggacgaattggtatgttttttttttgtttagatactgtaatccatctgtaatcatcagttcacttaaaagtaggaaattatttcttgagaggatttcaggatttttcctgtagttcatcaagtgttcagaattagaagatcggtgaagtttataattaagggttccctatcaaaatgggggatccac

SEQ ID NO: 3341 - DNA, 3859 bp, Oryza sativa
tataatcttgccgatgcaacagctctttaaccggttgtttccctttggtcgaggcctgtgccatgcttattgggcgccaaatttttgggtattctacattttacttgacaagatcttcgcgtttcttcttagaagactaggcttcaacatccagatacctgaagcttcatttaccggggggcttgttggtaattcgtctccttttgctgttcttcccaaggttctctctaccactatgaattcttatatatttccaagggagaatggctatctcaatggtttaataatttgttttaatgaacttacggattgcaggtcactccaataactacatttttattggtcatacttgctatgtctccttgcctcatgaaagcattctctaaaccccagccaaggcacattattagatgggtgtcatatgcaactacatgtgggtttatgtttggatggcatgtacatgagaaggcatcactccatttcactattccgcttgccctaattgccatggatagcttggaggacgcgaagcattattttgtgttgtcaataggtatgtttgagactttgagtcagttgagtcaccgttaactcttgcttaaactcctacttgcttttactgtaatacctactgtttcacaattttcttagaaaaacatctctttctgattgatacactcctttcaccataatacatactccctctgtttcaggctgtaagatgttttggttttgtcgtaagtcaaacttcttcaagtttgaccaagttttttttataaaaaaaagcgtagcaacatttttaaacaccaaacaaatatattattaaaaatatattcaatggaggatttaatgaaattaatttagtgttctaaatattattacatttttctataaacttggaaaagtttgacttaggacaaaaccaaatatcttacattctgaaatggagggagtactatattcacaaaaaaagagttagaaagcattggggtactggttaccatgtgaataactcatatcaggtgatggttcaagacctaagccaatagaaaatacctaattaaactattcggaacagacaccatcttttgcacactgaccaagaaaatggggaaaaagggaaaagccaaccatgtgatacaacattgttttgtactccctccgtcccaacatgtaagcatttttagctatgaatctagacaattgtgtgtccagattcatagccaaaaattactatattttgggacggaggtagtatttatagtggtatagtccactgctgcaaaccatagtacttctagctttaataatgaaaatggcgtgcagtttttcttatttttataactgaaattgtattttgatgaaccagtggcgttcatctgttctgcactttcacttacgtaaaatctgttcactatggagacacatagtcacatactgcttaacatgtataatgagctattgctgtaatatcctgccatttcttagtttgctaacttgttggacagttggagttgaacaccatttcataactatattttaataactcattgtgtcattctatggtagcaactggagcaaaatttcgtgtaattttgcctcaagacaacctgaactaccagtttaacaatgacttatgaagtgctgattatatattgtttgttttgctttgacatacatttttttgttttgcagtttcatgttattcattgttcccattgttgtttgagaaccaagaatatcctataaaggttatgcttctgttgacctatgctaccctcatgtgggtaggattttcttcccattttgctgcaaaatctcctcaagaagggaagaaagtaaatgaatcaggcagcgtggtcaggaaaaatagcttcattgggtggatcagttttagctatcttttaggaattgttgctatagaattatggtctcaagtattccaccactatgtatttggcagcagatttcctttcctacctctcataatggtgtcactctactgtggtgtcggaatgatgtactcatggatgtggcaactcgcatggattgtcaggcactaatatggtctctggttagcaacacgagcatgctgctttgccttgctgggaacccagcctcgcactaatttgtgataactcacccctcttgaccattgcattaggccatctttcccaccccaagttgctactggggtgggaacatgttgacacattcagttgtacagcgtgatggcaattttcggagatgtaaacctcttgtgataactcacccctcttgaccattgcattatgccatcgttctctccccaaattactactgggaacatcattcatatgttgacacattcagttctacagtgtgttggcaatttttggagtaaccttttcgtgatgtaatgtattcttttgtatggagctgcttgtaccaatccattcttcatgggttggtctttttcttcttctgataattctggaacgtgctctgctgattgtacgatgaccatggagatgcttactgtctttcttttccatttttctggaatgcaataaggtatccattggcctccctgattttactactggtgttgcatcatacttgaacatcacttgttgaaaacacattccaatcacgatgtatcaccgaaatttgttgcttgctgtttgatggaccctgtggtcggagttatctaccataccacaagtgcattcggtgtgataaaagaagttattcttttgttctcttaagaggctacagcccgagttgcagagtcccgttgcaattgaaccggacacgtaagcaactggattaaaagagagagagagagagagagcactggattagatgcaaaataaaaaccgagaaagtttaaaacagtagatgcaaataaaaaccaaaaagtagaaagtttaaaacagtagatgcaaagtaaaaaccgagaaagcttaaaatagtagatgcaagattaaaacagtagatgcaagataaaaaccaaaaagcagaaagtttaaaattgtagatgcaaaataaaaaccaaatagatgcaaaaataaaaaccgaaaaagtctaaataaaaacggaagcaaaaccaaaaaggataaagtttaaaacagtagatgcaaaataaaaaccaaatagatgcaaaaataaaaaccgaaaaagtttaaacaaaaacggaagcaaaaccaaaaaggataaagtttaaaacagtagatgcaaaacaaaaaccgagaaagattaaaacagtagatgcaagataaaaaccaaaaagcagaaagaaaaccgagaaagtttaaagaaaaacagctcaactaaattatcagagccaggtttcgatcctgggacctgtgggttatgggcccaccacgcttccgctgcgccactctgatgttgttggtatgattctttcacaaacttattagatgtcgaaaatattaatgggccttgaccaggacggcccaaaaactaagaaactactcatacagccacgcaggtagaataacaacgacaaataattctcagtattcagtaagacttaacacgatacactctgacagtctacaagttaatctcttggttgcagcatcaaacagcattctcgtacaagcctcgatcaagcttggtgtccacggcacaaaagaaaaaacgagaaggaaaaggcaaagcgaaacgaaacgtcggctccttttggccccaaacctggcgtaacgtcgatcacctgtgtcacttgctgctaatattctttactttccaagtgtcagaactcagaagaaaaaaaacttataaagaactcaaatttcctctttctgctttcgatcggattacgatatactatgcatgttcttggtgaacagcaagt

SEQ ID NO: 3342 - DNA, 3586 bp, Oryza sativa
gtatgagctagctgtgatgtcatggaatggaagggaggtaggtcacatgagacatcacccggattgtatctacccttctacggaacctgtactagctcaattcagatggagatttctgattacgactgtatttattttcaatttgagaaaggtaatatcacgtgtgattatgtgtttgctaatgagtgtaattttggttatgtacttatgtgtcaggttattgcctaagccgcgttggccgggtgcacctcagcaaattaatcaccatccatgaagctgttaccatgtcagcttaggataaaattctgtgcttatgggtcaagaatcggataatctaatggaaagacttctgggtttacactgaacctaacccggatttgattatcggaatgccatgtaaacacgttctgacgttcctgtctgtcaacgtttcaggttgattgagttagaataaccacgacgaagcagggtggatcattctgcagaatgaaagactactactattggattcggtttcagacacttttatagtcttcttccctcattggataggagaaaggagaaaggcgataaccagagcagtgatctttttgttcgagtatcatatggatcgttgattcttcttgtcaattctcatcatgacatcatagtcttgatgagatagaggaatcaaaaggcgacagagcaaagaaggcggcaaggcagcttgctcctcacgctcatcatggcaatatggcatcagggatgagcaaatgagaagagggacaaggcgatctcatgagtcatgactaggcatggtaggtgcagccgaacaagaagagctcatcagtttcagcaccaaatcactgcctgcttgcctgaatctgaatgcctgcacaagaactgcagccttaagattgggcatgcaccaggaatccacatggcatatgttgcaacttgcatgcagggattgtgctttacttgcattggctccatatcaaagtggtaaacagttccatcttcttgcagttttgctatccaagtgtaaagggtagaactgaactgttgaatgacagtggttcagccaggtcccgtgtaaatattggaaaagaacacttttgcagtggggtaatcaggtgatgctacttgctaacaccttccctagtcccacctcagatggttgcacataagaaatcacacaagagaacaaactttaaactgaagtacttggtccagaactaacaaaaaatttaccccctgaataacaggcagccaactgataatcaaatcaaatgacacttcaggagtttctggattaggctagaaaatacaatatagtatagctagtaatcaagtgacatgttcagttccaaatttgtgttttttccattgatattttaggccaacaggcagccagggtgcatgatctctgcttgcttttttcaaagcctgtctccatggagtatatctcattatctctgactatttattactactaccagcgagcggctagttttgctgccatcgatagcaacaattttttaccgttaatagctcctataaaacaattggctactctcgatcatgcaacaaatgaaggtgtttcgtatcacctctatcctcaatccctaggacactttgcaagcaacatgagaagaaattaaagaaacaccaagtctcctagcccatgtatatatttttaagtacctatataggagaagaacctgcagctacaatattcctgaactcctcccggttccattgccccatggcattgatggattaaactagaccaagtcacaattaatctattcttgtttgttcttgtgcttgagacaaatagctgtgatttgatggctgctactagtcattgcttactttggacggccggtctccacgggattggtaggagaaagaacaaggctgtagtgtgtctcaaggcatctcagcttctcaagaaccgtaacttatgtaattaacctgcatatagatccaccctaaaccccagggatctgagacaaagtagacttgatttttctgcacaaatggcaaggttggtggtacaaaagtgatagagacgaaacacggtccctgggacacacatcacatgcgtataaatttactttcagtagacctaagctgacccaacgtactactctaaaaaccaaataataatgtgcgtgtaacatcagagagagctagttacatgtgtagtgtttctttaattatgttgcatcattaggtcacagtacgtccttcaaaaacacatatttagaccgcggaacaagcgggttggtagtgccgccacgactcgtgcaagcaacgatgaaacagcgggccggagatatggaagcagccatgcatgcataagcatcagcatggaccagaccgatgcaaactgggaaagcggctggtggtgtggggtgagagttctggtgcatgactctacctagaatttaaatcatgttgagtaattatgaataattatgcatattacagtttaataaaattttggtgagatcatcgcatgcatgtctttaagtgtatatatattaggagagacactacccttaaaaaaagtcttagttaagagcatcgcaaacaatatggctatctcattcccaagctaaaatttaacaattatgaaaaaaaaaatgaactctaacagccttgtcaaccgaatggcttggccaaacttacaccacttctctcctccagccgagctaaaggcccagctaggcacacgtcccaaccgagccgagccggcctagccaacccatggccaagccgcctcattcctccttcttgtgggcggctagccaaaactgatttaccaatcgtggaccccatgcccgccaattttgtttcaattccctccttctctctttgtccccacacactctccgtcactgcacccagattgagtacatgttgcgatcatcattgtcgtcgttagggtcaccattcgctctggccacaccatcgtcgccttcatcgtctagagttccgccattcactgcggacgtctccgttgtcgtctcgagtccctccgctgtgaccgccatccattgttgcacgccatcgccgttgtctggagggtcgtctcctgttctcgacgccgatttccaccaccagtgctacccaaaaagggggagagaaagaggagatgcatgatctcgtcagtggcactgtaggggagcacacaacgttggggttgatgggaggagtcagggaagtttgggaggcggagcgtggttgcccacattgaggtgtgtcaccagccctttccaccggccactagcagtagtgcacttggcccgatctattgtctgcttgcccgccccttattgattcccgccacccacaacaccacggcgcttcatctcgcctcggccacctcgttgccgtcggccacgccgcatgctgttatgtcgaggggagtggaaagatgagggagaaagaagtaaacagagagtgacatgtaggacccaatatcatattggagagtgtaataggcatattgttggagtgaaagatagatttggctctctaattttttgacaagctggccaaatagtgggatctttaatgtggatagaagactagc

SEQ ID NO: 3343 - DNA, 8575 bp, Oryza sativa
tatattactacttttatatctcacaaatgaagtcaagtttggacaaaattatttacgtcattgtaacatcaccttattatctatatgtgtgatttttctaaaaaaaattaaacgtcctttcacttggggttacataagtttttatctaggttgtgatttgcaccatatatttaaagacagttgttatgtaaaagaggcgggttaagacctattatattgtattcctccttatatttgtggatgtgcagtgtgctccaccccaccacttaccacgcatcgcacgagtgtttcagtacgtgcaagcagcctgcctcctccataccgctaccaccacaccacaccacactactctcctgatgactcctcgtgacctcctcggccctgaatgcgatggtcgtctcgcttgtacttactccgtcccaaaataaatacagccatagatattcatgtttagcgttttgaccatccgtctcattcaaaaaaaattttaaaaaataatcacacataaaatactattcatgttttatcatataataataataaaaatattaatcatattatttttttaaataagataaacggttaaacattagatgtgaacagtgctaaaactgcacttattttaggacggagagagtagctagctctgcgcgcgcgtccggtgctccttgattcgcacaacgccatgaggacccaacccgatcggatttgccgttcttgacattgtggcgtaatattgtgcttcgttttgctgtaaaagctagctgtcgggagattgggtcgaatgacgtccgtgcaggcggcgagccggttaatgccagggcgccgttaaatcctcgtggccccgtgcgtgcagtgtgaccgtgccagtacatgcagccgttgcaccaacttccactgttactactagctaaggagtagtagagagtactgtagtaaaggttttctgcgagaattcgttgacaaattaaattccatcatcaacttctacatgaagcacgcactgtacatagcggtggaactagtggagtgcatgtacgagagacatcatgggcaactaatctcgcgcgctaaaacattttgtatagatcggttggttgttaatgcgagtgacacatgtgattgctcaaccagacatgcaaattaaatccactgttccaatcacaaatcatcaatacagaacacagtgaaatccgccgacacgctccgctcgatccgagctcgatatggtcgatcaacaacacatctgcgttgcattcatccatgtttgcatcgtcttcttcttttttgttttttgaaagattattcatgcatccatgcttgctcgttcccggaatcatggcatcgtcgtgcatgtgagccagttaatcaacctgctggtgtgacgaagctcgaatccacatttgctcctgaagggcaaagtatagtgatagacgtacgtgaggcttgcttgctcgtatatgctataataaatttattattaatggtcagcgtggtacctgtaattattgtcagctgcacgatactcctacccccaacgccaacgacctctctatgcatgtgcaaggggaatttgcgagtgagtttactaatccaaagtcaaaattcctcatgtctccaaatcatcattccttaattaacaacgcaatccgatcatttcgtgtataatgagacgaaaaaaaaaattcccgtattagattaaggccttatctagttggggaaaaattttagatttggttgtcacatcggatatacggacacacatttaaagtattaaacgtaatctaataacaaaacaaattacagattccgccagaaaaccgcgagacgaatttattaagcctaattaatccatcattagcaaatgtttactgtagcaccacattgtcaaatcatggcacaattatgtttaaaagattcattttgcaatttatacacaaactatttagttgatttttttccacatttaatactccatgcgtgtgtcaaacattcgatgtgatgggtaaaaagtttatgttatgggaactaaacaagacctaaattcccccgaaattcttgtgttacgaaaggaggctctgaactccgattcatgcaccatccaaagctgtggctaatcaaccgttcaacaaattaaatccaacagttcttaaaaaaaatccgacatgagacattttaagtggagtgtagttttggagtttttttttctcccattggatacaccataaagtgtagtggatcaaggggccgacatggttgatgcgtgtctgatgaagttcataaattctcggagatgagatattgaaggcgcgtacagcatgcgtacaggaagcccattacgctggccacggtacctttgctctctctgacaacgatccacgccgttttatctagttggtaagaatacccaatgcatggattaaaatgaaagcaactttcaatgatctgtataaatttccatggacactatggccttggcatgcatgcgtgtagaaacagaggtacatacacgtacatgtatatatgtaccaatgatttttaatgtgtgtccatgtattcatgtctagctgaattgaatgggctctcaacgaattctctgtcggtgcggttactgtacagttcgatcattcgatatgttttcagaaagctctgcagtaaattaaatcaacctcgtgatttttttttttgttgatgtgacgctcatgttagcttgagcttcatccggaagaactatgaggctggctctcttttagagttgaaagctactacttgagcaagccccacagattgttcgaccaacaaacattctagatatatacaggcaacaaagcgtcaaagcaaacggcttttgatctatgtactcgggcctcgtttcagaaatgcaggaagccatagctagctgaaaccatttctttctctcttctgttttttatccttgttctcgttgtgacagatggtaacctgacggctacattgcacggtgacacccgccagcgccaatatttagttttgtcgttcgtgcagcacgtaggctgataaacctgtaaccgggattactctgggctaaaatatatagtgatatgatcaaaggacatgaagtagagcattagctgatcttttggagtaccactttaatctgaagtaaatttgtgcccatttcacggtagtacatcatctttctcaaagttacttgtactacaatgatgtgctttgtctacgaggcaaaaataagataaactaccaacgattaaaatgtaatgaagggaacaatatggtgccgtttgagtttgatgaagataaagattaagtaaaaatatgctaaacaaaaaaatcatcagcacctaattaataaagttttatttattataaacaataaaaatatatttaaattaatattttagaacggccattatataaaatatttttgaaaagagtatcgtttagcagttaaaaaaagtgttaataaaaattgagatgtactccaatttgtatgttattaatcagagaagaacgagacggatacaactcatgtcctacacctccaaaaaccacatctcgacacagagaaatgacactgagaacaatcaaggtcagaaaaagcaaccaaagtcagagacacaaatcacagatgaacaaggaaagtagagagaaaaaactggacatgttcactcaccggaaagtaatctccgacctggtctctagtgatgtgtgtgcttgtgtgtgctctacttctactcgtctcacggctaatcacctggtatttgcgctccgatttcgctcgctctccgtgccaacgccgcgcaccccaaaacccataaataaaggcgcgagaccacacgcagggccgagccttaaacacaccgtctccttcccccccatggcctccctgccgccgcccgcgccgccggccatcggcggcgacccgctcgccgccaccattccgccctcattgccgtcgccggcgccgtcgtcgtcttcgctcaacctctccccgtcgcttctcatcatcaccgcgctcctcgccttcgtcttcttcgcctccgtgtcgatccacttcctcctccgctgcctcgcgcggccgtcgcacccggctccgagcccgctgcccagggcgtcggcggcggcccaacgcgcgacgacggcgtccgccgtcgaggctggggaggctaccgccgcgtcggcggtggggaggagccatgagggggaggcggcggcggggggtggggaggaggtcgacgacgagaaggagcggctggtcgcgccgctgccgctgttcaccatggcgtcggcgctggcggcgctgcccaagagctcccccgactgccccgtctgcctctcgccgttcgcgcccgaggccgagctgcggctgctcccggcgtgccgccacgcgttccacgcctcctgcgtcgacgcctggctccgcaccaccccgtcctgcccgctctgccgcgccaccgtctcgctcccgcacccgccactccccaccgccgccgccgccgccgcctccaacgcggcgcaacaggatcccctcgactcgcggagcagcaacaactcgaggagcttccgcgtcgagatcggcagcatcagcaaccgccgctcctccgccgcggccgacgaccggcgcacctactcgctcggctccttcgactaccgcgtggacgaggaggtggaggccgtcgtgtcccgcatcgcgcgccccgcggcggccaagtcaacgaccggttccgtgacgccggcccccggcgaggcgctggcggaggcggcggggtcgcggggatggctgcgcgagtacgtggaccgcctcgcctcctccgcctcgtccctctccggccggtggagcgggcggtggagcgcgcggtggagccagagccaccacagcaaccggcaggaggactcgtggcggtgggacccggaggcggcggtgatgtcggcgccgcgcggggtggacgacgacgagccgggcttcgtcacgctgtaccgttggatcgtaggcgtatagaactagccccctgtaattacaggacctcacgaggttttttttgtcaatttccttccacattttttttactaggactattttgtaaagagaaaaaaaattccagccccagatgagcttaacgtctctgaactctgaaccttccatcgatttggacaacatcgtcgccattctctcttcccattctcctcctgtcctcgcatcaatcctcgcaaattttggcggtattcaagctcagattgtaaccactggagactggtcattcgttcgttttctggagaggcaattttctggagggggaaaccgggcgaatcgcacacggcaggatgccacgccgtgctgtttgctcctttttccttgtggtttatagctgatctggtcgcggctactctgaagcctggtggtgcgcctgcagcctgtgcagatgtgtggattctgaatcacttgtgttgggtggaatggatccatggccgtggcttagtgccctagtgcgtcgtaggcttgcagtcaaaaacgtgtccaatcccctgcgaactgaggacacaccacttcaggtttgttcgttgtggtgatcctttcttgtgcccagttgaagagtgtaacaaaaaaaaagtttaggacattactgagagaatggattagtgatcctagttggatctagtatgtagacagttttagtttttttttccctttgtttgttgctaccgtagcatgctcctggcttgtctctgtcatggagtcgaggatcttgctaagttgggtagcctgcccggtggtccttgttatcattggatatggttggtgggctggaggcttggtgcaatggtgccaaattgccaatccctcctagtagcatatactgaattcagatttttttctttcccggggaatatgaattcaggttttatcatgtatactccctcacttcctaaatacaactattttttggtacgcggatttcagtgcacgggaatcaaaacattttcaaccaaacaagtgacgagaatcaagcgatttaaaattcgaaattcgatcaacaaaatgactgaaaagaaatcttccctcctatctttaatctctgctatacagtgtaaaaagtgcttatacttaggaattaagggagtatgtgagtctctgagatctccgatctcgttagcgttggtggctcctcggatgtggacctggtgaccaatcatcggattaagtacttgcatcgcgatacctgaacaaatgccaaaaccaattcgatcgtctcgccatgctctcggcttcttctcgcacagccagactgatcgtgttagctcgtcgccaccagcccactaccatcattttctagcctgctactactaacgctaaatctgctactaccactgctaatctgctgctactgctgctgctaccaccaaacacaaccgactggtggtgactgccacccaaggaagaggcaccgtcgcgtagcattgaattggattgacgggtttgagcagtgatcgcagcgttgctgtgccgtcgtcggttttaaccacgcaggcaggggcggcgaccagctgcacccaaccgcgcacttcaccttgaatgctctcatttactccgccttcctaccgaaatcgtccgctcgccgctcgtctcgtgcccttcggttcgtagggaagagtcgcctcccctcgcgtggtgccgtgccgtgcagtgaaaaaaaaaactctctcatcttttcgcttatacttatatctattatattattaaaggaatagaaaaaggagcctccacgttcgctctcatggcctagaaattctcacattaatcggagaaaaagaaaaggcagagtccatatagaaatacaatttagaaatagctaaaattcgaaattaaaaaataaggaatattagaagaggagagtagagtccatatagaaatacaatttagaaatagttgaaattcggaattaaaaaataaggtatattagaagaggagattagagtccatatagaaatacaattaggaaataattaaaattaggaattaaatgtaaggaatattagaagtagagtataaagtctatatagaaatacaattaagaaataactgaaattcggaattaaaaataaggaatattagaagtagagtatagagtccatatagaaatacaattaggaaataactgaaattcggaattaaaaataaggaatattagaagtagagtatagagtccatatagaaatacaattaagaataaaatagaaattcggaattaaaaaataaggaatattagaagtagagtgtagagtccatataggaatttaaaactaactaaaatttggaataaacataataaaattaaaagtagagtttagagtccgtataaaaatacaatttacaaataacaaaaattcgaaattaagaaaaacatgggaagaagagtttaaagtcaatataggaatacaatttagaagtaactgaaattcaaaattaaaaattaaagaatattgaaagatgagtttagagtacacatagaaatacaattagaaataataaaaaattataaataaaaagtaaataatattataagaagagcatagagtctatatagatatacaatttacagaaaattcggaattaaaaaaaataaatattaaaagacgagtctagagtccatataggaatatatatgatttacaaataactaaaatttgatattaaaaataattaataactaacacgtatataaaatacaatatgaatattacatattagtagttttgtaaagttgttgcaaaatttaaaactatgttgtcattttaatatatttgaataacataatgagagaacatatatgttattatatgagagaaaatataatgatgctagccgcgcaatctgcgcgggccaccgtgctagtttatatttatatcaactaaaatttaaatttttgatcttaaatttaaagttaattttaaaatttttttcatcatagtttatttttcaacttacttttacaaatgtataaaagttttagtcatgaattattttttatttatagatatatcgtttctttttttttctcaaatcagccaaaacgatgggcctggcggatcgatcggcagatggtgcgtgccgcgtgcgtaccaatgtgtcgtctctcgttgccatgtcgagttgtggtagcgcctgcgtatcggtggcgccgagtatttatggcacgttgaagtgagccggtttgaccgtacgcccatcaccggtgtgtgtacgcttgcacgctggacacttttgcattgcacgggaagcagggctttctctccacgtccacggaccgcctgcctccctgcagccactgagacacgtagttgcagcaacagcagcgaggtcggactcggacgctacggctgagcgggaccaagcgtgcagaggcattgaatcatccatgaccagcttggaaggaaaaccaaggccccgttcgatccaaatttgtgaaagcttcaccctgtccctgtgcatcagctgtagcgattatgaggaaacgcgtggggttgtaggggaatctgattggcgctgcttctcgttttggggggggggggggggggg

SEQ ID NO: 3344 - DNA, 2723 bp, Oryza sativa
agcccaggcccagcggaaggaccgggagagaaaaactgcttgaatgggatcgttttgtccagcgcatgattgttcctctcccggaacttacgaagggactgggattctgaatcaagctactgtgactagggatgaaaacggagcggatagtttccgtcggctccggacaaaaacggatacggatacctttcggatcggataattcttggatagttcggatacgaatacgaatgttttctcccggatatgaatacgaatatggtaccaggtttccgtcggatacggataataattcggatatccgcaggacccatgagacataccccatatctttctaactctataaccttcaatatacctttataaaatatacctttatagattttaatagtagtttatctcttaacactagtccatactattaatattatttaaattttaaaaaatatttataaattataccttattttatataaaatgagctaattatatatgttgatatttgtttctattagaagttgagttggttttcgtgttccgagaaaaaattgtttccgtatttgtgtccgatcatattcgattcttattcgtattcgagataatctgtatttgtttccgtattcgagctatccgtattcgttttcgtatccggtaaaaaatatgaaaacgaatatggtatgagcattatccgtccgtatccactccgttttcatccctaactgtgacaaaacagttgctaacttggtattaaagtcgataaacgccgaaacgacgacgaagacgatgaccatatgcaccagtcttcttccacttgcagatgaaagtggatcactggaagcggaagcgtgagtgacactgacaccatggacgacggccattagcagccgagttagtttggccaccaacttctctcgtctcgctagagcaatcttttacactttaataagcgtcctagcatctcaaacggacgtaagtaaaatacgagccgtgtaacaacgcaaggactgacataacacaagcatggcttttcgcaactaacagaaactgcttggagaggatggcacttgggcagccaacaagcttgctagcagctagcccaattccgtatataagtgaagcgttggtggttagcgatatcgcttatgctgactaaaacagtacctgcagcaactacacagattttgttggtgtgaccatgaatgaagctcagtacacttattattagcacggtagtggtatcgatggacctgggacccccgaggccccaataatgaatatatctctgtaaaggaattaaagggtaaaaagccctgcagagcagacaaatgttagtaataaatatataaactgcaacatctgaataactgagaccttggatttaccaggatgggaaaaaagaacgaaccaaagtacttgtactatttcatttagcaaccgaaaacaaaggtaccagtccatgccatgttaatttgtcttgacctgacaaactgatggtacaaatgtaatgtaccaatcaccaatctcaccacgccagatcaaaagggcacagttcgagggggaaacctggtgtctttctagtagtctactgggttacatgatttgtggtccatattttacaaacacgggcggtacaaataacaatcgtaacaatacatatactacaaaaataataaactacatatactccaaactctgcccaaaaaaacacgcttgtatccgggagaacaagcaaaaacactaaagcgtcagagttgttgaacttagagagaatgaaatcaagctgtaacaagtaatcttagcttcctgtcatgctttatcattgaacttacactctctacaaccaacacggtctgcaaaaaagtggcaaaaacaatttagattcaagtttagaaaggaaaatgcatagtaggacttaggataaacgttttatcatcttacgataacattcagcactaatcattctagagaagttgtaaaacgcaagagtgcttagctaagtactggccatggcaagcatagcacaacaaataatgcggaacatattggttacctgaaggcaagtgtaagccaaaccagtggcaaagtagaaatttgcattgccagtcccctgaaattattgtcatgttagtatcagtggcacacaatactaagagaggggaaggatgggagagggagataccctccagatccacaggttgtgcatgacagggctaaggagagagactccgatatatccaaaaaacaagaagaaagtgaattgcatctctacaaaatgtaaagagaaaccattagtgttgtagtgtaaaactaaaccattagttttctagaggactaggagtcattcaaaatatgttaaaagaaatgttaagcacctgctaattcattagcaaataggcccaaaagaccaagataaagagctgaatctccgaccttcaagataaatcataatatggtatcaatgaacttgtgggaaaaaaatcaggacaacacaacaaaaacagtttgatgaaattttacacaaccgagggactaaatttataggtattatcatgtaatgtgtacttaccgatggatacgatttcaatattgcgacaattgctgtgtaaatgaaggcaaggaagcatggacgatgcttcagacggattgccaatggtaataccataaaaacaatgttcatattgaagactataaggaagaagcttctgaaaaagtcaagacttcag

SEQ ID NO: 3345 - DNA, 3128 bp, Oryza sativa
cacataaaatgtccagaaaagcatccacaatatgaagtggaaaactggtttccacaagaattgttgaacatctcttgagctagaacttttatcattgtctgatacgtcagttttactggcacttgagctttttatacgaaatacttttgttggaggagcatctggaccatatcccaataaaagaatgatctggaaaaagaactttgttctcaatagctgactatacaggtaatggaaggcattatcaaatagatgaatataagagtacaaacaaagcttgtgacacaaaccggtacaatgagaattgcaggataaagagagagatgtgtagccataacatatccaaaggcagcaagaggagcaagacctaaaaattagagacattccaagttttaaacagcatgagaacttgttagacttctatgtcactcaaaagatagatactgtcttcatgaaattgttgctactgatgctttgccaaatgaaggccctttttacataacaaaaatgattctactgaaaatttaaaaatagcagaacatgttgaagagaaacacgaatttgagttgcacttacgtgaacaggctccatatatcattatcacaaccattaaattctcgataggtgaagtacatgaacccacacaagtaactattgcccaggggttccacaaatatatgagggaagcaatatctcctgcacttacgttaactgcaggaacagtatcaataagaacaataagtagctgcataacaaacattaagtaatcacaagatgaaagcatcagactatcattagtaaatgaagaatcactaattttgattcaagtataacgtttcaattttacaccttataagttgctagaatcacagtcatctttaaaaaaaaatcattccgaaatgatgtattaatctgaaaataagttgtttcatagcaattccgtgcatctctattatgaaagactagattggctctacaataaagaatgacaattcaatgagtcaatgaaatatttgaagctttgataatataattctgcaagaagctctgtatgctactccattggtaaaaacaagtagataactagtgtcaacaaactaagaacaactaggtcagtatccaataaagcatattctgcaaggagggacacaaaactgtaggtcctcaactatagtgctcacctgaattactcactgcctctgtgagctcaagtgacttcaagtttctgttgcgtgctatttggagtctacgaccagttgctcggataagcatggcagctataaaatctacggccacaaaaatcaaactgtcttgcattcatgagtgtaatataaattacaagatctccaacatagttcaaaaagataatggagtacattggaggcttcattttttttatttggtctgaatcattacatggtaacataaaaataataagaacataatttaaaaaatcatcatagaaaatccttttcatccatggaaatcaagtggctaatactgttagagaatagagacacagatcctaggtgtaatggaaaaaattacataacaacttatttacctgcaatatatatgatcatgatgtccaacagacctgtaataccatgaaatacaaggatgtgagtatttcaaacattgatctgatattgtgataaaataaaccaatcctgtcaaagcatatagctgcagtagtgcaaccaattgcgatcagagaagcatcatagacaaggaattgatcaccttttgttagtcaatggaccaagaaccaatagaagcaaaggggaaccatgatacattgaacctgaaagacaaaacattcaccgtgctgaataatcacttccagttcatgctacaagaaaaacacattgcaaagagaccctactaaaacatcatggataaacctataacaatgacaaatacctgcacaattatttgctaagtaaaaggtatggcaattttgcgcttattttttttaacacaccccattagtgcgggcttgcagcagttcatgcttaatggagcttactagaagaagtagcacccaatcaatttactttacttttaaaagtgctctcatgtagctagtaattccatccctatactgagctcaacaattcacgacttcagttgtcccccccaaaaaaaagtaatcaagcaagattaagatgtgtggaacgaaccggagtagggcgacatggaagcctgcttcagccagtacccttccgccactgcaaaacacacaggaaaacaagctattagtccaattacggcgacaacacagcacagctcaagtctgggacgaggaggcaggggagcaagggagcgcttacggcggcggatggaggtgaggggggtggagacctcggggcgggaggcgaggtggaggtccccgccgaagagcacgagaacgagccggaacccgacggccgccgcggccatcgaccagaagttccggatcgccatcgccgccgccgctgccgcaactccgatctgcgcacagccaccgcttcgtcgtcacggctgtaaccggagccgcggcctggcgattgggccttctacgccaagtcgtcatggatgtcgcctttgcgtaattgagttgggcttcagcagccagcaccggttggatggcccaaatcatctgcaattcgggagtacctatacatctttcgaaagatttttataatcgtatcatacagatttttaatctttgtattaaaatctgatagatataataaaaagcaaaaaacaattaagaaacaccataatgaacattaaattaccatatcctcaagaaaaagaccaaatcaaatataaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgattctttagtgttaaggcccacattagaaaactttggaagcccgacctggaaaaataccagcacaatgttttagagtggttttcaccaacaggcacaaaggttgaaacgggaaaatatgtggtgcaaaccatatatagtgg

SEQ ID NO: 3346 - DNA, 8430 bp, Oryza sativa
tgtgatcccaagttccaacttccaagcaaagtacacgtgtagttccatattgtattactacattctcataaaatatatactagtaatctaaaatcggattagatataacataatactataatctgaacatgtagaatatggataggaagcacatatcctaattggctagtagtatggatttagacagacaacacatattatatattatagtagactagtattacgggtctagacataagtttattatctatatcccatagtacgttgaatccggttagctggaatcttctgcttcaataatggcccatatatgtaaacagatactttttttttaagataacattgtgtcccaaaaaaaggaagcacagatcataaaaggtagacaagatcgaatcaaacttctcaaaataccataatgtcttgacgatgacaagtagggtctggtacaacattattttattttagcaaacttataaattattaagacaactattatggtattatcaaatcttgcccgcgtattaaaatgcccaggtctcgcacgctagcttctgatcgaaaccgtctacacgcagtcgacgtctacgcgacaagccgcgagaacgtacgccgccgccacaacacaatcccaagctcccaacctacgcaagctcaccatcgccggccgtcgacccaatcccagcgaccatgaggcgtctgctcgtcccggtgctcctcctcatgctcggattgtctacctgcgagtcctccgtgttgcaggacacatgcaagtccgtcgccgccggccacaagtacgtcacctacaacgactgcatcaaggccttccaggccgacagcgccagcgccaccgcggccgacgcgcgcggcctcgccgccatcgcggccaggatcgcggagaaggccgccaacgccacgtccgcgcgcatcgccgcgctgagagccgcggagaaggacgcgaggaggaaggaccgcctcggcgtgtgcgcggaggtgtactcggacgccgtggaccagctcggggagaccgccgaggacatcgccaggggcggggacgaggccacccaggacgcggtgacgcagctcagcgcggcgctggacgcgccagggacgtgcgaggacgcgttcggcgaggccgacgacgcgtcgccgctggccccggaggacgccgagttcgcgaagctggcgaccatcgccctcgccgtcgctgcgtccctctcgccgccgccatcgacaccggcaaccatggattgatactgtctattaatcatcgtgattcgcgcataattagaaatttagcatcgtggactacattcagctataataaaagatttttcgatgatatgttaaattttttatgctttacttggaaggattttgtccagtgccttgcatgttacgcatgcaacgtggtttagtgggcgagtagccagcttggaatctcatctcgcgctttttttatactccgtacgtggtatgtctttgaacgtgggtgctagctgttttctggaagtgggagcgttgagtggaagcaaggcgtgctgccttctgaacagcacttttgcctttcgccttcgctcccttcttttctatgtggcttgttggcatatattgctacaaaattgtactggtaaatatacagatatatattgatctgctgcgaaattatgatttgtgtatcgttctggattatttggagttttaagtagtaccacgtaaaggccattcggtaattgagcagagcagcgctagatgttgatctcaagaaagatatatgcatcagaagccaatgagagtaatagtgccattgatcatggattcatgtcttgacgttcaccggtagccagaaactgaaagatctaagccagctttcttaccgcatcttgcacgattcatgctcttgatggcatcgtctatcgtcttattgtttgggtgcgtcgaacgtaactgaggtggcagcactatataatacccagattagagcctagctcattggttagatttggggcagggggagataatcagagaaaaaccctcacgcgtcgctctcccaggggcggctcaggaggcaacgacccggccgcccctctcccccacccccacccccttctccgcctcgccgtcgcccgagcggccgccggcgaagccgcgcagccacaaggacggcggcggcggggcgctcctcgtctcctcgcgctcgggcggcctggggagccgcccggagtggcgacggcggtgtccgccagatccgcgccgttccggccggatctgacgggatgggctggcggcggggacgggcgacggtggcggtcgaggtgagttgcgcggggtggtgttgtgggtgatggcggcggggatggtgacggcgttggggtggcaatggtggaggccgcggatccggcggtggcgcacccggatccggcggcggccggtggtggccagagcacgcaggcaccccgcggctgccactggcgtcctccggcgcccctctaggcgtcggccggcgttggtggagaggaagacagccggatctggctccttgcccagatccggcgcgtcctcgggtgggaacggggtggttggagtccggtcgtcgtgcaggtggtgtgaatatcgcaggtatcctcggtgtgcaggtgacatttggtggctcctgtcgtggatgctatggttgatgggtgctccaaggcgaaagtcttgctccgctctcggtgctagcaacggcgacacccttggacgccgttcaccttcttgaaggcgttgctactggagccctcgttcaactccacttcaagagttttctccgggtgaaaacctagattcgttaggatcggacgatgtcgtcgttgtcggcgtaaccttcttaaaggcttcgttttaggagtttatctcttgttggacggctgtacttaggttcggtttgtcaatgtcggggtttttgctggttttcctttaattaaccgtgttgttgtaaggtttttgggtccggtttcccttataaactggatcaactctcttcttctatagtgaattgcaggagctccctgtctgtcccctcgaaaaaaaaagatttgggacaggggaccataagcttagagggggctcagagaaggtgagggatcgacaggcttgcagcattgcagagtgcaaagagagcccgtaattagcagttttatgaaaacgcaaacccccaaatgaaaggcaattccaactaatctgaaaattctgatgaacctgaggatactcgtctcagtgtgtctgtgtgcgctctaatcttttctcctttttattttcaaaaaaaatcttttcctacatctgggccggcccgtcctcaggacgtacacgttctgccgtttgcgatcggtgtctgccgtttgcacgaatgaagcaggcctaacattcttcttccgagagacgtggaattatgaaggaataagttcatctgaagtctcttaacttgtcaacgaatccgattttcgtcctccaaccgaaaaatcagatacaacaagtccctcaactgtcaaaaccagtgcagataaggttcctcagcggttttagctgacgtgacgcctacgtggctaatctgactcggtctccatttgatgtgacactgacgtggcgtttacgtggcaatttgatctaagaaaaacaataaacctcgtgggacccacatgtcagtttcacacataaattaataaaaatggtggggcccatgtgggccccaggtgtcattctcacccatcctcttcttcctcctctttccctatctcccctctcttcctgtctctcctctctctctctcaggcgtgacggagagggagcggcgcgcgccggcgccgacgggagaggatgccgtcgccgcccatggcgaggatgccgtcgaggtcggagggcggcgtggaggacggtggaaacgggggcgggggccgcgatggtgagggcacgacggattcgggccaccacgcctgtcccctccggccaccacggcggcggcacgcccttctcaagcagaaagcggcgctgcggcgggtcgcagtgctgcatgagcgccgagagcaacgaacccagcgtggtgtcctgcagctcgtgcaggaagtgcggccctgccggcgcggcgccgccgacgttgccgtcgcaccccggcacggcattgtcgccaacaaattgtcagcctggtacttgacgatggcggccgggccgttgcggtcgaagcggaccttctccttccaccaggagcggaggttgtcggaggcgctgctcaccggcttgcccttctccgggatgatgccgtacacgaacccctgcgcgttgcacacctccatcatcttgagcatgtacttgaggatcccgtcttgctcctacgactgctgctgctgctcatgcaagctccgccggcgggaggtgaagagaggggagatggggagaggagaggggagagagatgaagagaggggagaggggaggaggaagaagaggagggatgagcaccacggcgatgttgagcaccacgagtccacgacgaggacccccatgaagaagccgaagctgagcacggcggacctcgacacgcggagtatctgcttgactgcttgccggaggcatctagtagccctgcaaattaattaatcagcagacgaagataattaatactcctagctaggtacgtacgttgtcgacgaagaccgttccgaagttgccgacgatgttgatgatgccgaagacgagtccccccgagctgagcatggcgaggtaggagcccttgaagttgccggcgacggggccacacgcctggccgttgcgcgagaggtcggcggagcagtcgcgagcggcgctagctggcgacggccatgaggcggtcatacaccacacgcgggctggcgagtgtgtagacgacgacgccgagcgggatgaggaagctggcggcttagatgtctactccggtgaggccgttgacgacggcggagccgccgaggaggagcatggcggcgtggcgcagaggagagggggagagaggaggggtaagaatgacatcccgcgtgggccccacatttattaaactaatgtgtgttaaactgacaggtgggtcccacgaggtttattgccccgtaagcgccacgtcaatgccacatcagatggagaccgagtcaaattagccacgtaggcaccacgtcagccaaaaccgccatccaaaccgtcgagggatctcatctgcactggtttttgatagttgagggatggattgtatgttgttttacggttgaaggacgaaaatcagattcattgacaagttaagggatctcagatgaacttattctaattatgaacacaagtccaaatgggcttatattactggattgttttgttcagggagagaaaagcccaaatcgagagtgcgtagcgcagcgaggaacgtgttacgtggtcgggacaccggagaacccaatgcagccagccaggcagatcgacgaaaatctcgaccatggacgggcgtcgtttccggcggatcggtgtccggttctcagcatcccattccattcgatgtgtgtcctaactcgatcgtgatctctttgctacagcaacacaatccaaaaaaggccctaggatgacgctgatgcttcgtacgcgatggaactacactagagtagtccactcgtgtcggagcacttcccgggtggatagcatacgatcgatgttccattacgtactattgtgcggcacagctaatgattgtacatgtatgaagtactttcttagcaaaatttgttcatagatactttcaaaaattttggtgttggctaggggacaccgttaaagcaaaaaaaaacttggctctttctttttactatataattcctccgtctttaaatataagggattttttcttccagattcgttatattatgatatgtcacatccaaccaaaagtccaaaatcccttatatttagagacgaagggagtagttcaaaacttatccatgttcgctacgtctatcacttcatctaagccacatagttcaacacgtcatctgtcaccccatgtgaacaaatcatcgagcagctgccgtcctcgcaccacggctcgactaactgccaccgccaccgcccaaggcagaatcttgcaagctcgacaacgccatcgcccatgtcttctcccactccactcggtgccactgctgcttcacttgggccgcactgcctttgctccgctcagtgtctcaacttcatccgccagtggggaaaggtagagagaagagagaggggagatgaaaagtgagaggagaactacactgtggagcatgtatcctttcaggggcttaggactaaccaacaaccaatactcggcaagtgcggtatctacactgctatcatcctaacagggtaaattcgaggtggcgaccggtgagcctcaccaataaaagcttatgcgtgggcagcccgagtatttttgtcatgcattaccattagcacgtgtcaatgggagcaaattaaattgggagtaaggtgagaaaattattagaaagatgtgagaagtaaaaaggatcatacattctaagggttttcacaaatagcttaagttgatttttttttcaaactattttcaaatcgtcaagccaagctttagcttacaattagcattgctatgataccaactgctgtgggcaccacacgtaatatattgtccagtgcttatcgtgactaacacatgtatttggatctacgtgtgttggtcatgttggacacactggacgatatattacttgggatgcccacattacgtctttgctgcgatcccctcttaaggttgtgttctttagggcctgtttggtacaactccaactcctaaatttaactctaggagttaggtctggagtggagttgtggagctgtctaaacccagctctacaactttcattttgtgagagagctccacccagctccactcctagttttgatggagctgaaactgtttggctgagctctagctccagaaggggtggagctggagctatgacaaacaggcccttagttacccctgctgcagcgccggtgcaagctattggattcatccgctatgctgactcaagcgggctagcatccccttgcagcccgtgctgcccagcgttgttttgtatcccatcatcatcgtaagctcagtcagggactcaggccctgtttctttcagcttaagattattataatctatattattgagtcatattactataagctagattgttataatctgtagtagaataagcggttagttgtttcttttctaaattattagagcctagattattgggtttgcaagtctaaaaagggagtggggtggcatggtgggtaatttttcacccaataatctggaaaaagctcacctaaatgagcttatcggattataataagctggactccagattataataagctacttcaataagttgtttgtttctttcagcttactcctaataatctggattataataattctaagctgaaagaaacagggcctcagggtcatgacgccatccatactctgagctatagatgaaccgagtggtactgaggtcatttgataatgtttctgtgtccaaaatagcaggaaataatataacaacgtgtgccataatcgatggcaaataatcagaattttggagcgtttacgaacaaaataagttttgcgaaattctcaaatatcgtttagcttttttttccctttttttgcgtgctttctgtggtcaaatttggagtgccaactatacatcagttgggctgatcctcactctacctgaaaatcattggtccacccagaacgaatcttggctgcaaagttggaaaaaagacgtttgaggctcgttagctactcgagcttggtcgttacatgctttgattcgctcgagcctgctctgaagcttgcgagctctgaccagccaagctcgagctgttcgccaatagcccctctcatctaggctcttttattgtccgttggctttgattcttcatgttaggtttagtcccatatcaataattgataatgataaaatataacttaaaagatgaaaataattgtcacctatcaaattagtattttagcctgtctaaagttatgaatccggttaattctacaataaaaaatatccaatatgttctgagtggtccatggtacactccactttcctcatgttcacatgttgttggatggtctgatagctaggactagctcctccaacccactcggtgcaccatttcttgttatttttgtaaaaagaaaaaaaaacactagttacactagttgttaacaaaatagaccttcggtagcatatttatggcttattcgtatggccacttcatccggctcaaagcggttcgaataaatgtatggtctttgaagaaaatcgattagggtatattttaaaatttcattctacttttgagc

SEQ ID NO: 3347 - DNA, 12620 bp, Oryza sativa
aggcccaaagaaaatgtgcaataggaatgtccaaaaccctagtagacttggtcaatcagtccccttcccctcattctcgatagatccagattcggcatcggcaacagccgcccgtgcgccgcctgagccgtctgcgccgcctccgcacatcccacgccgctccctccatcctgagccgcctgcgcactccctccatcctgcttcgccgtcgcccgtccagcgtccagtggccgacgctcgctgcttgccggttcatgcccaggaaccagatggccggtccccaactgcggagctacccacgccgtgatgctcactggtcgctgtcggcctctcgatgagcaacccatgccgagtgtccctgtgcatcacggaggaggaagacgaggtgcagccgtgtaggtgtaacgtactaacatcctcctgtgatttgttcaactgatgattcatttgttgaacacttgactctgtgattcgttgcctcattactttgatacttagatacagttgcatacttggatttgaacgctggtttgataatctgaatttttattgcaaactttttggttttgttgtattggctcgcgagctgaacgagctagctcaagctagccgagctgatccagtcttctagctcgttagaataacgagctggcttggcttgttatcctagcaagccagaccgagccgagccggctcgatatccacccctatgtgggcttggtcgagatcggctcgttttagcccctgacgatagtaaaacaagggatcggtcggcggctcgcgaagcgaaagaaggaggaggcagttttcaattttcacacgactgcagcgccccaccctttcctactctttttatttccccacttgtcttcccccgtgcggcgccacacctcttctcatcttctcctcctatcaactccctctctctccaccgctccgcttgcctcggatcgcgctcgcgctcgcgcggagcagcgcccccaacgacgggcatggccggtgacagcggcaacagcgacggcggtagcaaccgggatgaggaggtccagatacagatcgcaggtcaatcaaatctttcccccccttcctctgtcgaaagcctcactgtttagctatgtccgattttcttcgttgagggagtgggggtgaggaggttagagtcgtcttgcgatgggcggcggtaaacgcagatgaaatgaactcgttcgttctctcgggcttatttggtgttcgatggtgtggggaagtaagcccgcgaggtgttcgatgaattgccttctcgtgcgtggcgtgttggatatggccatatgcccatatgggatttgttttttgtttatagaccatattaacttttcagactatcgtgacatcatcgagtggcagagtaggcatgtgagtttaattggcaaacccctgttgttcgcgtacatgagctggataagtggttgatgatagcaccagctatagtaatgcactgcatttaacaaaagtaaaatctttatattagtttttttatattagtgcaggatttccctgagattccaagtaactcgctttcatttgatagtttcaccaatggacaatactgtaaggatggagctatagtcttgtgttgctcgactttctctcaataaatttagagcttttggggtttatatggccaattgttggggggaaaaaaaggagaggagggtttcacttcactatgggaactttggtagtctattttgaataggaaaagaaagtttcagttggccgtgctatgcttaacacatgaagtttgggctaacctgttgatactgcctaccttctgtaacttgcagattcatccaaagctgcaacttcgtcaactcatgaagtacctatacagaactctcctgtcaagagttggcaatggtggctgatggtgggagttaacatgttcttcctcattgccggtcagaccgcatctacacttcttgggaggttctactacaatcaaggcggcaatagcaagtggatgtccacattcgtccaaactgctggctttccgattttgttcattgccctatttcttttccattcaaagacatcttctacacaaacagtcactagtagtcctgcccctacaatttctatccccaaaattactctgatatatgttgtcctgggcctcatcattgctgcagacgacttgatgtattcctatggcctactatatcttccggtctcaacatattcgctcatctgtgctagtcagcttgccttcaatgctgtcttctcatatttcctcaatgctcaaaaattcacccctctgattttcaattccgtagtcctccttacgttttctgcttcactccttggagttgatgaagattctcagggaactactagtatatcacatgggaagtacattttgggtttcctgttgacactaggggcatcagctacatactcgctcattctctccctgatgcaagtcacatttgagaaggttattaagagggagaccttctcagttgtgttgaacatgcagatatatacagctctcgtggcaacattggcttctcttgttgggttatttgcaagtggtgaatggatgactttacaaggagagatgcatgcattccagtctgggaagctgtcatatgtaatgacactgctgtggacggctatatcttggcaggtagcatcagttggagtggtgggattgatctttgtggtgtcatcgctgttttcaaatgtgataagcaccctagctctacccatcattcctgtttttgctgtgattttctttcatgacaagatggatggagtaaagattatagctatgctgatggccatttggggatttatgtcatatggccaccaattatatgttgatggcaagaaaggtagaaagactacagtcagtgtagaggaaacttcctaatcatcacaatgttgcctagaatgccgctcttaccaatttaagttgttggttctgagtaaggtactgtagttattaggaacctcatcaaagaaattccatttttgcaccatttggtatataactatacatattgtcttgattactctgatgtaaggatgtatcaagcaagagaataaattttatgtcacccccaattttccttgtcctgtggagtagtcaagtcgatattgtggttgtgatttttggcacgcttggcaagttgatactgtgccattattgggtttgattcaagtgtatacagtcgaatgcaggttcaaatatatgttatcagtgtctatgtgtatgtcaaacatccagattggatggttatcacaatgacttacttggtgatgaaatccaatcataagagggcgacgacgctcgatctgctgatagctctggccggctcataaaaatattaggagaattgaaattgagcaggcgaaagcaatgggacaagaatcagccaaagacgccgccatactgtaacgccaccaggagttagctcgccaaccaacagcttcaccgcatctccttgattttttttctcgcgtctaatttgtgaacaaaactcggaacgggacggccacgacggtgacggacgcccaaacgggcaacctatgatgaccaattttgctatatatttgtcgacaaattttctcttaaaaatttaacactataacttatatgtaattacactataactataatataacttataatataacttgtatgtaactttcaaaaatctctccataacatattattttggtaaaataaaggttgtgggaacaattttttttcagatatgtgtgtactgtgatttttttttcttcctcaccaaaacaaatctttataatagatctaataatttaaaattacgtgaaacttacatgcaagttacagtgtaattacatacaaattacagtgtaattacactacgattgtactgtaattacatctgtcaaatttttagaagaaaatttgtcgacaaatgtataggtggtcccatgatgactgctgaggtagagtgggccatatacgggtcgaatcttcttcgttgcttttgcacgagcgatcacattcggcccattgagccagtcagccagaggaataagttcaccggagatccctcaacttaacaacgagattttttgagatcccttaaccacaaaaccagaaatctctacccctaaactatacaaaaccgttcactcaaggtccctaggcagtatatatgggtggtttcactgacgtggcatactagtcagaaaaaaaaaattatacgtgagggccacatgtcagctgcacattccttcccttctcttatccttctcctcttttctctcttctctcttctcttcttcttcagtgagggatctaggccggcggccggtgggcggagcggcagcgggccggcggtggacgagcgcgccggggcggcgaggagaatggcggagaaggcgagtgaggcgggcggcgaccttgctcccgttcgcgtgcgtggagttcttccgaccttgctctcgtccggcggtgcgtccagggcgcgcccggcgccgtggagttcctcttgtccgtcgtcaaggggcagcacgccaccaccgtggacaagacgacgtccacaccgctggttcgttctttctaggaagagacgacgtgcggcgtgcaggattcggcgaaggtgagctcgccggaggaggcggctttgagcatcctgcatgcttcagctctcctccttcgcctgcttccgcgccgaccccactgacgacgacttcatcacgccattcccatacgcgtcccacccgccgccctcgtctcctcagccattgccgccgctggagcttgagctggtcgtagtagagcgcggtcagcacctcctaaccacaaaaccgttagtggtgtgcatgcatagcttagttagctgattagttagagttagtcaatacatgcatgtgttgcatgagttgtgtggcagttagcttcgtgtatgcggctagctagtggctgccaaattaagtggatcgcgtgctgcgtgcgcgtacgatgtggccgaagtttgtgttcttagctataaaagtcatgtaatctcggcttccggcttccggctccggccgttcacgccgcccgaagatgatgcggcgcacgttgtcgacgttctggacgcgctcaccggcgccgtcgagcgcgatggtcagcaggtcacccgcggtggcctgctcgagcaccgccgccacgcgcgcggggctccaggtcgcggcacgtattgggagccagcaagagatgacgccggcgaaaccacccaccgctccacccgccacccgctgaccgctccccgccgccggcctccctcaccgaagaagagaagagagaagagagaaaagagaagagaagaggaataacagagaagaaaaaaatatgtacggctgacatgtggaccccacgtattcttttaattgtttttgctgactatgatgccacgtcaacaaaatcacccatatatactgcctagggaccttgagtgaacttattcctcagccagactgctcccaaaaaccagaattcccacgcggccactctgaaagaggactcgcaggaaaattgggaaaaagtatattgaatgtccctcatcttgtcatcagattacaaaattgtccattaaccgcaaaaccgggtcactcggggtgtttaggcagttttgacaccggtttcatctgacgtggcaattaagccagcgtagcacctacgtgggccccatatgtcaatgaaacatcccttctttttctttccccctctcccgtctcttccccatcctcgcgtccgcactccagagtggcgcaacgggcagcggcgagcggccgctaacccacggaccccgacgacggcgtggacgatgggcggcggcgacaagctccattcctcgctcccctcctctagctccctcttcctcggcgtccccggccccttcccttctctccaaacgatcttgaggaggagcagcggcggcaacctccccgctgccatggaccctgacgatggggcgagcggcggctgacgagctccatgtgcacccctcctccacctcctcccatagtgcccccgccccttctctcccgtcgatcttgaggaggagcgcgtggtgacggacctgggactctctgcgtttgtccacagttacgccgcctaccttgacgaccggctcgagatccgcctcctcctcccaccaccgcgctcgactctggccccgcgccgcgccgttcctcgtcatcgacagcctctcccgcatccacggcatcggggagacgctgctcatcgtcaaccacgacagcgccgccgcggtttgtccgggacaggcgcgccgcgacggtggcgttggagtagacgggcagctggccctccctatgctcccccttcgccttcccccatgctcccgccgtcgccaccgccggctgtcgcgcctcctctcctgcctcgccccgccggcctcctccccaccaggcgcccccctgcccaaacgagaagaatagtgagagagaggaggaggtgagaaaagaggggaaagagagaggtgatgacgtggatagtctaacaggatgggttcatgtggtcccacgctgattcagatactacgtcggacgaaaccggggtcaaaaccgcttaaggattcagagttagccggttttgtaagataaggtatgttatatatctgttgtttttgcggttaagggatgattttgttatccgatgactaagttgagggaccttcggtgtactttttcctaggaaaagccactcttgagctttactgtgcggctgaacggcccatttggcagaaggcccaagtggctcgtgtgttctacgcaatagttaggcccttgtacaaaactagagaaaattctgaatttctgacgaatatatgtgcgtgtagagcagttaaccatgaagttggtattccctgatgagtttgcacgacccgtcaagaacagatatcgatcacaactcacaagcttttccggcccgtccaagaaatattgcagtctttccgttaagaataagaagaagaagaagaagaagaagaagaagaagaagaaatgttgcagtactgcagaaatcaccaagcacagcgtaaggattctgtctcaccgaactgtccgtccattttgcagtacaagactacatagtttgcagaaacggagaaaccaactggaccgctgccaccgaaaatggagaatctatgacataaatactctcaacagccagtttcgtagatcgtgcttgggtcatcgccatgcgctggcgcgtcagcaagaaggttaagtgcaactccatttgtggtacttatcatggatggtcctaatacagttctccatttaagggcttgttttgttgtgaacgcatcaattagcgacgcatgtgcttgaaatactttgctcatctattgcgttcatacgtacatcatcaacttaacaactgtaaccagacgcatttatcctcgaggttggtggaatggcgaccatcaccgtacctgtccctggagatgaagtactccgtacatcaaacgccagaagattcttctactccacggaagcttcaatcggcctcacacagtgctggatcagtagccttgccgtgcatgcaaccaggctagctttcacggttccatgagcaattgagcacgcaaaattagcccacgatgctgccatgcttaggatctcaattaccaggtcgcaagaaaaaaatcattctgagtaggcggtttcatgttgtcctggaagtacaaaaacaaaaacagaagagcaaaacgtgtttttcattctccaggagagcaacgatcgatcgagccacggtgtagacaatgtcccaaattaaaagagagttgcgtgacgtcctacgatttttccctggctcccaacaaacgcttgatccgtcattcaatcaattgcgtaatcacgctcgctcgggacctgaagtttgttgcgcgttggcgacgaggcacttgaccagcagcaggccacagcccacaggggcaagtccatgtccatccttcgccgcaaagcagagcaaaaggggagcagcagcagcagccagacagccagccagccaacagacaccgggaccggagagatcgaccgatcgatcgaccaggtcaggcgtggtgtgccccggccgacaagaggctctggctcggttcaccgctcggcaaacgcaagcccgggggcacgggccgccaccggcgcagtcagccaaaacgcacgcagaaacgcgatccaaccaccgcccgatcgaggcgcgcagaaaaggcggagcggatggcgaaacgagagggttacgcactagtacgcgcggctgcgtcctggagcgcgggtcaaccgtacgtgacgccgcactagctagcgagtgctcggctcatcatcacacgcgcccccaccagccaccacccaccacaccgccggtgaatgcgtgtgccacccatcgatcgggcgcgccgtctgccgttcacatccaccgcaccgcgagggccgcggctgacctgagcttaacgcctctcggggtgaggattatgcgcattaggcaagcttgttcccgaagcgacaggcaggtagcggacggcagcgtcctgggcgggccagtggtgccgaaatgcaagccatgattgcacacttcttgcgggtttctattgctttctggtgtgtgctggaaatgtatgcatgctgatttttatttttcgttgccaatgctaggctgcctcctttttatcgataaaggaagagagtttatttctagaaaaaaaaggggacttaagcatattccctcggcaataggtgatctataagcttccatgttctggacttctgaccaggcaccaaaatctgtgatcttcgttttatctttgctactatcacaataggatttataagttaaaagagtcgggcatttcgcacttttcaaatttactagctcaccatttggatcaacgagtgaagcgggctctttgaagctcaagtgtctgtgcaagggacactctcctcttatccaccatgctcattactctctgtgttttatattacaagacgtttaacttttttctagttaattttttctttaaatttaatcaagtttatagaaatgtatagtaatattttcaaaacaaagcaaaaatattatcaaaatatatttaatgctagatttaatgaagctaatttgatattttaaattttattgattttttctactaacttagttaaacttaataaaatttgaatatgaaaaaaattcaaacgacatataatattatgacagagggagtatgtcccgttgatctattcttaggtttactagcgcccacatcgctatcatcctccaaattctctgggagaaccgagtctcttccattctcatcctccaaaacagttgggagaagaagaagaaaagccttgattgtttgatcgtggttttatgagctgtgaaaaagctaacctacgcaataatgataatttatatacaaaattatattttaagcaaagaaagccaatgcagaaaaaataaatgaaagaaatcaacttaaatttaagttatacggggtaaaagtctaacttttgctgcaactgataatacgacaagcagatttccatgggaggcgtcattaaaaggacttactgctagcattttacataatcaaattgcgctccctccttccaaataaattactatgagaataggcttatttcatattttggttttttcaaataagttggccatatttgtagtttccatgtacttaagatttaaatgaaaagataaattaaatgtttaatcaaaacatgagaaatcatcttaatattcattggttgcatgcgtatatatgctatttaatttttgttatatgaaagatagattatttttttccttaatcctcagtataaaaataatatgtctaacccttttgatggggggagtactttgcaagtacggttgtggagagaacatatgcaggttgactttttacatattgcttgcacgaagagggttgacttggcaactgcccagtggcatggctcttttgctcttttgacatcatgattattagtactagtagtattcatagaacatactccttccgttctaaaaaagataaatctttggtttccgtgtccaacgtttaactgtcagtcttatatgaaatttttttataattagtattttcattgttgttagatgataaaacataattaatactttatgcgtgacttatctttttaattttttttataattttttttaaataagacatacggttaaacgttgtatacgaaaacccaggttttgattaatactttatacgtgacttatctttttatttttttatttttttttgatggagggagtagagtccgatagaaaaggcgaaatacgttgaaaacaaggagccgaaggcgaatcaaaactctgcctgcactgccgctacaattccagtgatgatgcaaagctcacgttagattagcaggagtaacattcaaaaaattatatatttttctaccggctccactggataatactactatatgatccagggctaattcaaacagagagaaaaatattagcacagcaattgaaaagtccaaccttctattttaattaacagaaagtgtaacgggtgatcttaacaagagtgagccacatctcccaaataatatatttgcttagtgaagtaggagtactagctactggtttgatgttgtttattagcagcaactcctgtactttggtatgttgatggtaccatgagcaaaaacaaaaggatgaatcctaccaaagagctggaagattggagtatataaagttaaacaaacaaataacttgttgcaccaggagaaagtaagaaaataatgcatgcaactaaagagctggagagagtgggacagcatgtaaagcacaaaatgtagcatcggagtgaatttctattcacaactttgcagttgcatgttataatttgtaccgaaaccttaagaggaatctatcaaaacacaaaatgttgcagtattaagctagctaggagaatccaaacactaaacagtgcatgttaacagttaacacgtcataatcagccaccagtcacaacactgcccacacgaatacaacatcatcatcatcacatatgcacatcgtgggcagcccacaagtcgccagcaagacctgaaatgacctgaaatgaatacaaagaatcataccaaatcatctaaatcgatatcaactttcgtataatcgaaggaaattatgctcgctaataacaggacgtactcataacgaatactatgtttgtttgtgtacatcttccaccgtgccatcaagaaaacgaatactacaatctcatgatgtttgtctattgtcacggtagtcaaggcctcaaatcagaatgtagttatcgcaatgattccactctctaacactgattaattgatttgaaagggatgaattaaagtggttgcatcgtgtcatgctagtagaggaatgcatgttctttcccccccccatcaagtttttctaagatttagcagcgtatttttggcctgtgcgcaccgtgttgcacagagcgcttcaaatatgttgttttttccccatctgtacgtggtaactgtgcaaaaaatggaatgagcagatactattaacttcggtatgcacaaagaggttgagaccatttaattagtatggtttggtgcaccagaaaagggagtaatggaggcagaggcagccatcgcccataaatacgctgcctgcctccatgtgaaagctctgaccaaatgaattgaattgatgctatttcatggagtattcatagaccattggatcagattcagaattcatttcagacacaaaacaatcaagaaccttcttttaatccctgtgcacaaagccacatacactcctatccccctctactcagatccctctcactcataaatccagcatttaatcctgtgtacaaacgacctgtaccgtgcagtccatgcacatcaacaagtccactcattcttaaacccaagcatcaaagaaaaaaaaaagaaactaaggttaattaacaattttgcaaatcaagattagacaactagctgtacaaacaaacaagcagctcttacagtaatggtcggctgacgagcagtagtaacctatatgtcaacgaagtggtttggagttgggagtataaaatcttatagagacttttcatggatggacaaaatgcgagtaagaaaggagaagaaaaatctaaaaaggatggtaattgggattaggtggtgataagcggtgaagagaagatgaaaaaggtgaaaaagaaaacgtgaaaagatcaccggaagcgtccgccgtcggcgagcttcctggagcggcaccgagtaatggaggcggcggaggagaggttgtggagcggcgatggccgtagctcgcaggagaaggtgcctgggtcgggcggatgggcgtggcggtggcggcgcccggggctgggccgcacgagagggctgaggcagacggcgaagcccgatggcatggtgctggtttggcgccgccggcatggggtcctccgcatcggtgaaggagatggctgccatgggggatcagtcggcgagctgctctcctcgtcgctgccgtcgcagtcccgctccggcgagagcccacg

SEQ ID NO: 3348 - DNA, 5549 bp, Oryza sativa
gcgtggcgctgacggagaacttccccgcgcgccgcttctcgtacccgatgtccccctcctcgagcccgccgctgctgccgtaggcggggccgacctgcggcgtccggaagaagaggaggctgggatgatgcttaagcgcgccgccgcccgaggaatccgacttcctgcgggacacgtacggcgacaccgacctcgggaacgccggcgccgccgcggccggtggcgcagccggaggaggaggcgacgacgacgccccgttctgcgcggcggcgagcgcgagcaggcggtcgttgaggcacgtggcgcagacgccgccgcccgcctggtacgggtgcttcttgcacctcatccccatctcatcgactcatctcgccgccgtcgccgccgccgccgccgcgcgctccggccacgaggaaggagcaatctacaacggcgcacgcgcacctgccttccttcttccccttcccttcccttgaaatttgggcgagttttttaaaacggagattggtgcgcgttttggcgaggggatttttttttcctcttttttttcggtccgcgacgctgcgtccgcgggcttaaataagcttcggcgaaacgaagggcttaccaagtgcaggggggacggagtaaatggtggccttgactacgcttttgggcgaattttggtttgattgcggttgcttttctattcgtgtttgtgagacttgcgagtagagtagaatagtagtagatgcagatgtatagtagtagtactagttgagatagatttggcacgggaccatgcttggatttggttgcggtggtgcggcggctgagcacacatgcacaccgttgagagcgagacatacatgttcgtttttatcggctaatctttgaaaagtgtattttgggtttggcctatctacacgagtcatcttaaagggattccttatcttaattaatccagggagatgctctactgttattgaacaaatgctgccactccactagctagcatcccacaaattgttgcttggccattcggcctacttttcaggttcttcctctctgaagcctataaacccaagccgtggacttcccagacctctcgattctcagccttgcttacggcccttttttccttgtcatgatctggtgtaggtgatttggtttatggttcaaccaaaagcgaagaattgtctcgttaaaccatacgctccagtgtgtcgctgaggtctagacacgtcggtatttatacaccatataatttacagttaattgcacagtgggccacttatgtttaccaaggttgcaacttggactagggagaagaaaatattttcactttgatttagataagtttgcaaaatgattcactttgtaccacttccctctccagctctctcatcactttcttctctacaatctaggaaacttggtgagctcgtgaaggcagcagcacgcggctcaaattcttaatgcatcagatcagcatgagcatgattcaactactaccaatacaggatctgctagctaggtgctcgcttcttgcgttgattatgggaactgggagcctgggagatccttgagcttcacgtcaggtagagggcacggcccggaggagatgctccttggcgatgagcagtaggcgctcgtcgtagcctccgcaaattggggacattccccggtgcagttcaccaaagcatcaactatgcttgctccaatgcttcacgatacgcagtgcatggcagaatgtgtaggtcgagcagagcgcgtacggcaccagcagaaatcgagctcgagcagcaatatatggacggcaacgtactagtggaggcatgcgttcttgaacattttgtgtgtgtatatccttctcatctccttcctccgttgagcctgctctcatctctgcttcctcgtcgaccacaagtagctggccgtgattagggaggagaggagaggaagaacactatttgatattgatgtgtgggccactggttaaaaatgcaaagttcagtaataaaacccggtcaaaagtgaaaagatctgctgatagctggtccaatttacaacttgggtaataaaacctgccctaaagtgcaattcactctataatttatcctcaagtgattacgttgctgactgtgatctctcaggtaaaaaaaaaaaggcccgaccaaaatccattcggagggcgtgaaatcgatagcaaattagcaagtactcgtactatacgtacttaataacgccttgcacgaaccgcatgcaccacacgtataaaccagctcgtcactttctcgggtaatatataatcgcgttccagaagacgtttgcgctcatcctgagccgtactatccattcatccactctcagctttggcacggatgcagtgcaccaaaagttatggaaaagagcaactttcaccgcacttaattagcacagtagaagcttcccgtttacactgatgcttagtcattagtcactcgagaaaggacccggtaaaacagaaagatctcaagacgtacgagcgcgactttgccggtgtcgatcggttttaatttggtcgctgatcgatcacgccgagatggcctctcgccgcgccatgacggagtgggacggagatggactgttcgttcgtctagagaaagagcacagggcgtagctactggtcggttgattgatcgcgcgatcgatggagaccgactcgagagaccgggccggcgcgcgagcgaggaggcaagcgaagcgcgcgcggatgcagccatcgatcggcgaccgcgcgcgcgcgcgtacgcgtcacgtcgcgctcgtggagaagctggcgctgctggcgatggcgctgtccgggtttcttgtgctcgcgccgcgcgggttcgtggaatcacggtgggattgcggcgtcacgagggaaaatatagtgaaaaacgcgcggttgattttgtcgcgggggggaactgtgcaagtgggtagaaagatcagaacggcgacaattctatcgtcttctggagggagaagtgtaaggatacgtccgtttctaacctgttcatggaagtggtcattgtcgagatggattgggattagtccatcctgcttaataataatgtaaaagaagctaacctacttgccattcagcaagcaaccaagtatcacacgcctcggatatattgctagtggtttcattagggtctatatgtttgattttattttttctgatctaaagcatttggctgcgtttgtccaactcacgtcgcaaaggaagctgacgagatagtggaagcgtcatcatcattgcacttaaactactcgtgtctggtttacttgtacactcacgatgaaaattaaggaaagataccgtcaggttcatcgttttcatctcatcgatatatatatatatatatgagatttcggcaatgctgtcgtacgtgtcgtgccgacgccacgcgtcgcagtcgcatctaattcacacagggctgattaacgattgaccaggtagcttcttgctgatcaaataccagaagcgacaggaagggcaacattatcttcttctgcttaatactcttagcttaaacgtcacgactcagcccgatcatctgtagcactatttctgctagtaattaacttttgctttctagtactattaaccatcatgatccgcgcccctttcgcggggtcaagcctgaaagctccacgtaccccccgccaccgtgtgctagcttttttctctcccactcttccatatgcacctatatatccatttcccccttcacaagggcgccgtgaaacggatgaatatacgaggacttgtcgtgccatcctgccaaatcgacgtccgccgcgggctcgcgccgcgcgcgggacggacgggacatcgcctcgcgcccgttcgccgcgttgcgcttgcgctttgctcgtgaaacggccgtgcggcagggtgggggcgcgcaggtgcaagcggccgtgggcggtgggctctctagcatcggcaaaaaacgggtggcggctacgtcccttgtcccaggtggcccaactgaacggggagctagttttggacgaaaaattgttcgagaggcttgggctcgcgataagatgggccgagacaccagtgctgcaagccggccacagccaggggccaatagcccactactgcggggaccgttaatgcgcgggtccacacccctctcccctatacgtctttctcctcccccttcctcctccccttatccaaattcatttgcacttaataaataccagcttctgccatagtggaacggaggcgcgtcgccatatatatacctcttgtaagccgccgtgcggcgttgtaacctcaccccagatatagtgaagatattttgctggctagcgtccgtggtttttctctcctactttgggagggttttccacgttaaaatctcgtgtcttctgtgattaatctattattctttatcttttgtttgcctatcatttcctaacaccttcttctcttccctactatagtacaccacaaaattattttgaaaaaacaaaagttagaaaaatttatgtaaagaaatattatatataaatatttgaatttaaatttaaatttgaatcaggtatgtaaacttttgacttataaactttggatctataaactttaggtgtataaactttagatgtatagaaatactatatattagaaaacatttgaattcaaattcaaaattaaatcagatataattcaaatttaaatttgaaacgggtatataaactttaggtttataaactttagatgtatagaaatactatatataaaaaatatttgaattcaaattcaaatttgaatcggatatataaacttttgacttataaatttttgctctctacactttagatgtgtaaacttgaggtgtataaactttatatgcataaatttactaaaatagaaaagtaatgtggtgaaaaaaaaagaaaccaggtgaagaaagatggaactgatcgcaaccagttggtcctgtcgatcgatcgcgaatcagcctttccgcactactactagcaatttgcagtttgatggcgctcggcaggcacacgcacaacaggaggactgaacaagtggtggctctctctacttctctagatgaaacgaaaagtttccagctcagtttgtagtgcccatcgtgtcgattggagttcctgccactgtgaagctttttattcgatcgcaactaggacgagtgtcaagctctgattgattgcagcaactaggagtataggacgagtgtcgatatttgattcgattgcaactaggaagtgccagtaacgtgccagcctctgaaccacacgaagctcagttgaatcagtcccaactccagtttcccatgacttggctctagatggttaccgaaaggtcgccagacaaaacttgattattacacactgatgctgtaagtacgtaccttgagagcaaaaaaaagttgcaactactcctgattcctgaaggatacgtaagtggtgacaacttgtgctcaaaccatgggtcaaatggatccaaaactgcttcgttaatagcacttggttgaagaaacatgcttata

SEQ ID NO: 3349 - DNA, 5874 bp, Oryza sativa
tgctacaaactgactgactagccaaataaatacaaattatcttttcagtcttaaaaatgtgcaatgggcaatgggacattgtagttgatctaagaacattttgataagagttatggatgtatgtactagtcattggttattggttagttcttacacaagtgatatggtataccctctaatattcaggaattcaagatttcaagtcccagtgccgacgtatactttcaacatcatcttctaaggaagaaaaaaagtatgacgagtactaatttaagtcaataatagcttccttagtcaatagagtagttgttaagtccgatgaagttatattgctggataatcaggtgacagtactagcagatcatgcaataatataatccaaagtgaaaaccattcgtatgtaccacctcatctcggttcttttaataacaacttccacatttagaacgtatataagggcataagaactgatcagcagcaaacagaacccaccatatcacaaccacgacttccctttcgagtaagcatactacctgcttatcatttatatgtcaggctcatttgaaaacatttcatttccttgatatagtttgttttaaattttgatgcatttcagttaatcttggaaagtatgcttttcttctatgttatgaaacacacaccgtcttgtggagtttgtgtgactacttgttttctgaaagaatatgctcagactggcatctagcagcatacatgtgttttctgactattttatgttcaaccatatgatacaaatgggaaaaggttcaaggctcaaatgataaaagctttaattactccatcctttgtattgtgagcatctctttaaatacgtagtgcattggatgcatagaatatactctacagataactctcaggaactagttattcttactgtctactctctccgtcctataatataagggattttaagattttgcttgcaacgtttgaccactcgtcttattcaaatttttttaaaattattatttattttatctgtgacttactttattatctacagtactttaagtgtgactttttgttttttatatttgcaaaaaaaatttaaataagacgagtggtcaaacgttgcaaataaaaactcaaaatcccttatattatgggacggagggagtaattatttgaatttgtgccgctcacagatttgaaccctcaaaagataattcaagccgtcagcaaatggggcaaacggtaaaatttggaagagttcctttcaaggttggcttctcacattcacagtcccgcccaaaggtgagcctttttgttcttttcaatgtcacgataaactcattcaaacagaaatacaattacagagacatcataatcaaaattcctggaatagttactgcttttaattagttcattggtcgatgataagagagatttaaagaaatataagcacgtaaggtagataatttactaatttaatgtaaatgattgatcatgcttcacagcaggaccgatggcaaggaaaatcgagcgagcaaagaagcatcgaatcatacaacaaaattccagaatttccaaattgtcacaagctagaggaaccagaggacaatcaacaaacagcactgcttctatctggatcccagaacctgtcttcccccgatatttttcagctgctatctgtggatgtatgtataccaacacaacttaattactctactatgcatttaacttttcaagaatcatttaacttaaagtacaggccatagtcatcctaactatttgtttgggatcattcatgctgatttagaccgattcagaaactgaataaatttttgacatatatttcatccattagatataatatacactccataataccagtgtactttaattaacagaacattatgcactaaagtactaatgatgtgcattatactgtacacatttcagtttgtatcatacctttaaaaatacatattgctgaaacatgtgcgtttcatttatttcaaaagtaactagctgggtggcctgcgcaattgcgcggctagcacccaaacaaaatcatatatttttcagtatgattttacttaagatttattaaatagctatacttgtatttctaattatatagtttttaaaagtcacaccagctgctaccctttacttctgtcatatccttcttttgtttcctcggtctaccactatttctattcattctccttgaaacctctaaaaattggatcttatagttttttgagtttattatctcgttgggtttcgtttttataatttctagaagtcccgtcaaacgctgccattatactcatctacgacccgtccattgtcttttctctttattgtcattgggattttacaaatcgaacataataatcgttcgggttcatttttttactttctataagtcccgccaaaccgtcagtggctttgccattgtactcctttatggttcgcccgctgcctcccttctttattgtcattgagattttaaaatgtatcatgattatcattgttttatttttactttttagaagttccgaaactttaaaaattggaccttgtagtttttagagtttattgtcttgttgggtttcattttttataatttttagaagtcccgtcaaacgatgccactatacacctctacagcccatcccccgcctattctttattttcattgggattctaaaatcgaatataactatcgttggaatttattttttattttctaaaagtcccgccaaccgtcggcggctctgcaactatactcctatacaccccgcgcacgctgcttctcctttttattctcattgagattttaaaaatcgaatgtgtttatcaatgttttttttttactttctagaagtcccggcaaccgtcttgcccgtccctccttttaatcatcattaggattctatttgatgttttactaacagtttttatatatcgtatcaactgccaccactattcctaattaaaatctttttttctttttctaatttatttttttaattaataccgtatagtgtttttttaatatttttattttttatcttttgaatttcagttgaactctcttttattttttattctgaattttaattaatctcatattggtttcttatatggattcttctttcactattgcttatttttaattccgaatttcagttgattttaagttgtattcctactttaacttttcttttctttttgctaatttcaatttttttatttttattccgaatattaactaatctcatattgggttcttatatgtactcttctctcaatattctttatttttaattccgaatttcagctatttttaaattgtattcttacttggactctccttttattttataatttcggattttattttatttttattttgaatttgtattaatctcgtattgggttgttatatggaaacttctttcaatatagcttatttttaattccgaatttcagctatttttagattgtatttctacttaaactctccttttctttttttctttttctccgattaatgtgggaatttctagccccccacagcgaacgtggtgtctccttttaaagctgttttaataataaaatagatatatcaaaatagcactattaatgcactatcacactaataataaaaagaaggaccgaacagagtctgactggaatagaattaattcattagatgtgatgtacatccttcatccatacgatctgtccatgggaaaagttgcacaaagtgagctatccatgtgggtttctgtagagtacaactgcatgcttcgggaatggtgcattcgatcagggcaaggatgcccaagggaaacatgaggagaacagcgtacacaatgtcaatcaagagatcaaacaaaccatggatggaatcagggtaaaacaaatacagtgcttacatgtagattatatgaatacagaattgatctaactggaaattctttccctactgcatgattttaatttcaagactctgctctccagtgaaaaggttcctcacacaacatatcagaaaatcaagactaggcacaaaacctgcgtaagaaaatggaatactctacaacattaaaccaagtttttcatgtgtagatgactgtggggggcgtggcagaattcttgaaaagtaaattagcaaacatggtacagaggggatgtggaaggaagagagaggacataagactccaaacagctcagatgcatgcagctctctcagttgcaagactagctacagcagttgcacgaatggttggtaattgccaatctgagtctaccaatgcaaacaacactatcatgactgccatagggaaagatgaacatagaaaaatgcatgttgcaattgcatctgccgcagcactggtggcagcctcatgctctgaggctgcaaagttaactggagctagcagagaacagatttcgacagtcattcacatgggcatggaaactaggtcgctaggggatttgctcatgctgactaccagcgcggcgacctgtaagaccaagaatagaaccagctcatatttctctatatattgtatactaagttacttgcatgaaacttggttcttttgctgcaggcttaaaaggagctaatgcctttaagatgcggaacagggcaataagcaattatgcctttgagaatctcatgagtaaccagaaagatgtccgacttcctattcgaacacctgatggtataatgcccaattaactcatcaatgacatgccacattcaattagattacttcattttccagggatacaagatgaatgcgaaaaaaaaaacactttcatttgtgtattcatgcagggaagatccatatcaggatggtttctgtgcactgcaagcatgacaagataatattgaacttaggaaaggagcatagtttgagaaccagtaaagaatgtgagcctcattttactatcctctttcttaagtgcaggaccattcaccataggcagtgcaaatctgaggtcttacctttgcttttaatatgtagctgtgctaaattgatttatccaattgtttaatcacccactttcttccagacataatttttgatgaacatggtgggacaacagacttcagctacccaacagatgaacatagctaccatgcaataaacctcgcaacatctggtggaaacatacagttattatttgaagaacatgacaatacagcgcttggaagtcattcatcagatacctgataatcaacaagagatcaaggctatcctactgatacatgatgtacgaaaattcgacaatcagtagggactcatgctctacattccttacaaacccacacatttcttacgtgaacaataccaatgatcaacatcatgttatgggaagcaccatttgtgtggtggtggaacacatgactccatccacaaatatgattgtgtgtatccttagttggtgcagatcccggaagttatacttcctttgtccaaataaataaataataataatgtaatagaacttagtaatagttattccaccaaaatgcagtttattactaagatgtttggttgaatgatgagatccatcccctgaattatcatctcaacgtatttatgtatattttaagatcacagctagctggcaaaattcaactcagtaaacctgaactgagatgatcagacgggttccaaggccctacccctgccattctcacatattccattagcattaacatcacagcagtctttttacacatttgacaggacaattttggtgtgtttccaacttcagaactaaaaaaggcatgaattatttttgaaaggaagagtttctgtatttatttgaaacataagtatatttttgaaataagtatgtctgatt

SEQ ID NO: 3350 - DNA, 1702 bp, Oryza sativa
cttgcggttgggcctctcctccgcctccttccgcgaccgccgcgtccacgccgcgcgcaccaccagggacgcgcggttgctgggcacgggcggcggcgagagcgcgaggtgggcgatggaggcggaccacgagagcggcggcgacggccggagagagggcggaggtgcgcggcgcggggggagagtggcggcggtggggtacgcggcggcggcggccatgggagcgtgggggtttagacgaggtcgccttatcctgtacttacaccaattcttttaagagtaaatggcatatagggccacttctttttaccaatgtggtaagagtaaaagactaggaagtaggaacagccgagcagcccaacactttaaatttgaacccaaaaagattacatataagttttactttgggcaatttgcttcttccctatctttccctctcttccttgctctctgtcttcttgagcttgttgggttggtgtgaaagctcaaacagacagtaacatagagcctatggagtaccgccctccgtcgcactgctcgcatctcgtcaatttgctcctacaccacatagtccccaagctagagcagctctgcgcttgcgtcgattggaggcggccatctctacggtttatggtcgacgatgagcaggcctaggtccatccttcgttcattataggttaatagcattaggagggacatagcttgctcacgagctcattagtggtgatgagtgtggaagcgtaagcgtggatctggaagaagtgagtttcagtacgtttgaggacatggagaggagctcatcaagtggctaatgtatcgattagttccaatttgcaataaattgtaagtccatccggttcaaagtgaaaatatgagatgagatgagatctagttcattatacaactttggtaaagaaatcatgtccaaattacaattaactctttttttaattgcagaaaaagcatcataactatggcgaagcgatggcagttgagatattcaaatttgtcaagagtgtcagagtgacaacatgcagttttacaaattttcattaaaaaaatatagatcaaaggtacatgttatgaaatgcttttaccaaatttatcattatcctgccgcggattataatagcgtacattgtaaatgcagagtcatatgtgtagcgttatcccttatattaactgacgtaatgggtgcttttatcgtggagtattttacatccttataacaagtttaatagtatagcgaactattagctctaaatcatttatagtcaatctaatagcaggtacaatagcaagctataagccagctataaacatttttaaagagataaagaaagagagaaaagagcagcggactacagatctgtagccagctgcagcacagactccaagacgtaatatgtgtatgacagatgggaccaggtattaatagtatagtaagcaactattgtatgaattggctattacattgactatagatgatttggagctagtactgggctatactattaaacttgctctactatcattcatacaatagttacctataagcatataatacaccaatatatggtctcacccctcatacacataatgtattgaagtctgtgctgcagctgactataaatctgtagctcgctttccttctctctataagcatataatacaccaatatatggtctcacccctcatacac

SEQ ID NO: 3351 - DNA, 4687 bp, Oryza sativa
  unsure (1)..(4687): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccatagctatctcagctcagatgttagtagtatcgatctatcaggacgtacgtggaattcgtcagaggcgtctgcctgattcagcctgaagacatatatatgtagctttctggggggaaataattagcggaggtttatttttctcgaaatatcattacaaaggacggtttgtgtaattgtattcattccagaaccagtgaaccaggacactagaaaatacagagtccaaacgtatggcgcccatctgattgacagcatgtccaatgtgatatctctccatgttttttgcatttagtttaacggtcaaagacgggcaatctgaattaagcagcatgcaatgatattttgagagcaggactgtcaggaaaatgttattatcagcatgaaggtacacgagttcattgcctcaccccgcacagcggcgtgccgtcaggttaatcaccacgcgaacggcgcccatcagctgcctgagagtcattatcagcagcgataattagtcccatctacaatgatcgatcgattggtcatctcaccgaaccctgcaaccgtggatgtgatcaattcttacttctcaggcacagacctaagttaggactggccttggacaatgatcgcatgacattagttaccagtagtccgaatcgagcaccagctagcacatcttgcatctactgttacgagtgtacagtagaaccgattaggtcatgtgcaatgcgagggcggaagacctcttttctttctcacactacagtctacccattgcatgcgtcaaatttactctgtaccaggtccaggtttggaccttgaaacaaatgaaaatcattactattgttttccaagcgttggctcaagactagtgaggatgacatgattttttaagtatatatattgttccacattcagtgttaaccactgtgttagggataaaccccactcttagggttagagcaagtttaataggatagccaacttctagctacgaatcatctataaccaatgtaataggcaattcatacaatagttgcttactatactattaatacctagtcctacacctagctatagctggctacaaatctgtagcccgctgctcttctctctcttcctttatctcattaaaatatgtttatacctggcttatagtctactattgtacctgctcttatcgtgttaactaataacataactacactattgatggcccatgcaaattgcgcgaaaagtatcttttttttcttatataatagtgtgtgtgtgtgtgtgtgtgtgtgtgtgtgtgtgtgtgtgtgtatatatatatatatatatatatatatatatatatatatatatatttcacattttattattaaaatagcaacatagttttaaattatttactaaattgatcatacgtgatagttattaattactttcaattttgatcttagttatttctaaattgtattactacatgtactctaacctctacttccacttgtcgacgtttgatgtcacgactacggtatttggacagtatggggatcgttggtgctaggatatatgtgagactgaggtaaagagatggagacatggatttttatacaggcttcgggcccctgagtagttaggtaataaccttacatcctgttggccgaagccggtattgctcttattcaccataatcacaccagtacaatatgtgggtagcctatctaactgttgttgacatgtcagtttgaaggtctaactcgtagtcgacaacaaggtagtcttcctcctcgaatccgtgcccgacgagatcagagatagcgctttcgtatctcctgacggtatccggagacaccgtaggggaatagccatgcctatccctgaagtcgatatccggcggcgtgtcttggcgtatgtaggcttgtatgttgattgtgttgggtgttgatgaggtggtcgtccctatcgtggtgatcgtgttgatcgtctcatggtggttgtcgatcgtgttgatcgtctcatggtgagtgtctgtccccctgtcctcctaggggggcttgtatttatacccataggtgtccccttgtccaagtagaactagggaaaccaatatggatacaatccgagtagtccttgtcgtttccatgtagaactctggttgtctttccttatccggaactccctccatatctgaagtcggtttccgtataggacatggtatgtggtgggtcctgccgagatttagtcaactactattaggtatgtagtatccataaccatgacaccactattctttattttttaattccgcattatcattatttataaattttatttttatatggattctaaacacttaacacttgtttcaatattttttatttttaaattttgaatttcaattatttctaaatagtactcctatatatggactctaaattcctctttcaatattccttatttattaattctaaattcctattatttctaattgtattttttatgaaccctgaactcatattttaatacttttttatttttaattccgaattttagttatttctaaattatattcatatatagactttaggtccttcttccaatatttatttttttattttaaattttagttatttctaaattacatttctatagggactttaaactctacaattttagtatttttattttagatccaaatttattttaaattcctatgtagactttagactcttcttataatattccttatttttaaattccgaattttcgttattactaaattgtattttttatatggactctaaattcatctttcaatattccttatttttttaattcctaattttagttatttctaaattatggccgagtttagttccaaactttcttcttcaaacttccaacttttctatcacatcaaaactttcctacacacacacacttccaacttttccgtcacattgttccaatttgaatcaaacttccaattttgacgtgaactaaatacactctatatttctatatgaaatctagacttgttttccaatattttttaaaaattttgaaattttgttatttctaaattgtatttctatatggactctaacctttacttttactttttttatttttaattctaaatttcacttggttctaaattgaataccaatgtggactctagtttcctcttccaatattacttatttttaatttcaaatttcagctatttttaaattgtactttattatggactccctttttttcttattcttgattaatatgagaatttctttatcgtgagagaaagtgtggagccttttttctattatttaataagttagtagatagaggattgaacacccctagagcaatgtcactctcatgtaacgagtcaagggcaataatgtaattttccgttgtcaatgaatagatagggccctccagagacaagggggatcccaatccatcccatgaatatatggttactctaactctcatccctcctctcctcctatttgactatctcctatatccaaccttaggctctctccaatgaggggtgggagcccttgccatgattgttcggccaatttgttccaacaattgcatgttttatcaggaaactcttttaacccatagagggatgttccatcgtatcgtgcttatcaaataaatagttttgaagaattaagataattatatttggcaagatatattaatatatcactccataaatatacaagtttaaatttgacttctataagttaaaataaatagatatgcttgtgtgtactagtttaagttaaattggttatttttgttacaacttatggggatcaaatttaaacttacatatttataaagtgatatatcacatattaatctatcataattttactatttagatgacatataagagcgacaggagaaaacatcttctcaaagaattataatccatttcggccctgtttgacacagctccagctctatctttcctggagctcagccaaacaatttcagctccacctaaaatgggagtggagctgggtagagtgctctcacaaaatgaactagagatgtggagctaggttttgactgctctagaactccactctgaacacaactcctaaaactaaattttagagttagaggtttaccaaacagagccttccattctttaccatacttatttaattagcatctatgaaactcttatatgccctgacgtcctattgtctatccacattgctgatggcctttggtcatgtgaaatgagaaaaacaattctaatattacatgatgtaagaccgtatgcaatgtaggagtaaacgtcctggggtagtactccgtttcacaatgtaagtcattctagtattttccacattcatatagatgttaataaatctagacatatatatctatctagattcattagcatcaagatagatttttcacattcatattgatgctaatgaatctagatagatatatatgtctagattcatgggctgcaggaattc

SEQ ID NO: 3352 - DNA, 11057 bp, Oryza sativa
cataatgaatgtggaaaatactagaatgacttacattgtgaaacggaggaaatagttcactagtgttttctttctcactttgactataccgattgcaatgcatcagatttagaagttgttttgtaacaattgcgtgttttaccacaatttacagggtagacctaatggccggatgcttgtgcgcggtcgtgtgaagtgtctggacactgaaccaagtgtatatttatggtccactgtgaaacattttcctaggtacttttgatatggttgtgtttagttcccagggaaaaaatttacaacatatcacatcgaacgtttggacacatgtaaatagtattaaacatagaaaaaatatataattgcacagtttgcgactaatttgcgagatgaattttttaagcctaattacgccatgatttgataatatgttgctacagtaaacatttgctaatgacagattagttaggtttaataaattcgtctcgtagtttacagacagaatatataatttgtttcgttattagtctacgtttgatattttaaatgtgtatccatatatccgatatgacacgccaaaactttacaccccgatctaaacacacccataaaaacattctacgtaaaaccattttaaataaggaagaaaactatggcaatttgcagattagccctttcgcattttacctcggcacacggtagactctcgaaaatgcttcctgacgttcgatagaaaacaaaatgccggacggctgcgtatggtgggacccagtcatttaactattcaaccaatccatttcccattcgccattccccatccttatctcttatgtcttatcttcttctccccattttcttctcgccatcccggtgaccggagggcaccgcaggggttcgtcgcggccgcgtggctcgggggacggcgtgtactccgccgcggcgaccacgctgccctacgaggacgcggatgggctcatcaagtacttcgccgtcgacgactcccgcggccgcgtgttcgtgttctctgtcgccgtggacgcgctgctcgagctggagcctagggtgtgcaacgagccgccgatcactgccctgcttgtgtacctctctccgcgccacacctcttcttcctcttcaccggccatgccgacggctccatcgctgcccaccgcctcgtcgagtcgtctcattatttgttttcgttgcacctttgtcgtgaaatgatgtttcattgtatttttattggatgttgcatatattattgtctttttgttgcaatcagtagttttcaactgttgcattcacccaccgcctgatcgagtcgtcccattatttgctttttgttgcatcttgtcgtggaatgatgtttcattgtgtttttaatcgatgttgcacatattgttgtctttatgttgcaggtagtagttttcaagtgttgcatctagttacaactttttaacccggtgataaaatattttctcaagactgatgaaacatttctctccaaaatacaaacaactgaaacatttatattaaaacaattttttattgtcaatgacacatttctctgcggcactgaaacattcctcttgaaacaatttttattggtcagtgaaacatttctccgtatgcgctgcaacaccgtccgatattttaaaaaatatcagactttcgatttgtagcactctccgtaaactctataggtcccgaccacatcgcacatgaccttaggaatgacaccttggcatgcatattgattcagttcaatatatatagcgacacatacagtgaccgagatatgtgggatctctcttagcctcctcctctagttgcaagttgcaaccaccagtggctagagaaaaacagaagcaaagatttgacaacgcttgacgacagtaataccacagcgaactaggcgccaccacacgcccacccctcaaccggcgtgatgacgcccgtgcgtgcgtgtgatatatgatccgatcgatggcaaccggccgatgatgtatcgtcacactaccctgcatgccatcagtggaagagagcccacgttgagctgtaaagcacagcggccactgtgaagaaccctggacgtcaatccgcgcactgttaactgttccctgaaaccggcgagagccagccggcggcaggcggcagcccgaaacaacggctttccgatcgatcgatcgatcgctgctgcgcaaacccgcgaaaatgacaaatgcatgcacgagataagggagtgtggcaactggtggcgcattggcagccactggcgccagtccactggtgtcgacgcaacctccgacaccgagcggcggagcatgcagcgacgatagctcgcgctagctagctcgatccattccgcgcagcttaaactcatggatggcagtaaatatgctatccctatctctaagggactaacacagtagtaacactcacctgccacttgtgcaagcctatctaggctcgtgcattgtactccctccgttgtaggtaacgctgtaactattttatatatatgtttaactatttatcttatttgacaattttgtgtaaatagataagatacagattatgcttaaaacaacttacaacaaaataaataatactatatattatgtaaatcttttaataagacaaatcgttaaacatatatatatatccacaaatcaatgacgtcatctagtttatatttttattcccgttcaatctacggatatccaatacataaggtcagtaggctgccgctgcatgtaacctaaatcaataccagttcttacatgtgactattttaggttatgaccagaatatgtgactatttttaagagacagaagaattagcggaaatgagaacaatttttttggcatcactttcccctctttgaggacatgtttaacttatcaattaaacatcacaagataatagtagcaaacatcatataacgtatcaattcatcgagatagcattaattatagcaattacaaccttcaacttaaaattttggctagtgaaaaaacatgacaataatctgatcttagttcggttcagtttttttttggggcctcggtcttttttgccatttctacctgacgaagtgacgatgcactagccagctactagtagagacgaggctcgtgttccgtacagcctcgtagaataatcatcgtgcggttgtgttcacacaggcaagtggcaacatattcaggggcaaacaatccagagttccagtctcggccttcatttactcaagcagatgtgattatatgaaggaatggttggttgaccacgactaagcgtagcagtctaatgtagaatgccactccatttctggatttccaagagaaagcgtgaggggcatctttggcgtgcacccatttccagggtcgactagcagcttgcaattaccctgcataaatagactggcgagtgaaaaagatgcggcgggctatatatgctgtcatgtagtattcctgtgcagataaaccctgattaaaaccagacaaattgctggactcggcactaagtttttcgtcgtttgccaattatctaaccaggtaaagtcacataagttactgaaacagaacacgagcagccacaccaaccgaccacaaataagagtaaaaggcacacttgagattgccaggaacgatctgaatttttcttgggaaaaggctgctcttgcgtgctacgatggccgggctatgagaacgggataaaaaaaaaaaaagagaggtggaaaaacggcgacagtcatcgtcgagcgcgacgtctcggtgtgatgcacatacctaagaatacctgtttgtgacatcatgcgagcaagacacgcacgctcctccacctcccttttgtgatctgcacatcctactcacagtcgcagagccagctagccagctgcagctgagctctataaatcccagacctctctgctcagacacaaccacttccatagatcccctcctcttcttcctcctgctcggcttcctcacacagagcttctcgttgcattagccgacggaggccaccggtgaggagagcccgaggaggagcaagaaatggttagtacgtgctcatgatttgatcgttcttggcatatatgttagcaaagctacacggtttcagcttgtttctgtagcttgttggtctgtagccaagattcagttttgtctccatgttcagtgatgaaacaccatgcgtatacatggcagcacatgaaactggaaactaactgacagcatgtaacttgatggttgcagtctggcaacgacggagacatgaagatgagggtgatcgtcgtggaaggcgatgagacgagtaacgccccgaaggatgtatgctgcgagtacaccctcgatggctccgtggatatcaagggctcaccggcggtgaagggcaagtccggcggatggctcgccggcggccttattcttcgtaagtactttgtgctgaactctgctgatttcaccatctccttcccggctgagacgggccagcaaaaaatggagacaaagtcgatgactgggctttccagtgaagtgttttcgcaacagtgcaagtcggtctgaggtgactcgacgttgaggcttaaagtggcggtaggcgccgggtctttacgcggaatgctgcatgacgaggtgacatcggccatgcaacgcccacaactggagggttcctcgccacgggggattcgggcgcacgcattactagcgccacattaggatctccgtaggagacatcggacatggtatccacgatgtagcaaccatgcatagcgatcaaatgatcgatcgatctgtagggtatgtggagtacgatatcgccctaccacagtttggctttattgctgctttcatgggggagttaagcggcgcactgtttgcatgtgtgcatcgttttatgtttgtttagaattattcttgaaggccttgacacctttttattttgtgtgtgttgtgcagtgaaccagggtctggcaaccctggcgttcttcggggtaaacgtgaacctggtgttgttcctgacgagggtgctgcagcagagcaacggcgacgccgccaacaacgtgagcaaatggaccggcacggtttacatgttctccctcatcggcgccttcctcagcgactcctactggggccgctacaagacctgcgccatattccaggccatctttgtccttgtaagcaccaccacacggcacatccctctctctccgcagttctatctgaaaaccacgcgcctttctcggtgcgatcgattgatctcatgtttctagctacttcggtctgatctgttggtcgggcaatcatcagtgaccagttttttccgttctgattgcccatttcacgggaaatgatggtctatagatgcgtaggaacgtacgtacaaagtaacagcgattggtgcgggagaatctgtccagagtggagttaattcggcctgtactctgtactgggtggattgtatctgcacgtatgctggtgtcgaaagtggatggtccatatagtagaggcatagagtagtacgtggtggcgccgaccggtcggtcgatcggcccaaggcacatcgcggtcgcgttgcgcgtacgcccaggagatgtggatcacgcggctgactcgttcgcgtcacggtgttttgcctgcagggcctcgcgctgctgtccctgtcgtcgcggctgtacctgatcaggccggtcgggtgcggcacggagcacgtgccctgcgagccgcactccggcgcggagctggggatcttctacatcgcgctgtacatgatcgcgttcggcaacggcgggtaccagcccaacgtcgccaccttcggcgccgaccagttcgacggcgaggacccggccgagtcgcactccaaggtctccttcttcagctacttctacctggcgctcaacctcggctcgctcttctccaacaccttcctcagcttcctcgaggacgagggcaactgggcgctcggcttctgggtctccaccgccgccgcggccaccgcgctgctgctgttcctcggcggcacgctccgctaccggtacatccgccccagcggcaacccggttggcaggatcttccaggtcgcgttcgccgcgtgcaggaactggaaggccggcgagtcgccgggcgccgtgacactctacgagagcgacgagaaggcggattccggtgggaggaagctcctgcacacggaaggtttcaggtaaagtgttgtgtggttttgtgagctgtgaactgatcacgcatgcacgcactgaactcgccatgtattgcaggttcttggaccgtgcggcggtggtgggcgctaacccgaagcttggcacgtgcacccaaccgcgtgacccctggaagctgtgcacggtgacgcaggtggaggaggtgaagagcatcctgcggctcctccccatctggctctgcaccatcctctattcggtcgtgttcacgcagatggcgtcgctgttcgtcgtgcagggcgccgcgatgcgccgcaccacccggttcccgggcttctccgtcccgccctccagcatgtcggccttcgacatcctcaccgtcgccaccaccatcttcctgtaccgccgggccgtctgcccgctcgtgtcgcggctcacgggccgccacaccggcccaaccgagctgcagaggatgggcctcggcctggtgctcggcgcgatggccatggccaccgccggcacggtcgagcacttcaggaaggccggcgccaccacggcgatgagcagcgacctgcacatcatgtggcaggtgccgcagtacgcgctgatcggcgtgtcggaggtgatgatgtacgtcggccagctcgagttcttcaacggggagatgcccgacgcgctcaagagcttcgggagcgcgctctgcatgatgtccatgtcgctcggcaactacttcagcgacgtcatcgtgagcgcggtgaccaaggccaccgccgtgcgcggccgccccggctggatccccgccgaccttaacgagggccacctcgacaagttcttcttcctgctcgccgtgctggccgtcgcggacttcgccgtgtacctcgtgtgcgcgagccggtacaggagtggcacggtggacgtcgaccggagcgacggggaggaggaggatggcgtggccggcaggcagatggcggcaacggtgtaagcgtcaggatgaatcggccgtctgctcgcgctcgatagatgcatggcaggctgtcgtggttcttgagacggagactgcagactcttcgaggggatgagttgcattgggacgagttggtttagcacgacaagtctccgttgatgataggacatgcacggggggatagtgacacgatactaaagaataagaggtcgcctacagatgcagtattgttctatcatgtacgcctgtgtttcatcgtttcacatttttctggccaatgtaacaagagaacgcgactgttactgaccactcatgttttttcttctgcaagagtgactgatcaatgcttctgtgcattgccgactgttgattgatacgcatactagtgctaataatacttcattttccctgcctagtactgttttgtttctactatttacaattcactgctgttccttcacggtggcactgttactttgggcctgtttggcacagctccagctctaactccacccctcctagagctggagttcagccaaacagtttcagctccaccaaaattgagagtggagttgggtgaagctctctcacaaaatgtactagagttgtggagctgggtttaggccccgtttggcatagctctagctcccactccaacttatcaggagccggagttgtgccaaacgaatccagatccacctttttttggagtggagttggcagagctactcctaaaaaatgaactacggggtggagctgggtttttgctgctccacagctccactctatcccaaaagacccactaccctctaattttttagagtatctacacgaaaatgccactcaactacccctacaatcctcctttcctcccgttctctctcctcccctcccaatcccgagcgggcgccggcggcggtggcgggctgcggcagcggcgggatgacgacaggcggcgacaggcggcgcagcgtgacgatgacgagcgggtggaggccggcggcggcgggctacggtagcgtcggcggtagggggccacggcgacggggcgtgacgacgacgcgcgggcggaggccggcggcggcgaagggctgcggcggccgggggctgcgggacgaggacgggcggcgcgcgtggccggcggccggcggcgcggctggggccgattggtttcgttttttttcattttttcattttttttttcagatctagaactgaaagtatagccaaacacttttaacgagttttcaacttcaaccggagctagctctcactggagttggagtttagagttaggagttggagtttggagccctaccaaacggggccttagacagctacacaactccactctagactcaactcctggagttatatttaggagttggaactgtacgaaataggccctttgttagcagcaaggcggtgaacagctgaaataaagttaagtggtagaaaaataaggtgtgtgcgcccacttgggtttgtgggggcgtaaatgtggtatgtggattcacatccaacttgtagccgaaaaccatgaaatcgttatttttcagtagcagacgagttatctatttggctgcctagcactcaccatatttggattgctgggccaaatttgagttggaagtttattatttctgtggaagagtacactttaagggtgtgttcagcacccctttttcccaacccatctctctcgttttctgcgcgcacgcttttcaaactattaaatggtgtattttttgcaaaaagtttctatacaaaagttgcttaaaaagtcatattaatccattttttaaaaaaaacaaatacttaattaatcacgtgctaattgactgctcagttttccgtgttactgttccgggttggaaaccagcctatgcaaacacaccctaattatcttggctatgcattgagcttcattcgtgtccattagcgcaaaaccggctatagagcgttaccgattatcaaaactaatgtaaatcaagtccctcggtagtttacacggcgctttcatcctacggctacatgacagattaacttagtccttatccgacgtaatgcttacatgtaattacagccaaggaaaaaatatataataggactcgtatccacatgtaagtggtaattgtatagatgttttttttattttgagtaaattatcacagtactgcaggtttaacatgatatatcacaaaactatagatttagcactaaatttatcacataactacatgtttaagactaagtatcacaaaactatagatttgatatcaatttaataacagaagttggacttatataactcaaacatagcattagtgctgaggatttaaaccccaaaatctgtagtttacgataatttcatcagcaaatctatatcttttttatacttagccttaaaccagtaggtttgtcataaatttattgttagatctgtagttttgtgatacatcactttaaatatgtagttttatgataatttaatcaaagtatttatagctttgtgaaatttactcttatattttttttccatgtgaaacatatgagtcctacatctttcattagaaaaattatggcacaactacgactcacattgggtctccttatttttaaaattttttaaatttttttctagtttcgtgattaccacaagtgccatgttagattaagactatgccaacgtgccaagtagaggttacataggtcaaaaaccactttcaaattagtcgagggactcgatttgcagtgattttaaaagttagaggatactcttacctaattttatagttgagtgatgcaaactcaaattagggatgcgaaatggaccgtttccttcattagttgggtttgatgattgaaggtccgatctaatttgtatctcttaactactatatcagatatcttgacccataactattaaaaccaatgcaagatgactccattagtggttttgagggtgtttatgtgttgacgtgactcgttgacctactctagcaggccgagttactatgcggaccccacatgccaaatcccttctctccttctccaccccctcttctctacccttatcttctggattcggcgcgactctaggagtgggcaacgcggcgcccgaggcgatgggaggttgaggagaaggcaatgggtggcaacagtgtgacgatggcagaggagctcaagggagctgcggtccccatgtctctcgacgggaggcaaggcggtgggaggtaaaggggagggcagaggctggcggcaacagcgcaacgacgatgcagtagctcaagggggttgggaggcagtggccatcaccgacgtccctgtgtaagcaccggtggagagaagcatcgtgaaggcggacacaatcttcgttgcgcggtgtcgcgcgcatgaggggatgaacgtcgtgccgtgggagatgtgacgggtagggggcgacggggtgacagaggagggatgagggagagaagagggaaggagaaagagattggggatgaagaagcgggcggcattagagcccaccgccgcgagccttgatgagaaggagatcaaggatgggtgggtcttcctcgccgactagcgggtcaagggtgaagaggccaccgtcttcatccatggtaaggactatggtgttcaacgatgacaagaggggggaagaagcaggcagcatcagagcccgttgtcgcgagcctccatgaggaggagactgaggtcaccgccgcgacctatcgtggacaacctcgctccgggtcttacccaccatcgagtccaatctcgggtgggcgcttaggcataccctattcactagacccgaatccataaatgcataactgatggcagcttcaataactgtcattggcataccacatacctatacgtccagtcagggttcaggatcgagggaaagacacatgtgcatg

SEQ ID NO: 3353 - DNA, 8437 bp, Oryza sativa
  unsure (1)..(8437): unsure at all n locations
caagccgctgactgccgtcctcgattccattgtgcccgaagctaggagagagagtgaggagaagagtgctcgcctctagccccccgatcccgtgcacgcagctgtggagaagaaggcgagaggagctgtctaggaaagaaagggacgaagagggaagaggaagggggcagagagagggagagataagggggaggggggtagggtgggagggaggggatgtgacatgtgggacccatgtgttgactttgccggaaccacgtcaacgaaaaccaccctcaaaaccaccgagagacatttcaccccggttttaatacttggagggtcaagatccggcattacggttgagatatacgaattagattagacctatatttgagggggttaaagtggagctattccaatttgatggtcttggcaaatttaattgggtagaagggtaattgagagcccattagaaagcccatcaaaactacccatattgttccctccaggccatttacaacacagcccccaaaagatggcacaaccgcacaactgatagagagtgatagtgataggtttctgcgatcctgtgtaaggagtactccttgaaaaaccgacgtacctctctcactgcaacagggccccacggagacgaccccaacaacttgggtcgatagcggcggaccgatttcgcatccttcctccggctcagcgaactcgtcccgcaatcaaaagcggggcaaaacgataaaacaaacctcctcctcgtcaaagccaagcctgcgtgacaccccgcagctgcgaaaataatcccaaaagcgcccgaatccactaaagcccacgcgaaatccccagactgcctccacgcgcgccgcccgcacctcgcaacccccaggggcgtttccgtccattcgcagccgcgcgagttttagctcccgaggcgtcgaggcggaggggaaggagtcccccaacccccgcaacccccgtgccctagactcccccgatctcgccgccgccccgcctccggcgccgctcgccggtgacgacctgctccgccggcgcccgaggccctcgcccgagatcccctccgacggctggccctgacggggccattcgccgccgcgaggccgcaccgccggtcgccgccggtggggcgcttggggtgggtgggcccctctctgatttgaaccccggggccacgcttgggtgcctctctggttcagagggtttgtgccgaggtgaggaaactatcgagtcgattcgactctatgtcgctgtagtttagggctcctacttgtgctttgggtctgggctgcacttttgtggggtttagcatttctgcaggggtttgcgtcgatggcatgggcgcctgcctttcagcttgcggtattcaggttttgaagttttggtgcataagattggtgatattttattcttttattgggagtaaggtaatgcggcataagtatcagttaggatggtgataatgtggctaggctgagcgtttatgtgatgcctttgtgctcatttctccgatcgaccaatcagtttgaccaaagagtgatgggacttaacatgagttcagtgcatttgactagtgttgctctgaggtgcaatttgccttctgctacatattgtttttgcaggtaactccaacatgtactgttaggaatttcatgttgtcacatgctgtataagctcagatactgtcaattagctctgttggttattaggggttattaatgttgcattgtgactatgatgatcatggttggttttgggtactcgttgaaacgtgtgaatagatgttttggacaattcgtagggagttcaaaacatgtcataccattcacggatgacttaatgacctagtttcactgttttatttctcttctttctgtaatactttttttttttggaaaaaagtttagaccttttatctcatgcactaaatgtattttacagtttgtatacgatttttctgaatatgccccaagacatgagatagttctctacaaaatatcggaaagatggcatcaaaaggtcctcgatcaaagttagatcatgagacaagagccagacgccagaaggttagcttttagcattggtatttatgtttagtagctgcaaatcattgttatactatttctcttatcttcacacacatttttctttctattccacgcttgcataatactgtttttgattttgtcaggcctagttagagaaggaaaattaagtcatgttcttttgtatatatgtaaatccattttcactttctttgtattgcactgactgaaaagttttgtcctatcttgtgcaggctcttgaagccccaaggggggagcctcgaaggacgaaaactcactgggaccatcttcttggagaaatggcttggctggcaaaggttacttgctattagtacatttgacagatcatgatccttctttcactgagtgaatttgcatggttttataatgaagatatactaatcctattcccttggcttggttaatattaaatgttgtgcaggagtttgatgctgagagaaaatggaagctgtccatggctaaaaggattgctcaaagagctaataagggtgtagttgaccaagcaacaaaggacgagagaaaacagaaggtttgcttgtcttttttttattaattaggcagattaacatgactccatgagagttgtcttattacaattctgtcccatattgaaggctatcagcagctttatcatttatatacatagaataataaactgtagtaatgggaaaggttggaggctgggaaggcgacaaggaagctggactgtaatttattgctggcaatgacccacatggccacatctgcatgcttgccgtttgctgaactgagtgatgtgcatcttagtttatcctcactgcagtacacagggaccttaactgagtaccctttatttattaccatgatctgactttaacctgccgagaataaagaatgaagaaccatagctaactgattgcttaactgcttgctaaacctaaatttggtggagactttgatcaataagatcaggttgacaaataaagcctagaataggttaaattcacaagtactgcatgttttggcataaactatggtcagtctaggaaatatatttcattagtacataagacattatttataacagcacattgaattgaactttgatgaagataagttgagaaccaagcagtgttccttcccctaatttgttctttcaactgcaagtaaatatataaccagcacattgagcgacatactcaatgaccgtagattatgtggatagcaaatcagtattcatgggttttatcttaatgttggctgcgattttcataggaggaagaagttcgcctgagaaaagttgccctaaatatttctaaggacgtgaagaagttctggaccaaaatagagaagctggcaagttcattgtggctcagtgtatatttagaacaccacattttccaatatactaaaccttatgctatttatatttgggtttgatgcaggttttttataagaaccaactggagcttgaggaaaggaaaaaaaaggccctagacaagcaacttgatttcctcttaggacagactgaaaggtactaccatctattatcagttggttttgttttggaactatcttactttttagtaagttcatcgctgcatgctcactctctgttgttttgtgcaaactttttctagatattcaacaatgctggcagaaaatcttgttgatgtgcgccttcaaaatcaagaaaatgactctttacagactaatcaaagatcccagcaggaactagcacaagagaacataaatgcatcaagtccgactgatgttggtgtgtagctttatgaaatgttctgtatatctctgaaattttaaatgtcctttttctttagcttttaacagtatgcttttacagacaatgtggaaatcgatgatgattacaacagttccttgggtgaagagccagtaagctactattgtgatttttttgattcttttttttatttttcgtgggtagcattacaacttgttagatttctacagatactggtactggcaccaaccattattactttttttgtaagttgtgtaccagggcaaggaatacatattttcctgtccaaaaaagataataatgacacctctccttttcctttttggtttgtttttcatttctcaggacattgaattactcttgtgtgtgtttgtgctgtagaaagatgatgaacacacaatcgatgaggatgaagctcaaattacggaggctgagcgcaacgaggaattggctgctttgcaggcagaagctgatctaccactggatgatattctcaagttgtacactaaaaataaaggtgatctccgaaaaacagttctcttttgccatgtttcacatattttaggaatcaattctgtgttccactttgctctcaattgataatttgatcagttcaagctttctcagttagcagggaaagcagtccagatggcagagacgtttttagtgactcagattcaaaggatttgattaaaggttatatattcagagtttcagacacctttatggtatttggaatctgaaatacttgacacattgtggcctttcatttgatttgtgttgtgtatggtttcttccagatcctttgaaccaggctaatggatgcaacgatgaatctgatcatacttcaagtgatgaaggcatttcttctgaggaagcagatgattaccagtcttacnnnnnnnnnnnnnnnnnnnnnactgtatgcttgatttctttgtgtcatttggcttatgcttatgtagtatatagtaaagacaggggactcaggatttcgagcttttgaatgttctctgaacgtgccatcaaactttcttgacttttcaggtgaaatgcaatggcaatatctcatctgttgatgcaaaggtacatttttgttatcattatttttggaggggaacatttttattatcattgtatttgttttggattttgtcttctccgttccaataccatttggtctatttcactcatatctcttagaaagactagctgttaggggtgggcattctgtctagaccgaaaattcggtctgggtagttcagtttttctgaagatcgttttttacaaatagaaaacagaagtagtgaacaagaaatcgttaatgatgatttagttaactgaactatcggtccgatccttggtctccaccgaaatgaccgaaggtacatggactctgggagagctaggcccaagcggtggcgcggaggtagggtggatgcaggctgtaggtggtggtgcgacaatcagtcgggacctgggtggtgcggagtttgggtgctggccatggtgcaatgagcagcaggggccacggagaggctgcgcgcgggcggcggtgcaacgagcagctgagcgtcgagcggtgcggaggctaggcgcgggcggcgttgcaacgatcagccgggggctcggaggcttagcatgggtggcgttgcgaatttagaaggctggcgcagatgggtttgcctttgcgtgatggacgaaagggataaggttgtggctgatgtgttcatgcgaatgagcttgtggacttgtgggccttgtacaggagggatacagggaggtagttggctgcttcggtccatcggttctttcggttaatccaaagtaacgaccgaactcaccgaattaagttcggtctttctggttgtacacccgaattagtgaccaatgaccgagctttcggtctttttgggttcgtttttttgggtccggtcttccgtcctcggtttttatgcccaccgctaccagctgtccactgcctagtaacaagataatgaaatctttcaaatattggaaagtacgaacagacaattgttgttggaccaagttttctgaatggtattggggtggggaagaaaggattttattggcaacttactgccgatcccttagttttgttgcatactccaactaatgtttgcaaataagttaataaataggattggaccttgctacccgtattaaatggaatattttaacttctctagtctctcctgtagcttcaagagaaaaggaaaatgcagagtggggggacgttgcattatgacttgatttctcttgagactacattacccaataaaatggatggaaatatagttatatgggggtgaattagccaaactggcaatttttgtcaagtacaaagctttttagggaaatgaagtttgttaaagttgacgtggattagaattttcaaacaaattcctgtgattcctgttatagttttctttggattctgactgccaagtaaaaaagcttttctcccctcctatttgttatctgagcaacatgtggtaacactctaatgtagacaactgttatgtacctaccattttcaggacgacgaagattatgttgctaatgatgaaggaaaggtaccatgaacatcttcatctgtttttcccactgccttcatatttcccatatattctgcatcctatgactgtgtggcggtccttcaaaactagaaacatccattcatggattagttatcatttgcatcgatttagtctatctcactctttttgcggttttttcttatacagctataaactcatcttttttgacaggatgatgaagctactttgtctgaagaggaagagttggcgaagaaagaagactgtgatcctctagatgaggtgaatataagcattgaacatcattattattcaaaatttcacactgtgaagtttagccactctagttcctgatttgttgccagtagaataaacttgtcaataaaatacaatcgatttattatctgtgctatcacaactacttaaggttaatattttaatacgaaatatcttggtataacaactagatagtaattttgtggattccgatttaaactataccactttttgtgatacaataaacttgctctaggatggcaacacattcaaagtatccagttgaatattcgagtgtatacaacctaatttggcctagattgatgcaaaactattttcttgtctaaactaggactgatacaaaagacatactactatggtgtactagaggcacccttgtgcaatacatatttcttgtgacagttctggatcattggtattattattttttaatctgtaggttaagttactgcagaaagagagtgagatcccacttgaagaacttcttgcaagataccaaaaggtatctgctgaatttctatttctttcttcagttatgctttactgtggtccatttgtaatgccttttttatgtttaggatggctatgcagatgatgacacaacagaattggaaaattcacctgcactatcagttgaggatgtcaatgccaacatgcctgtggatgatgagtctgcagacaccgtggaggtaaacagggatctttctgcagataccatgaaactgaccagagatcagtctgcagagaccgtaaaagtgaataatgaccagtctgcagagattgtggagggcaacaatgacacatttgaagatcatgaatctgcaggcatgctgggacctgagcatgtcagtggtagtgttctacaactagaaacatcagagcctattgtacaggaaaatactgctaaagagggtgatgtaactgatactaaagcgatggccaatggagataatagtgatgtgattgctgatgctgcagctgctgcaagatcagcacaaccgactggtaacacgttctcaacaacaaatgtgcggacaaaattccctttccttcttaagcattctctacgagaatatcagcacattggactggactggcttgttgctatgtatgaaaagaggctgaatggaattctagcagatgaaatgggtttggggaagacaattatgaccatctccttgctagcacaccttgcatgtgagaagggaatatggggtccacatcttattgtagtgccaactagtgttatgctaaattgggagactgaatttctcaaatggtgtcctgcgtttaaaatactgacatattttggaagtgcaaaagagagaaaacagaaacgtcaaggttggatgaaaccaaattacttccatgtatgcatcactacatacaggcttgttattcaggactccaaagtgtttaagcgaaaaaaatggaagtatcttattcttgatgaggctcatttgataaagaactggaaatcacaaagatggcagactttactaaattttaattcgaagcgacgcattcttttaactggaactcctctacaaaatgacctcatggaactttggtctctcatgcactttttgatgcctcatgtatttcagtcacatcaagagttcaaggactggttctgcaatccaatttcaggcatggtagagggccaagacaaggtaaacaaagaagtgatagatcggttgcacaacgtc

SEQ ID NO: 3354 - DNA, 719 bp, Oryza sativa
aacaagtagaattttggaagggattgattaaagaaattgaaggacttctacggtacaatacactagcaatatatatttttggcatatacaaagatacactaggaatttccatgtacaagttcgcgtgagcatggtggagagtggggagttgggcatcattgctgctgcctcctccaggtagaggaactagctagggttttgggtgggtcggaaattgagaagacgaaagaaaggcaattcgaattaatttacaggcaggcaggcacaatagcgtggtgcgcgtgaacttgcagtgcgtgtggcgtctctctatggcggtatggcctatgatggacgacaactacgggactggggaatgaaatcaagtgaggaacacgtctagcattgtgcatttatgtacaacagttgtctgcaagcaaacatttagaaagacaattatccccttttcaattttatactacaattaatttaagttggtaggccagttaatctacaccatctgatcattcatactaataaaatgtactgtttgtattgatccatatgttatgaaacgaatgtagtatcgtatatagatcttctcagaaatttatgtcttctctctgttccaaactctccaaaattactgtaagaaccccacgttgaaaacagggcctttaatctcactaatcatgctctcttaagcagcgcaactccaacatctgatcaaaaactaacac

SEQ ID NO: 3355 - DNA, 643 bp, Oryza sativa
agataacgtgtgtttagtacgcccttcccttcaagcgagccacttcatatatctttagcagctaagcaaagagaattaatcaattactaattaataatcgatcaaattagcaaagttggctacgaaatagcaaaaggatcggcatctgacgaggaatttcgatgggtgagatacctctgcgcccgaatcgttcaccggatattctctacaagcttcagttccatcagttttgtggggacgttttggcagttcggtgcgtgctggctgaaccgcccgtgtaggctccagcagagccacaggcacacggggccactctgcccgagcgccgtaccgcgacgcgcgcggcaggtgcgccgtgcgcgagccccacgcccccacctccgcgcgtggtggcgcacaccgactgcgacgacgagcaccaagtccaaacatgcgttacgcgtgtgccggtggtgcgggtagctgggctcccggtgttttgttttgtttattttttcatttcacggccgctgcgccgtcctgctctggtcgcgacgcgcgcctgcgcgcgagggcggtccgctcacacaacggctcgtacgcggctgtgtggcgcacgggcgcgtggtggagtggaacggtgggaaggtgcgcgacgtttcgc

SEQ ID NO: 3356 - DNA, 67707 bp, Oryza sativa
  unsure (1)..(67707): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcatcttttgtggtaattatcttctattccatgtatatcttgtgttcttgagtattaggatgccgtactattaagagggctaccacatgcatataattggtagaacactagtgctcaaaatcctttatttggactgttcctattttattcctgtcggactatccgatcctgataagactatccgatgctcagactatccgaaatttcttagaacttttccctctgtctttggtctgagtgttggctaaaaaatatcggacaatccgatataaggtcggattgtccgatacatcggactgtctgaactttctcagaacttcactctctgtcttgaattgctttttattcctcttgagtgatttttcaaatcagactatccgatgtgatcggagtatcggatgacccagagactctgaaattcaatggaacttgagtctctgtgagaggatgaaattcatgattcaaaaataacggaatatccaatataacatcagactatccgatcgatcggattgtccgaaattctccagaatttcgttctctgtctctggcgtgcttgggggtcaaaaacatcggactatccgatgtcacctcggactttccgaggtgggatgaaaatattttctcccaacggccacattttgggggatctataaataccccccacctaacccttttctagggttacccaactcattcattcacattcactttgggttgagcttggtgctaaggtgctttggatatttgagctctttctccctctctcaaatccctcctcattctttgtgtggtggatcttggtgattgtggatttggtgtttgagggcctactgtgtgtttcactcgatcttgagcactagggtttgaccaagagttgtgtggtgtttgtcactcttggaggttgaggactcctagacggctaggtgttactcccgagccaccgatctacgtgtggttggccgggagatgtttgtgaaggccggatctcgcctccgcaaggaaagagataccccttagtggaaggaggagtgcttagtgcaacctcttgaggaaagggttagcaaagaccccgctcttagtgagctcctcaacggagagtagaatcccctcaaggatttgaactccgggaacaactcggtgaacttcattgttggtgatatctcttcatcccttctttagctttgcttaattgtgccgctatagatctagtcgctgtttgcgctatactcctgtttgtgcactagatctacttgttgtgtttctttagtggatcagacagtctgatccaacatcagactatctgatattttcagatggtctgactgtggatcagactttccgaccctaactcagtgtgagcttccgcataaagttttaaattagcctattcaccccctctaggcctaattgaccctttcaattggtatcagagcctaatctactaattaggcttaaccgcttggagagatcatgtcgggccaaacgggggatggcaaagatggtgataagggatctacgtttccttatgactatccatccacatctacctcttatgtgagtacctatagcggcaaagcttcgtacttcaacggcacggactatgccgcttggaaacataagatgaagatgcatttgaagtttattaacccatctatttggagaatagtcgaaaagggctatgttttgcaaaaacctgaggatcccaccaaggaggatgacgagaacgagcacaagaacgctcaagccgctaatgcaatacttagcgccttgagtggaagtgagttcaaccgcgtggacggtattgagagtgccaaggtgatttgggacacgcttcggaatttgcatgaaggcacggatagtgttcgcgagtccaaggtggagatcctcaaagggcaatttgagaggtttgtgatgttggatggagagagcccaagcgacatgtatgaccgtttgagcaagatcgtcaatgagatcaagggacttggctccaaggacatgaccgatgaggttgtggtcaagaagatggttcgagcaatcactccaaggaactctaccttagtaactatcattcgtgagcgtctggacaacaagactctcacacctcatgatttgctcgggcgcatcctagcccatgacatgcttgtgcaagagtccaaggaggtcatccaatacatcaaccaaagctcaacgacaagcatcaagaaggaagatttggcattgaaggcaaaggaagaagaagaatagagccgcaagagcaagagcaaggaggagatcgatgatgaagaaatggctctcttcgtcaagaagttcggcaagttgatgaggtgaagctgcttcttcaagggaagttcttccaagcaccactccaacaagtcaagtggaagacattctgcaagggtgtgctacgtgtgcaaagagcccgggcaattcattgcggattgcccttacctcaaggatggttcccacatcaaggaagataagaagggcgaaaagaaggatgagaagaaggagaagcacaagcatagcaagcgggaacgttatggccaagctcaccttgggatgattttcggctccgactccgagtcaagctcaagtgatgaaggagttgccacgtttgccgtcaagccttcatcaccaccaagactcttcaactactcaagtgatgaggatgctcccatttgcctcatggcaaaagagcctaaggtaccttcctccctcaagtcaatcaatgttgatcttgtttgtgatgaggaggatgatgttgaggatgaggttatggatgaggaattgttcaagtccataaccaaggagtctctaccacacttgagtgagttgcttgggagaattgatgatcagtatgcaacccttgagaggaggcaagaggcattactcattcgtgagaaagagcggtctcatgaactcaagggtgagcttgctaaggagagagaaaaatgaggctttggtacggctttacaagcaaaccaaagagtctcacgctaatcttgaggtggcaaatgctcaacttcaagagagagtggatggcttggacaaagctgttaacgaccaaatttagtaatatcagcatcggaaaagaggattagatcgaagtggagccgaaggcggagatcgattcgagaatagagcaagaatcggctggagcctagatcggctacgattagaatcggttaagtccgagtaagactgggttaagtgatgcagccgattctgacaatacgacttgtattcgatatcgggtttgagttgacgtacttcaagatgattgccatacatggataaagtcctgggaaggcaattgtatctattaattaggatattttatgtaaatttcttagagataaatatgggcaaaagtctgccacaaagacttatggtatcttagagtttgttagagataatagtcgtgtcctgtatggacatatcttgtaattctcgggtataaatagaccccgagccctatgtaattttaacacacacgttcaatacaatttcggcgcatcgccacccttttgctttagttttatttcgatgatttctggctttcgggttgagctgcatcggtttcgatcttcaacaagaggtaaaacttgttatgtcggcttgtgttctcgggattagtgcttccatctttatgatactctaatcttgtttatgtaatttgctgagttatcatatatcttacataatctctaacgatatcgccatctagcctacaatcggctaacatctgttaatagagggcagccgattaggttaaatatcgatgttggtttagattatataagatacccaccactatatgaaacttccagcgacttgattgtctagatattgttcttcttttcatacgtaatgctgtatcagttgagtttgatctattaagtcgtgcttagaatatcaatatctagcctgccttctggttgccaattagggtagtatcggagtttcagccgatcttatctgatttaattatatttgctttatatgtttcattgacatgttaaatctgccctttatgtcaggatattattgcatctaagtatattaagcttctgtttggtatattctgtttgtttcaacatcttaacatagagttgtatcggagtattagccgatacatgctagatctatccgatcggctatgctataaacatatatagttctgttattaatatatatttcaatctaagtgatttatactgtcttggcatggcgaccgatctatcccaatcactcgatttatgtatatatcgatataaaattatatattgttgatatctacagtcgatcgagtaggtttagttctttattatctatttataaccgccgatagatttacatatgacatcggctcaaagataaatgatatgtcatcggcacttagccgatcgtctatcatttataggtttaaccgcggtttctttgtctctatttcttgttgattgcaggatcaaatcaactggcacgctaacatacccgaaggcgagctttggacctgcactggagttaagcagatctcgcaggcctcgtgttttacgtcaacacgcttttggcatgcccagtgggaccaagaagaagtcagcaagcaattcttcctcatggccgagaaaccaccgctatcgccatcctcggctagtccaagcactgttaaggaaaagatccagaagttgggattgaccgacgtcaatgaaggaaacgtcgtgcccatcgatccagaaaaattcacacctgatcagaagaaagatttcgacgcgatgatgcagcaggcacgggatcaattcttgaactcattcatgcagactagcaagggaacagtggttcagaagtataaagtaaaggtagttgccgatgatcctgggaccagttcttctaaaggtgaagacgggaaacaagctccggacggctcggctcaaccgagtgacaatggtgctacagacggttctctaggaggtcaacgtgacaattctcaaggagtccatggggttcaaggtgatggggtgcatggagttcaaggtgatgttgcttaggggttgcgtggaggaaattttaatcaggatggcaatgcatcataggagtttttcaataacttccaagatcgggttgactatgccgtgcacaatgctttgatcaatcaatctgggatgttagtcaatacattgtcaaatatgatgaagtcaatggtcgatggtacaatagctgaataccaagctgcaggcccagtttatttgcaaggaggagtatttccaaattatcggcctttgatcaccaacagtcatccatccgttcaagcagctccttctattgcaccatcggctcagccgatggcaccagcatcggctcccgcacctactgtaccaccttcggctccaggccaattggtcaatccccgattgctgataagagaacagccacaacacgctggacaaaatgtggatcggctaacacaagaccaggttgcatctatgtttttgcctccccaaaacactgttgatccaacccgcaacagccgattcagcaaacaccccaaatccaacaaattgtgcaaccagtgcagcaaacacccctagctcaatgagttgtacgaccggttcagcaaactccattaaggcaacaggttgtccagccgattcaacagcaaggttcaatgaattcatcggcagggtttgcaacacctggtgggcagcctgtgcaacatgctacaaattaggttgtcccagagcatttagtacatcacgtacaaccagatggcacggtaattccgctagttattcctgaacatttggtgcgtaatattcagccggatcttcaaaattaccagggggcaatttgaattatcaatatcagccaccatcacctcatgttcaataccagcaagcaggatcggctcagccccaatttgttcttcaatacaaccaattcgagccgatgccacaacaacctcaagggacacctcaatagtggccatgggccgatttgattgcagatgtcatgaaggagcagttcaggcttaggccgaaagatgctggaaatctatatcggcagccatatcctaagtggtttgagagagttcctttgcccaaccggttcaaagttccagatttttcaaagttctcatggcaagatagtacatcaacttatgagcacattagccgatttttagctcaatgtggtgaagcatcggctgtggatgctttgaaagttaggttattccggttgtctttagctgggtcaacctttacttggttttcttctttaccatatggatcaattaacagttgggctgatttagaaaagcagtttcatagctatttctatagtgggattcatgagatgaaactgtccgatctgacgtcaatcaagcaaaagcatgatgagccagtacatgagtatatccagagatttagggagatgagaaataagtgttacagcttgagtttaactgacgcccagttagccgatttggcttttcagggtatgattgctccaattagggagaagttatcatctgaagactttgaaagcctgtcacatcttacacagaaggtagccttgcatgaacaaaggtatgcagaggctaggaaaaattctaggaaggttaatcatgtttgcccttataaatatggatcggatgatgaagatgatgattctgagatagctgcagccgagtgggtaaggagtaagaaggttataccatgccaatgggtaaagaactcaggtaaagaggaaaggtatgactttgatatatccaaggctgataagattttcgacttgctactccgagagaaacagattcaacttcctgccggtcacacaattccatcggctgaagaattagggaagaaaagatattgcaagtggcataattctggatctcatacgactaatgattgcaaggtcttcaggcagcagatccaagcggctattgagggaggcaaaatcaagtttgacgactctaagaggctgatgaaggttgatggcaatccttttcctgttaatatggtgcatacagctggccgaacagccgataggggccgtgcaaggggttttcaggtgaattcggctaagattatcaacaaatatcagaggaagtatgacaagcagcaggagaagcatcatgaagaagatgacgatggttttgatcctcattgaggttgtgagttctttagattttgttgaaatgaaggtctaaggctgccgtctattgaagactgtcctgggtgcagtgatattgccaagaattcaagccgatcatatggtaggggcaatcggctaaggcagacaagagttcctgttcatcaaagattgggtccagtgaatcaagatcatggccaagaggacaatgaaatcaggaaaaatcagtggtgtccttctggtattttcacgaagaatcaaaagagaagggttcaaagattgaggaacagggagtgcttttaggaggttgaacaggaaattaaccatcggctgcagaaaacaaagtcgaggcaggagtggcgtgttaagaatcaggttcctgtagccgatgaagctacagctgaggaggcaaaaaggttagctaaggggaaaagtgtcgtaactgcttcggtcaacatggttttcacgttgcctgctgagattgggaccaagcaagccgatgtcgatgaagttgaagaagaatcagccaaattgattttgttgccagagcaggcaatttttgagaagccagaggggacggagaatcggcatcttaagccattgtatataaatggttatgtcaatgggaagccaatgtccaagatgatggtcgacggtggggctgaagttaacttgatgccttatgctacattcagaaagttgggcagaaacgttgaagatctcatcaagacaaacatggtgctcatagactttggcggcaatctatcagaaaccaaaggagtttcgaatgtggaactgacagttggtaacaaaactatccctacaacattctttgtcatcgatgggaatggttcttatagcttgttgcttggaagggattggattcatgctaattgttgcattccttcaaccatgcatcaatgcttgattcagtggcaagacgacaagattgagattgtgccagccgacaggtcagtcaatgttgctagtgctgatttagctctttgggagatggatggtctcgattgtttatctggaaaagtttgggatagagattttctaaaagtgtccgattctaatatacagccaattgaagatggagaacccaagctgttatttcgagggcgttgtggagggttcaaatgtctacatcaaggacacggtagatgatctcgatgacaaacaaggacagggttttatatcggccgatgatttggaagaaattgatataggtccaggtgatcgaccaaggccgacatttatttgtaagaatttatctacagaatttagagccaagttgatagagctgttgaaagaattcagagattgcttcgcttgggagtattatgagatgcctggactcagccgatcgattgtagaacatcggctacctatcaaaccaggggttagaccacaccagcaacctctgagaagatgcaaagccgatatgcttgaacctgtcaaagttgaaattaaacgattatatgatgcttgttttattcgtccttgccgatatgctgaatgggtttctagtatagttcctgttattaagaagaatggtaaggtcagggtgtgcattgatttctgagacttgaataaagctaccccgaaggatgaatacccaatgccagtagccgatcagctggttgatgctgcgtcagggaacaaaattttgagttatatggatggaaacgtaggatataatcaaatctttatggccgaagaagatatacataagacagcttttagatgtcctggtgcaatcggcttatttgaatgggttgtgatgactttcggcttgaagagtgctggagctacatatcaaagagccatgaattacatatatcatgatctaatcggctggttggttgaagtctacattgatgatgtggttgttaagtctaaagaaatagaggaccatatagccgatttgaggaaggttttcgagagaaccagaaaatatggcctgaagatgaatccgacaaaatgtgcttttggtgtatcggttggccagtttttgggatttcttgttcatgagagggggattgaggtgactcaaaggagtgttaatgcaatcaagaagattcagcctccggagaacaagacagaactacaagagatgaacggcaagataaattttgttagaagatttatttcttatctgtctggaaggttagagccttttacaccattgttgagattaaaagctgatcagcagtttacttggggggcagagcaacagaaggctttggatgatattaaagaatatcttagctctcctcctgttttgattcctccacagaaagggatatctttcagattatatctatcggccggtgagaagtcaatcggctcagtcttgattcaggagttggatggaaaagagcgcgttgtattttatctcagtcgtcggctcttggatgttgaaactagatattcccctatggagaagttgtgcttgtgtttgtatttttcatgtacaaggttgagccattatctactatctaacgagtgtactgtcatatgcaaagccgatgttatcaaatacatgttatcggctccgattttaaaaggaagggttggaaagtggatattttccttaactgagtttgatctaaggtatgagtcgccgaaggctattaagggacaagctatagccgattttattgtggaacattgtgatgattcaatcggctcggttgaagttgtgccatggacttcattctttgatggatcggtgtgtactcatgattgtggtataggcttggttataatttcccctcggggggcatgtttcaagtttgcttatactataaaaccttatgcgactaataatcaagctgagtatgaggcagtgctcaaagggttgcaattactcaaggaagttgaagccgatgctattgaaatcatgggggattctttgctggtaatcagtcaattggcaggggaatatgaatgcaagagtgatacattaatggtttataatgagaagtgccaagaactgatgcaggaatttcggctggttactttaaagcatgtgtctcgagaacaaaatattgaagctaatgatttggcccagggggcatcggggtataagccgatgatcaaagatgttaaggctgaaattgcagcaataacagccggtgattggaggtatgatgtgcatcaatatttacataatccatctcaatcagcttctaggaaattgagatataaggcgttgaagtatactctattggatgatgagctttactatcggacgattgatggagtgttacttaagtgtttgagtgccgatcaggctaaagttgcaatcggcgaagttcatgaaggaatttgtggtactcatcaatcggctcataagatgaagtggttacttcggcgtgcaaggtatttttggccgacaatgctggaagattgtttcaaatattataaagggtgtcaagattgtcagaagtttggagcaattcagcgagcgccggcgtcggctatgaatcctattattaagccatggccattcagaggttggggaattgatatgatcggtatgataagtcgaccatcgagtaaaggacataagtttatattggtggcgactgattatttcaccaaattggtagaggcgattcctttgaaaaaagttgattctggggatgcaattcaatttgttcaagaacatataatctatcggtttggtattcctcaaactattacaaccgatcaaggttcaattttcgtgtccgatgagtttgttcagtttgtcgatagcatgggtatcaaattgttgaattcttcaccatattatgcacaagctaatgggcaagccgaggcatctaacaagagcttaatcaaattgattaagagaaaaaattctgattatcctcggcaatggcatactcggttggacgaagcattgtggtcttatcggatggcgtgtcatggatcgatccaagtccctccctataagcttgtttatggacatgaggctattttgccatgggaggttagaatcggctctagaagaacggaattactaaatggcaagtatttgaagaaatattacctaagtgtttgggttaatgcatgatcggctgatgttgccgatacatgatagccgatgaattttcatcgcctagagatggccgatattgttatatcgcccttagttttttttttccaattgtaatcggttatggtttaccgatgtgcaatggccggtattactatatcgccctaagttgcttgtataattttattaatgctgttgacattataaaattagggggggcacatatattcaaaaatcgcatgatgaaagtgaaaatttttgagcaaatttagaagttgtattaatcggcacaaaggtagtgttaaaacagcggggtattaaggcatcttagccgattacaaaaatttctaggtcctattacacaagagttattgagataagtactgctggatagcctaatttgttcaacttcttcaatggcttgggcatcttgagcatcagttccagagatgaccttcagggacttggttaggtcagcaacattcttgatagtcgatttgagccttgccttttgttctttgatagattttgggagatcggctagctttttgtgctccatatccagttcagcattgcattcttcaagctgtgccaagagatcgatcttgtgagcttcgagccgatcaatattggacttaatcggaccctcagatagctgatcgagtttgactttttcttcatgcacaagctgccgattgacctggattgtggcttcaatctccttgcgctcacggcgttcggctagtcttagcttggctttttccagcttgaactgatgttgttcaagataagcggctggagttaggacatcggccaattcttcgggaatcagagcttgaacttcatgcagccgtgtcctaattgatccgcagtcaactaccaagctatctaaagaagaggcttctagctagccgttgagagatatcttcaagtgttatctttacatcgtcagatagaggagctaaagctttgcttgaagtatcttcttctgccttatcaagataatctctgatgtcaaaagagaaaagatcggctaaaacctgcagagacaatttcggaaagagtaagagctgggtaaaatgtagctgatctaattattgagacaaagaaaaacttattgggatagcaggagcagctggttgttcttcctcctcgatgtgatgactctccacagccgatggagtctggtcacttgacggttgctgtacaggaggagaaggaggaggaggaggctgtagaatagacaagtgttatatagagccggttgagattgattaagtaaaagaattaaagacatcttactggtggagccgacttgacaattgttgctgctggttttttcttcacagcagttttcttcttctgcaaccacaaagtctatgagtaattagccgaagagtcgattgtctgtagaacaaaaacaagagattagtcaagtaatgaatcggctaacaattattcaagctaacaatggtgaggtttacctgaggtatgacatcagggaatagatctgtcatatacatcgaagctgattgatgaaacaagtgcaacttccattcaccccaccatctgtcgaaatttttgcttctaaatcctgccaactcaatattatcaatactgcccagaaggggtcctggtaggttaagtagccgatccatcattagagtggatgtgatttctcctcggcactgaatcttgtcggcaaagaataagctgattgggagttggcacaatccaagttgtctggccgagctcattgggtgataaaattcgtaggagacttagatgtttctcccttggtgaatgttgacatgaaggatgcatggactgattgaagctgtaagaacttctctagatttttggaatttttcatgattaatgtcttgaaatctaaagtctgatggaagttcaagatctgctgagtcttcataagaaaaccacacccgtgcatctttcttaaaaccttcgtagaagctgcagaaccagtccttgagtagctcagccgatagcttcgctcgagcatcggtttgtgtggatgtatattctccgtatgatgtgcatatgtgatgagtgcgttcttctccatcgtctcctacaatcggctctggcaatgggaactcagcttctgtcacaggcggctgattgaaaactttcctaaccatcaggttcaaccaggtttgtagcagccaccatggtctacctgcaccaactactgagccaacggctattttggccgatgcgttgttcaatgtttggtataagtaaccgaggaggatcttgcctaatggaaattctttctttgattctaaggcttcggctacaaattgctagttggttgtagggccacaactggatccacagaagaggaacttttctagccacatgagcaagaaagctacatgctctcgaggggtaacagatccttggcccatatatgccgccatatagccagaccagccacctatgcttttggttctgaaatcaaactgatttttggtgttcatgctcatgggattagccgatgaagttacatctaaaccggtgatcatggtaatgtcgatcaaagttggagtcattggcccttggttgaacaagaaggcgttaatggtgttggaccaaaaataagaggcggctgccattaagggctcgtccttagctaagttggctatggttaggtcaagtgcttggccgattccaatctcatcccagtgaactttcttattagccgatacgcgctggtaccatgtgatccaacttttctcaggggtggttttctcaagagatggccaagacttgaaagtgtttttccagtggctcaggttagggttggctagcctaaaggggatcctattggtttcaccaatgataaaatcagtggagtcaagattgccgattggacccagaaaatagtggttttcatgcgacaagctgggaatcgcaattaggttggaaagatgctgcaaatccaaagcaaccggaaagaagaagagcaatgtgaggtaaggaaaatcgatctgctgttgagaaaggggatctagccgatggggacttacctcggcatactcagctgatggcgcagcagacgggctggcggaggacgacatcgttgcgggcggagatctcgccaagggtgaagtcgcctggaaatcgctttgtgcattggaagaatcgccgtagagagagaaggcagagtttcacttgagcggtgaaaacgggagtaatggtgtaagatttctctgcggcatcggtaaattgaaaccatgccattataattttgcaaagtttgagatatgccatcggtatctcaatgacatgtaggacccacatgagtcaatgacatgtgggtcaggatggcatatctcaaattttgcaaaattataatggcatggttccaattttccctagtatttaaagcgcttgaataacagtcggaaaacggtaaagtgcgaaacttgctcggagtcgatgttaagaaaatccgaaacattaccaaatattccggacttggggggcatgtgttaacgaccaaatttggtaatatcagcatcggaaaagaggattagatcgaagtggagccgatggcggagatcgattcgagaacagagcaagaatcggctggagcccagatcggctacgattagtatcggttaagtccaagtcagactgggttaagtgatgcagccgattccgacaatacgacttgtattcgatatcgggtttgagttgacgtacttcaagatgattgccatacatggataaagtcctgggaaggcaattgtatctattaattatgatattttatataaattttttacagataaatatgggcaaaagtctgccgcaaggacttatggtatcttagagtttgttagagataatagtcgtgtccggtatggacatatcttgtaattctcgggtataaatagaccccgagccctatgtaatttttaacacacacgttcaatacaatttcggcgcatcgccaccctttttgctttagttttatttcgatgagttcttgctttcgggttgagctgcatcggtttcgatcttcaacaagaggtaaaacttgttatgtcggcttgtgttctcgggattagtccttccatctttatgatactctaattttgtttatgtaatttgctgagttatcatatatcttacataatctctaacgatatcgccatctagcctacaatcggctaacatctgttaatagagggcagccgattaggttaaatatcgatgttggtttagattatataagatatccaccactctatgaaacttccagcgacttgattgtctagatattgttcttcttttcatacttaatgttgtatcagttgagtttgatttattaagtcatgcttagaatatcaatctctagcctgccttctggttgccgattagggtagtatcggagtttcagctgatcttatctgatttaattatatttgctttatatgtttcattgacatgttaaatctgccctttatgtcaggatattattgcatctaagtatattaagcttatgtttggtatattctgtttgtttcaacatcttaacatagtgttgtattggagtattagccgatacatactagatctatccgatcggctatgctataaacatatatagttctgttattaatatatatttcaatctaagtgatttatactgtctcgacatggcgaccgatctatcccaatcactcaatttaagtatagatataaaattatatattgttgatatctacagccgatcgagtaggtttagtactttattatctatttataaccgccgatcgatttacatatgacatcggctcaaagataaatgatatgtcatcggcacttagccgatcgtctatcatttataggtttaaccgcggtttctttgtctctatttcttgttgattgcaggatcaaatcaactggcacgctaacacacccgaaggcgagctttggacctgcactagagttaagcagatctcccaggcctcatgttttacatcaacaaaagcttatctctctcttgaagagaagttcgaaaccttaaagaatagtgtctctctccctagcgaggcaccttgttccaaaattgttccaagcaatgaaccatgtgctaggtgtaaggatattgatattgatgcttgtgctactaactctacttccttaagtgctttgcaaaagcaaaatgagaagcttatgggactccttcacaatggcttgcttaagtgccatatgggtagtaaggtactaaagaaatacctaggctatcaaagggacaacttcaaccatgaaggccttgggtatgttcctccaccaaaaggaaaggtggacaagagtgtgttgatcaagaagccccaaggtcttagcatctttgttaaggccaaaagtatccttcctaatggtcatgcttcacattgtccttttgatgtatcatatgttcttaggaagaatgctagtggtcgtgtggttgctaaatatgttgggcctaggggcaaaaatgtttccatcaagagagttctttgggttcctaaggcacttgtcactaacataagatgacccaagaaagtgtgggtacctaaaactagaaattgatctcttgtaggaatatctctccggtggaagaagttgggtgattgatagtggatgcacaaatcacatgaccagagaagaatcaatgttttcttcccttgatccaaatggcactttgcaagagaacatactcttcgggtacgatggaaagggaaaagtaatgggattgggtaagattgcaatctccaatgatctttccatttctaacgtcctcttggtaaaatctctaaactataatctcttgtccatttctcaattatgttccatgggctacaattgtctttttaccgatgttgatgtgaccgtatttagaagggatgactcctcggtagtctttaagggtgttcttaaggggatgctttatcttgtggatttttcctcaactaaagccaaacatgagacatgcttagtggctaagtccgacatggggtggctttggcatcggaggctagcccatgttggtatgaggaatcttcacaagcttctaaagcacgatcacatccttggtctaacaaatgtactttttgagaaagatagggtgtgtagcgtgtgtcaagccaggaaacaaattggagctcatcgcccggtcaagaacgtaatgactactacaagaccgttggaacttcttcacatggacctcttcgggccaattgcttatctaagcattggaggtaacaaatatggtcttgttattgttgatgacttttcacgcttcacgtgggtgttcttgcatgacaagagtgagacacaagccatcttcaagaagtttgcaagaagagcccaaaacgagttcgacctcaagattaagaacatttgaagcgacaatggcaaggagttcaagaacacgtgcatcgagagtttccttgatgaagaaggcatcaagcatgagttctcggctccatactcacctcaacaaaatggagtagccgagaggaagaatcggactctcatcgacatggcgaggacaatgttggacgaatacaagacatcgcaccgcttttgggccgaagccatcaacaccgcatgtcacgtcatcaaccgcctctgtcttcaccgtcttcttaagaagagtccctatgagcttcttaccggtaacaaaccaaatgtctcttactttcgtgttttcggtagtaagtgctacattcttaataagaaggctagatcctcaaagtttgctcctaaagtggatgaagggttcttgcttgggtatgggttaaatgagtgtgcataccacgttttcaacaaaacctccggtattgttgagatcacgcgtgatgtgacatttgacgaaactaacggctctcaagtagatcaagttgactcgcatgtgttaggtgaagaggaggtccctagcgaagcaatcaagaggttggctcttggagacgtacgtcctagggagccacaacaaggggcctcttcctcaacacaagtggagccacctacatcgacccaagccgacgatccctctacttcaagcttggatcaaggtgaagaaggcgagcaagtgccaccctctccgataaatctagctcacccaagaatctaccaaagtatccaacgagatcaccccaccgacaatatcttaggagacatcaataagggagtatccactcgctctcgtattgcaaatttttgtgagcattactcgcttgtgtcttctcttgagcctctaagggtggaagaagctctaaatgatccagattgggtgatggtgatgcaagaggagttgaacaatttcacccggaatgaagtgtggactttggtggagcgaccttggcaaaatgtgattggcacgaagtggatcttccgcaacaagcaagacgaggccggggtcatgataaggaacaaggcgaggttagtggcgcaagggttcacccaaattgaaggattagatttcggtgaaacttttgagccagtagctagacttgagtcaattcgcatattgcttgcttttgctactagcctcaattttaagttatatcaaatggatgtcaaaagcgccttcctcaacaggcctatcaacgagttggtatacgtggagcaaccaccaagcttcgaggatacaaaatatcccaaccacatgtacaagctccacaaggcactctgcgggttaagcaagcccctagagcttggtatgagtgttttcgcaattttcttatgaaaaacggctttgagatcgggaaagccgattcaactctttttactaaaagacatgataatgatatttttatgtgccaaatatatgtcgatgacattatatttggttctactaacaagtcttttagtgaagagtttagtaggatgatgaccaagcgttttgagatgtcgatgatgagtgaattgaagttcttccttggccttcaaatcaagcaactcaaggtaggaagtttcatttgccaaacaaagtatttgaaggacatgctcaagaagtttggaatggagaatgcgaagccaatccacactcccatgccatcaaatggccattaaaagacgtcgaccaaaaggtataccgttccattattggatcactcctttacctttgtgcatctaggcccgatattatgattagtgtgcatgtgtgcaagatttcaagccgctctgaaggagtgtcaccttgtggccatgaagagaattcttagatatttagtgcacactcctaatctaggtctttggtatcctaagggagcgaggtttgatctcattggctatgccgatgcggattatgtcgggtgcaaagtggataggaaaagcacatcaggtacttgccaatttttgggtaggtcccttgtttcttggtcttccaagaagcaaaactccgtcaccctatccaccgccgaagcggaatacgtttcggctaggagttgttgtgctcaacttctttggatgaagcaaaccttgagagactatggcctaaatgtgtccaaaatcccactcatatgtgacaatgagagcgccattaagatagccaataaccacgtccaacattcccgaaccaaacatatagatattcgccaccatttcttgagagaccattccacaagaggcgacatagacatccaacatgtgagaaccgacaaacaattggcggatatcttcaccaagcctctagatgaagctaggttttgtgagttgagaaatgaactaaatatcttggattctcggaatgtggcttgatcttttgcatacatttattttcatttactagaataagtttgcatgccacatcatgacaaagtgcacattcaattcatgaatggacactagtcataatctatgtggatagcttgaatctatgtgtacgggggtctcattctctaatgaatcttggtccttgcacaatttgctatagattcgtacattccctctctcgagggtgctaagttatttctcttgtgctgcttttgcccaagtaatagtctagccatcaagttcattctctttgtgccatcctttattgtctctgccaaaggatgtcggactgtctgacatgatgtcagacaatccgaccacatcggatagtctgatttcaaatcagactatccgacgtggggccgagggcaaggggacttaacctccccaggggtaattttttttaccccttcacccatttggagcagtcgttttctctctccactcaaaactctagttcttggccaccaaaaatcttcgtttcgaagtctccgactgctattccttcgctttggggtggtttccctccctcaactccttccaaatcactggttccctagtgattttcttggtggttcttgaggtatttccttgtttttcttcgatctccgtcatggtgcattatttctatattcccttcggtgaaccatcttgttttagtgcctagacctagttcctagaagatcatttgattccatcggatatttttgtgtgaatcgagatttgttggtctagggcaaatggctgtcggaatgtctgatatgccatcagatagtccaacggcaaatcagactatccgacctccttttggcctagatcaaagttcttttgattcatgcctaaatattctccttccaagttattcttaatcattatcctctgttctaaatcagtgtatcctcatgatcaagggtcagttcaagaatcaagtttactctcgccgtgttccaatgagttctcgaggtcgttctcccacttccaaagctcgccatgctatacgtcgaatgtccgaatcccgcaaagatgctattgacacgcaagctcaagcctctgaagatatagcagctcaagtggcaaatgtggagcgaggtgctcctcttcccccctcgccgcagccgagtcagtggagaaggctcaagtgctccaactagcaaagtgaggcgaggcaaccccacggcttcttctgatctggggcaagatagtggttctcatgctccatcctttgaggaagagattcagttagaagaggacattgccgctcagcaagccgctcatgaagaagggcctttctttgtcactgctccctctagagatcctaattatcatcggagagtcacaaggtggaaccgcaagtggactgaagtggagaaagagcgtaagaaagatccctacaaatatcaacagttgtccactgatcctcggttttggaacctttttcagcaggactactatgagacagtgattgcacctaagaagggggcgattctcatgcagtgggttgattggaagtatatggaggagttgcatgatccaattattaatgaagtcattgaagcttgtgctcggcaaaacttgaaggaactaatgggcttgcaatacccatggtgcaaagagatcatcgcacaattctatgctaccgtttactttgagccaaacaaagaaaagattatccattggatgacagatggcatcatatactcagtgacatatgccaagtttgctgccattttggggtttccggctcgctctcgcaccaatcgtgtcaagattcatgatgagaagcccatggacacaaattctcttcacttcttgtaccaagatgtggactatgagttaggcaccatcaaaggtctccttcctttctatgcctatctcaacaagctcttgcgcaaaactcttaatcctaaggaaggtgatgctagcaatgtccttgcctatacaagaaatttgctccacaagatgaaggcacacccacagctctttgatgcttttgacttcatctttgaaaaaatctggcttatctccatgatacctaagcgaggacatggctatgggccttacattatgaagatgattgagattgtgtccaagaagaagtttcacaaggaagtggctcacaccggttaccaagttcgtcccatcaaggctgtttccgtgccggctggtcgaaccactcgtgcttcttctcgtgctggtccctccgctactgtcacctcgtcggactccaactcttctttgcggttcttcaagtccatctttaacatgtgcaaaaccatctcagttcatcaagccaaggaacgcagagcaaggaagaaggacactcggcggatcaagaacctccttcacaacgcccatttgctgttgacggagcgtggggctcctcaccgggagaccgcgcaggcccccctttgccggttcggccgggggcgctaagtgaggttcttcgccctcgatctgaggaacgtcagcgagagaggaattgcacaagacacgggcgacgtagacaggttcgggccgctgagaagcgtaacaccctactcctgtgttctggtggatctgtgcgtgaaggaatacagagagccggagagcgagagagagttcaggctctagaacccattcgccagagtcccaacccctttctcttttctctcctccttttttttccctctaggcctgggcctcctttttatctggtccggggtcaccacacgggcctcctgctgcctaagaaaagaaacatgctttttacaatgagggctagtctacatccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggaagagagccaggaagctctcatcattccgacgggacggggcgaggtgtgtgacaggccgcctgttgccacctaacccgcgatctgaccggtctgtgaccggtcacacaccgtgaccggtcacggaccggataagcgtgcactgcgccgcattaaatgcggcgtggcgcgctcgtccaacctgctataaatgcggttaggtgagcccggtgggcccacctaacccacacacgtggcgccaaaaccacagggggtcggggcgccccagccctcggggccgaaacgggagtggcccgacccctcggggagacagagggaggggtggccacgtcaccctcgggcccgacccccccgagggggtcaggccacgtgggtgaccgcggctacccaagcctctagtcacgatacccccggccccatgtcaccgacagctgtgttctcccgatgggtttgaggttgaggacagtggggaggatgtatttgaggacccctttgcagctgaggcaagctcctctcgtgcagatcgtggcaaggctcctatggaagaagaagaagaagaagaggaggaagatgacaatgatgaggagtcaagtgaggaggacaaggattttgatgaggatgagtgatccactctcttttcccttttagtgccttgatgccaaagggggagaaccaacctacctatcaaaacttttaaaaaaaatctatctcgttttcgtggtggctagttgaacattgggcttttgtgtcatgtttaaagtctttattatgcatgtttatgtcttgttgaacctcgcagacttggatgatgttatgtgcatgttatatgaaattatctcttatccatgcttaaatgagtgatgtatcttgtcatatgcatatgcatgaggttatattgtgatttctaatcttttgcatagattaagggggagctctcatattcttttctagcttatctttagggggagctccacctaaatcctaatcttttattatttctaattgtgttgtcatcaatcaccaaaaagggggagattgaaagtgcatctaggacccctcatttattttggtgtttatgacaacacaattagaggttcactaatgctctttgttgagatggatgcaaggataaaaaggagtggaacttgaatttacaagctttgcggcatattttctggtaattgtcttctattccatgtatatcttgtgttttgtattaggatgccgtactattaagagggataccacatgcatataattggtagaacactagttctcaaaatcctttatttggactgttcctattttattcctgtcagactatccgatcctgatcagactatccgatgctcagactatccgaaatttcttagaactttgccctctatctttggtctgagtgttggctaaaaaatatcggactatccgatataaggtcggattgtccgatacatcggactgtctgaactttctcagaacttcactctctgtcttgaattgctttttattcctcttgagtgatttttcaaatcagacaatccaatgtgatcggagtatcggatgacccagagactccgaaattcaatggaacttgagtccctgtgagaggatgaaattcatgattcaaaaataacggaatatccgatatgacatcgaactatccgatctatcggattgtccgaaattctccagaatttcgttctctgtctctggcatgcttgggggtcaaaaacatcggactatccgatgtcacctcggactttccgaggtgggatgaaaatattctctcccaatggccacattttgggggatctataaataccccccacctaacccttttctagggttacccaactcattcattcacattcactttgggttgagcttggtgctaaggtgctttggatatttgagctctttctccctctctcaaatccctcctcgttctttgtgtggtggatcttggtggttgtggatttggtgtttgagggcctactgtctgtttcactcgatcttgagcactagggtttgaccaagagttgtgtggtgtttgttactcttggaggttgaggactcctagacggctaggtgttactcccgagccaccgatctacgtgtggttggccgggagaagtttgtgaaggccggatctcgcctccgcaaggaaagagataccccttagtggaaggaggagtgcttagtgcaacctcttgaggaaagggttagcaaagaccccgctcttagtgagctcctcaacggagagtagaatcccctcaaggatttgaactccgggaacaactcggtgaacttcattgttggtgatatctcttcatcccttctttagctttgcttaattgtgccgctatagatctagtcagtgtttgcgctatactcctgtttgtgcactagatctacttgtgtttctttagtggatcagacagtctgatccaacatcagactatctgatattttcggatagtctgactgtggatcaaactttctgaccctaactcagttttagcttccgcataaagttttaaattagcctattcatcacccctctaggcctatttgaccatttcacaccccccccccctctaggctacatctttgcgtgttcaggtgcttggatgtacgcgtgggcctagacaagcaagggaaggtcttcgacacggcctttcctatgttatactagatgatttgggaagagagaaatgcatggtgttcgaggcagttgaataaagagtgaagtagttgatgccctcacaaaagaatggtggacttggaggattggtttgcttgatgcgatgctcacgccacaatagacattgttcccttatcgtaatcacgcatgggtgctgagccgggacgccctagtccgtgcttacttggtaggtgactcaggggcggacgtacccattgagcggcatggggcgatcggcccagctatggcatgcgtcgccccaacccctcatattctccttgggccgcttaccaccacattttattcataattggcccataagtgagaagcccgactgtccaatttaggattttcaggaaattagggagtctatctataggcacacatgtgtgcgactcctcggtaacggcgccatcaacgcttcgtctccaccgtgaccgcgactctgcatgccgcgctcgtctcgctacttgcactcttgtaacatactcaaattctagaccttaaaaatttcatgtcaaaatagttggaagctaacttttccatttttgtggaccaaaattttccattttaaacctagttgaagttgatctaattcttgcatgaataaaaatttgagggcgaattaaaacattttttatttataacctatgacaaaaatgcaacacaagtgaaagcatgcaaacttgcataaaacatgttttgacttgagtccttcatgtgcatttggattttcgatttgtatttcataataggtctcatgaataataactcaaatctagataaacaactaaaccatcagagcctagtgctaactattggaaaataatacataggaaccatagtacaccttaaaatatatcaacaaggccgatgtcaagccccacaaaactaatttggtcatccatctaaagacaagtcatgaacatgaaagtgaataaataaattaactcatatagggtaaattctatcttaatcgtctctataagcattctcttaatttatactaaagtaaacttatacataaataggtaagaagcttatgacatgtgtaaggtaaactgtaattctaacatatcaacatcatctcaggttaagaagagtccaaatataacttttataaacatttacatacatttaggaaagggaaacacatataagagataagtcttgctaattatctaaaataatttgtgcaagataaaatcatgggaaaattcatgtacgctcacttaacatatacaacacacagtaattttgatacaatttaataactaaatttgatacctcaaataaatcaatcaaaccagtcgaataatagactattcctaatcggcaaaaaccatactttatttaaaagtgcatttaactgcatggaagtgtatagagaaaataatttattcaaatactagttcaattatcatgagtaaatataatttttccagaatttatttcctttgtttagctcttctaaaaattctaactagtttccaacgagcccatcgtctgctaatttctgtgagtaatctatccatatatttttagtgcaaccaaagaaaatggaatctaataaatggaatctgaggtatctttatctacctccactaaaatccacatgaattgatctgcgacacaaattaatgaatgaattaacaaagaagggaagagaaatatatcctggaaaatcgtccaaaaatcaagtctacctatgtttctacccttccctttctccctaaccttggtctcatcgttttgggcccactcatcagtggctgtggctcgcttcctctctgtgcaactcctccaaccgaccagcagacaagagagaacgtgagagggagatatcggcgccgacaactctcaggcgcgctcgacgcgtgtacatcgctgtggcaacgccgagtgtggaagcgaggaactcctacagagaggaggttacgtgttgataataatgccacaaaccaggcaacaggatacaagagataaatagcttcagtgagagtttgttgtgtacagctaaatttcagaaattgatcctatcttgtctaactaacacaacaaactctatcctcagccatacgggagcattatcacatgtacatgcaatatatccgaactctaacactccccctcaatcttatcctgtaaggtttagatttttcctaaacatctctaactgtttaacagttagagtcttggtgaatccatctgcaacttgatcatttgtggatatgtattctacctgtaacaacttccgtgcaactcgttctcgaacaaaatgatagtccacttcaatatgctttgtacgagcacgaaacataggattagctgtcatatatgttgcaccaatgttgtcacaccataccttagctgttttaggcgcttgaactcccaactcatgaagtaaggtctatatccacataatcttagcagttgcattagccaatgccttatattctgcttctgtacttgaactagacacagtagcttgcttacgtgcactccatgacacaagattgggtcctataaacacagcaaagcctccagttgatagcctgtcatccaaacatcctgcccaatctgcatcagaaaacgcactaacaagcaaggagttagatttactaatctttaaaccaagcttaactgtatgctttagatatctcagaatcctcttggcaacagcccaatgttctgttgttggagcatgcaaatactgacatactttgttcactgaaaaagatagatccggtctagtcagagtcagatattgcaaagcaccaacaaggtttctataccttgtactatccactggtccaagaggtgtcccttcatgagcacttaacttttatgagatagataaaggagtattaacagctttgcaatcactcatgttaacccgttttaacacatccttagcatatttttcttgtgccaaaactataccatcattttctttcttaacctcaattcctaggaagtaatgtaactcacctagatccttcagtgcaactcttgattaagattcttcaacaaggtgtcagtggcactgttagatgagctagctattataatatcatctatatacaccaacataaacattgtaacatctctcttgctataaaagaacaaagatgtatctgatttagatgacttgaaccctagctcacacaattttgtacttagcctagagtgccatgctctgggagcctgtttcaaaccatacaaggccttatcaagtttgcacacataattaccttgttcataaccaggtagttgcctcatgtaaaattcctcttctaaaattccatgaaagaaagcattctgcacatctagctgacgcagtgtccatcctctagagacagctatagacagtatggtcctgatagtagcagccttgactataggactaaaggtatcttcatagtctataccatatctttgtttgaacccttctgctacaagtctagccttatatctgtctagactgccatcagctttcctcttaattttatatacccacttacaatctatcacatttaaacctctcttgggaggtactagatgccaagttttatttttcataacagcatgatattcactatccattgcctctttccaatgtttatcccctagagcctcatccaaagtttgtggttccccagaagatgtaaagcaactatatctaacagtaccatcagtataaattttatcctttctaatgccactttgtaacctggttttcggtctcattacctcagtagacacaccctgttgtgcggcctccatttgcacagatgatccaggtggatgggactgctgcacgtcctgctctgggcacgtgatgatgctgctgggctagcggggagagttgacggcaggcgacgtgccagcttctgactggcctcccatcggcgaacgcgtcggacgcgcaggagagcgctgctgctagtccccctggattccagatcccgagcctgctgtcccatcatgcgctactgccgagggggattctcccgccgaaaccgccggcgctccgtgcacccggctgtgcgtagcagccacactcgcctgatctttcatttccattgcagttttctgcgctgttcctatcataagattctacagctatacaagcatcatcagtagcatttggtacatgaatattaaacatttgatcatactgttcctctcccccttgatccaatgtgttattcataagattagaaggaagcaaggagatttcagctctaagacgggcaccggcatttggatgaagtgttgcaaagggaaaaacttgttcatcgaacgtgacatcatgagaaacatacaccctgccggaagacacatctaggcacttgaaccccttgtggagattgctaaaaccaggaaacacacattgcttggatcgaaattagagtttatgagagttatagggacggagatttggccaacaagcacaaccaaaggttctgagggatttatagtcaggagcttgcttaaacaatcgctcaagaggagtatcgaaatttataactttactaggaagacgatttatgagatagcaagctgctagaaatgcttcatcccataatttaagtggcatagaagcatgggctaggagagctaaaccaacctctactatgtgacgatgtttacgctcaacagctccattttgttgatgtgtatgaggacaagacacatgatgtgatatgcctatctcattaaagaaggtgtttaacttgacatattcacctccccaatcggtttgcatagcaagaatcctcctatcaaattgtctttcaaaaagtttttgaaacttatgaaattcctggaaaacctcatatttgtgcttaaggaaatagatccaaacaaattcgtcgcaatcatcaataaaactgacataatatatctttgcccctacagaagtagaagcaggtccccatacatcggagtgaataagttccaaaggattatttgaaacactagatgatctaggaaaaggcaactgatgacattttgcctgttgacaggcatcacacacagactcattgactgaattgctaagacatggtaatttattttgactaaggattctaagaacgattggtttggaggagtgaccaagacgaccatgccaccgttcaaacgatggcgcagcagcgaaggcttgtctcaagggtgtgccgacaggaagagggtagagacccagctagcatggtccttcaagaattgtccttctcatggccttgtccttaatcaaaaaatattttccatgaatatcaagaaaagcataattatctgcaacaagtctatgaacaaagactagatttttcgatgcttgtggaacatgaagtatgtttttgagatgtaaaggacaactaggggtaggaacaatggtatgaacaatgtgtttaacattcataccttcgccactgaccgtgtggatcagatctgttcctttgtacttctcccttgtggtcagcttgtccagctgccctgtgatgtgatctgttgccctagtgtcaacataccagtttgtgtcgacaccataggcatatgtggccgcaccacccagcttctcgtcggggccgtagttctcatcgtagcgatgccagcagtcacttgcaacatgacctcttttgtgacagacttggcacaccgggcgagtgtcattgccacgccctcgcccaggattggcaccgcctgtgttcccacggccaccaccacggccgccgtgaggtgcgctgctgcgcccgccacgatttccaccacggccaccacgaccaccgcgatttgcagcgttcgccgacgtggtgaggtaggcttgacgaatccgaatcctgttttcataactcaagagttgagaatacacatgagaaattgaaaggggtgcgattcttgctgttgccatcaatccttcaactgttgcgtcgaagtcggagttgaggccgttgatgatgtacgctatcagctcttcatcgtcaagaggcttccctgcacccgccatctcgtcgccaagagatcgcatcttggcgatgtactcggagatggaaatgggtcccttctgagttgtcgttagtgcaaggagaacgttgatggcaccagctttggacttgcaggtgaacatgtcgttgatcatgctccatgcttgggccgccgtctttgcgccagccacctgctgcaggacctcccgtgacagggaggagaagaggaaccccagcacctgttggtcctgggtgaaccacttgatgtattctggattggagatggtggtcttgactttcttgtcgccatcttctttctcacactcggccgccggagcttcagctgtgccggtgatgtacccttctagctgcgcaccccgtagggtggtaaggatttgtgcagaccagagggagtgattttgcttggtgaatttctccaagatttggatcccgaacaatgggttggagatcaccaccgctgaggaagaactcgccattgcagagatgcagaaacgagctaatctaatctagcggggtgctctgataccatgtggaagcgaggaactcctacagagaggaggttacgtgttgataataatgccacaaaccgggcgacaggatacaagagataaatagcttcggtgagagtttgttgtgtacagctaaattacagagattgatcctatcttgtctaactaacacaacaaactctatcctcagccatacgggagcattatcacatgtacatgcaatatatccgaactctaacaccgagctcactctccatctctcccacagtcgcatcgcctcgcctcatcctccagtcctgtgccgagagaaccgagggagagagctcttgctgctctcctcgccttcgatctcaccaccagccgtgacaaagacgatgctcgtcgtcgccgacgagtcttcgccaaccctatctcttccacgttccatactctcctcaccatgcccaagattctccttttgatttcatcctctttcgtacagcgaatcaacgggaacgccactgtgtcatcgccggccttggggcgtgctctgcgcgacgccgttgtgacctcgtcgctgttcccgtcgttctggaccaaatcaagcagagccatcgcgccatcaactcctccatgagatcctcttaaaaacccctcaagaaccgagaagaatggagcaccatggacggagatcggcctccatcgtcttcaacttcggccactgtcgccatgaccaaattctccttcgctggtgagcccctcatcgattctttgcacatgcaccatctatgggacctaatcaacctcttggacatgcatgcatgtgtttgtatcataatttggcttatagttagttcatttgtgcaggccaaattattttggaatagatggtgaaattatcttatgatttgcttgaaatcaattcagtttacatgtgtagaatttgtgatgcaatagatggttccatgtaaattggagggtggctttatcatttgatcatgtgagggagttaaagttgcttgatgccagtctgaaagcagaagcagagcaggagtcagatgcatgcaaatttgcagatccttgaggagttcgtgttgctgaccgaacaaatttgggtgccgctgcgtcccgcgtgcgatatggagttttggcgtcggttggcaggagatgggatcatgggaaccggtgagttagcgcgttcagcggtaaagataagaatggatttttattagtttatttccttgtttattttgtgtgggaccattatcattttgccggtatatactccctccgtttcgaaatgtttgacaccgttgactttttagcatatgtttgactgttcatcttatttaaaaacttttgtgaaatatgtaaaattatatgcctacataaaaatatatttaacaatgaatcaaatgataggaaaagaattaataattacttaaattttttgaataagacgaacggtcaaacatgtgctaaaaagtcaacggcgccagacatttcgaaacggagggagtatatcggtaacagtagaacgggagaacccccaacaatctatcaatctactatttttctcattctttacttttccgttattttctattttgttttcatagctggattctagcaatcctaggatttggttaacctttgccattttgtgctgaaaaacggtcgtgcttctccacgaaagcgaggaggttattgtcgaaagaaattttcggcaatatgaaaaggggatagcgcacgagacctaaaagtggatggatgcggagacaaggatttagacaggttcaggccctctcaatgagaggtaataccctactcctgtttggggatttaagtccgccgggtgtattatagatctgacgatctagttgtctcatgccgcctagagggcctcctgcccaccttatataggatgggggcaggattacaagatagaaaccttaaccaatacggtatcggtttcctaaatctactttacaatcttatcaaaccaggactttaggccgttccataatatacagggaaacgtaatatccaagttatgatccgttacatatttcatagatataagttatcccctataaccagtcggataaccacgccgtgtgggtatggggtacccataatctccatagtagcccctgaaaccttcgcagtcgaaaagataatcttctctcaaatcagattactccaaagccgagtgcttcaatcatcttcgtcatggtctcccgagtacttttaccaaatctgaagactgtggagggctgaaaaataaagtcaggtgcatcgactagatgcaccaaataggtgtagctcccgactatgtggttaattgaacaaaccaagcatatagttaaggaataaataatccaaccaactgagtggtttttgataattatagtcaaccaagtgacttgataccaatatatagcatatgcggtgtgaatccccgaataatatgatccagatgatataccgactgctttgcagaatatgatgcgtgcaacctaaagttgacaatatctttgaaaattcacatagcataacagctataaagaagagcttgctgttgtgaataaagaaacttccaaattattgggcatacaccacacgcacactgctttaacagatgtgcttaagtccctaaaagacacatggtttcaccacagttatctttgctagtttgcccagaaactaatcgtttgtcgtcacgtaattatgatatttatcatttttctaatttgcttgtaaattagtcgtgtgattccgcggaagtgaattaatctcgaaatcggtttcattagccgatctatcgattttgaggactctattatttacaccgcaaatcgttaggtgatcatatgttgataaaaaaacgtcaacagcatggccactcttcaagtagattgaaccgacgccgttacctcggaggttcttgccgctgccgtcatgtccgtccatcgtcaagatcccgtcgggcctctgtaagccattttcaagcttcggtgagcacccttgagtaccttaagaccacatgcatgcactatctcacatcacattgctctagaactcgacatgcacaagcaacccgagacatgccgctgtttccaccatcgccaccatctattctgtccactatggcttgtaacaagaccaccattggctttgcaaagaactcatctaaattttctatttttaccccaacgtcatccgagccacctatcgccgccggcaagctcgccaagctcacgaccactcctccctgtacatcggcggctggaggttgaagacaaggaccctgtcttgtagtaaactaaaagcttagggtttaaagcgtaaagcactagagacttacatgtggggcctagtactgcgagttcatttatggaaaaactagggacctttctgcaaaacagtaagagactgacagtggacccctggagataaaatcggagaatatacaagagaaatacctagaacttgtaaaatccatataaaatcaaatatagattattttgagatgattcaaatttctgtgaactcactagattatgaaatttaaagttatgaaataaaaactttcactcacagtacaaatttcacctctaaaattcatctaagttaaatcacacataaagcatgcacaaacttataaaaatatatggaaaattgacttcaacctattttgggataaactcaaattccacagaatcacaaacttatgctctcctgtagaataaaataaaaaggtatacttgctttgcatcaaatgcctctaaaactattacctttaaaataactagttttatataagctgaactttagaaattcatataaaattcatcttagatcctttttgagtaaacccaagttctgtagaataaccaaaacatatacttccaagttgtaaaataaaagtatatacttactgtatgataaaagcctctaaatatttatgtaagtaataaccaatatagagcaacctttaatttgtaaaatttgtagaaaattcatctttagtccaaatggagtgaaccaaatttctatagaaccagcaagtaatataatttaacatagtagagtaaaatatggcaccttctgtacaggtttcaactctaaactttaaatttataggataggttctaatcacatagtattgattaagcaatacatatatataaatgcatatagaaacacactctagctataatgaaacccaaataaaacttgttgaaccaatgaaggcatagatccatcccttccaccaaaacttagtacactttaatcatatattaattcctcttgtttataaaaatatgaactaaaataataaaagtcctaaacttgtgaactagggatagattagttaacaaaattatttgcttcattcatcacaattaaagtagaataagttttggacttcaaatatcaaaggcatgtgcatatagaacactatacgcctacaatacgttataacttgtaaaatacataaagaattcatattaactccaaaagttatgaaactaaatgtgttagtcttaaaaatacagatcttcacctcagcaaatataaacttaataagaatcaccttacaacaaattcagaatagtacctaagtaaatcctatattataccgagtaaacttctaaatttcataactcccaaataaaaagagataaaataggaattctttcacctaaattcatcttagaccagtacctatccactgtgcacaaatcatgcattttagagcattttggatttttcgcataattcggtgtttaattacataacgtgtactttgtatagatgattgcttaaacggtgaagaagtgattttggtgctaactttttccaagttacaaggcaagtcccacctccctctctctttgatcactttgaacctatgttttagaggttattgaaaatgtttgcaaatcttgcatgtcgattgtacactaataaattataattttgttaaacttgttagacaaacttctactacttgcattatcaccttaaccccacgtatatccatatccccattcctaaccttaggaataatataattataacactttatatatgagttttgatgtcactaggttactataatgcttagccatgcttagaatgatcttccttgtcattatgggctcattacaaatatgaaaattgattttgaaataatctggacagaattttaatacttgtgattttgataaataaaatgatggaaaacatagattctaggtttgggccttaagtggtgcacatatggtgattagttgtgtaccgatagggggagagtgcgcctaaaccgacctaaggacttcactcaatgtcagttcatttcgtatacagtataaccacatgtgctagtatgggatagcccaagattagtaaattatttatggtttagccttacattctggtaggccggtgtatatgagttcgaataattcaaaggagcttcctatttaccccgatgtggtagtttaggtgactaagcgtgtccaatacaatggtattgtgccacgtggtgggttcccgttgtgtccgccaccacagtgttaagtttaaggcgtgggcccgccacttaacggttctaggttatataacgtgtatggcttaggatggagtaacacatatcgtgctggtgtaaggctaaatcatgaattttggaaaaacgttgatgcgggtaataaatcgggtacttatgtatcgcgtgccatgctcttgcatgattattatttcgcatcatgtgggtaaagtgtacaaactcttcagagttaaaactaatcaattagccgtgctcgcggttatgagcggtgtgtggatatgtattgagtatagacttgtgtttattcttctaaatgctgaattttatcttcaaattatgatgagatttgagaatgatctccttgctgccgtggatggcaatgaggtgtatatttatacatgattaatgtctactttgatgcccatatgctaagtactagcttgctgaaatttatttgaaagcaaatctgatttgaatgtgttttatgcaaataaaacttgctttatgctaaaaaaatccatattatgccttccttgattatatgccttgcaagtagggtgttagttttgtcttggtgcttgccagtacattattctaataatgtactgactcttgctattggattaaccttttgcttgcaggttgtaaacttagtcttttgagtgatgcgggtaatcgattgcttcttctaggacttaaacttaatggggtaaacgtctagtcggtgtgcttggggattgggtagacaagcttccgatgttccctcatacatctatttggccgatcggcctatgtatctctaaagtagttgtaaattttaatcgctttcatctgaaatgtgtttgctatgtatgtccatacttaagatgaaagtgtgaatctagtgcacatcctgagaactaaattcacatgagtatgagttaagaatgtttgagatgatatagatctttagcctttttttgtcaagtctcctaaatgtgtaacacatctggtcgctgccttcgagtagtttgacgggcacatctcaggctgaagttgactggcaggctaaagacccagcaatgcctccaatattcttctctcgagacgtcgaatgtttcattatatttatttgatgatataaattattcacttcatctatataatgggaggtcaagagagcctacgacaactctccgcaccgcacggtgcacgcgacacctagccacggcctgccggcgttgagcgacggctggctcctcgcagccaatagctcgctcctcgccttctctcctcctgcttggtgctaagctgacaatgcgatgctgtcactgtcgcagtccggccgtgctagccccaccaccgtctagtccggccggccggccatccccgtgcggccatgctgccgtgcggccaacagtccgcagcagtgcaacactgcagcagctagcagcctagcgcccgacaggccagccgccagggccaagcgcaagcaacacgtgcagacacgtgcaggacatcgtcatttgtggtggctagctgcctagcggctagcgcctaatcgatttcgtcctgctgctatggtctatggacatagaggaacagggataaggacatggtgtggtcacgcacatacatacatacatacatacatatatatatatatattaaagatatctatcgaccatgttttataaaatttttggtgtatgatgaattatgtatggcgcaaaaaatattactttattttaaaatggttttgtctgtaattatactatatttttatgcgattatagtatagatatggtatttgttgtgcttagttggccttatgaaacaaacattttcgttaaatcttatttttaatccagcttccgccactcactcctcctaatggttctaagcagtgtgacttttagattttcttttcagtaactttcctattgaactttgtaacaacattttatttgatcttactaaatctaggccggcttcttcatgggccggtgtaaatagaatggaattctcttgcatatttacagaatatacaacgagtcaaggaagcccttgtttagtttccaactttttcttcaaactttcaattttttcatcacatcaaaacttttctacacacacaaatttccaacttttccgtcacatcgttccaatttcaaccaaacttttaattttggcgtgaactaaacacacccgaagatagatttagataggttatggctatgtttagatccaagggtgaaaagttttggcgtgtcatatcggatatacggacacacatttgaagtattaaacgtagactaataataaaataaattacagatttcgcctgtaaactgagaaacgaatttattaagcctaattaatctgttattagcaaatatttactgtagcatcacattatcaaatcatggactaattaggtttaaaaaattcgtctcataatttacacgcaatctgtgtaattatttatctatttttttctatatttaatactctatacatgtatctaaatattcgatgtgacatggtgaaaaattttaaagtgaatctaaacatggcctacatacatttggttttgtaatttgtagcgtgtaacttggactgccgttcttctataaaattctttattgctggccagaaccaatagtgcttcctaaaaaaaaaggaacaagtgaaatcttctgtcctctggagcagaaacgtagaggagacgtatctgatggtcaaccctcagcactgtcagcgggcggccgaaatggataaaccagcgccgcaggcgttcgtataccgtatcagcacggcggatgagtgggcgcagcttcagcgcaccggcggcacccttggcggtgacctcgaccgctccaccggctgtatccacctcagcgacctcagtcaggtaattcccaattagaaagcagggacgtctgatttcttccgactcgcgggatccccatggatctctctatttatcatatgcacatttcaagtggagatttgggcctagtcattggttctctgatttttcagtggatctagggtgctagactactttgctgaaaattgctgtttaaaattagggataaagccatccaaatattacaacccaggcttggaggttggacgcaaatcagtaatgctattagaggtgcctctcgcagcatgtgtgatttcatcttttgtttgcctacagagcttcgtgtggagatctcctgcttcttgcgtgtgtccaattggccatcctagatgccatttcctttggaatcttttgattcatttagggcatccacaatgttagaaaaaagcaggtagtaggcaatatactattcctatgacttagtaataagcattgtggaagtgggtagtaactaatgctcggtactaagcttatgacccactcataagaataaaaaaacattaaaatctctctcactctctccttccaacacaagatgtgctactactacatgctgagttggacaaaaagcaactaaaaagcaatatttttttctcatgcgacccactttacaaaggcctactacttagccctgctacttattacttagttaggtaagatacattgctgttgcccttaggatgtttctgagcagtgaccgtaacaaagcagtgaagaataatctatattatctataactagcatggtggcccgtgcagattgcgcgggtagcatcattatattttctctcatataatagcatatatgttttcccattatattattcaaatatattaaaattacaacataatttaaattttgcaataactttacaaaactactaatgtataatattcatattatattttatatacgtgttagttattagttatttttaatatcaaattttagttatttgtaaattatataaattcctctatggactctagactcgtcttttaatattttttaattccgaattttctgtaaattgtatttttatatagactctatgctcttcttccaatattatttatttttatttctgaatttttattatttctaattgtatttctatgtggactctaaactcatctttcaatattctttaatttttaattttgaattttagttacttctaaattgtattcctatattgactttaaactcttcttcccatgttttcttaatttctaattttagttatttgtaaattgtatttttatacggactctaaactctacttttaattttattatgtttattccaaattttagttagttttaaattcctatatggactctatactctacttctaatattccttatttttttaattctgaatttctatttttttcttaattgtatttatatatggactctatactctacttctaatattccttatttttaattccatatttctattatttcctaattgtatttctatatggactctatactctacttctaatattccttatttttaattccaaatttcagttatttcctaattttatttctgtatggactctatactctacttctaatattccttatttttaattccgaatttcagttatttcctaattttatttctgtatggactctatactctacttctaatattccttatttttaattccgaatttcagttatttcctaattgtatttctacatggactctagtctcctcttctaatattccttattttttaattccgaatttcaactatttctaaattgtatttctatatggactttagtctcatgttctaatattccttattttttaattccgaatttcagctatttctacattctatttctatatggactctactttttctttttctccgattaaagtgagaatttctaggccatgagagcgaacgtggatgcttctttttctattcctttaataatataatagataatgtgcggaagtcgttctgtttggctttagaaggacatactatttcccttgattgctttgacagacatgcaaattggtgcccatttgtagtttatgcaaacaggttgtaggtaaatgctagcgaaaagaaaacatggcatctcattatatcaggatgttaaatttcagaaattgtggcctattaagaaagggcctgctattcatattgcgttctttggctgtgttttcatatatgatatatggaaatggttttgcttactcaacaatcccatatacatttctaaactgtgacacctattgtttggtacactcaagttctacaaaacaattttgtgcaaaagtatgttactactattgcatataagtacttcaatttatatacttttcgtgatacactgaataatatatttgtcttgtaatttgatctgggcgttgtttatatatgacctccaaccattcctttttggcactgtatatgtattctttagaactcattctcaacctgttttaggtgaggaaaacgcttaagaactttttcctaggaaggaatgatctatacctactacaagttgacacttccaaggtaacgtgtgtcagtgtatttaaactccattggatgtagtcacataatagatcattttaaattaaactagttgcgcggctagcacccatataaaattatatatttttttaatatgattttacttaaaacttattagataactatcttgttgtcttaagacttaagactttgaaagaccaaactttattatccctgtgtttttaattttatagtttttaaaagtcataccaattgctacaactttcttttgtcatttcttttttttatttgctaactcgatctaccactttttctattcattctccttagaacctttacaaattggatcgtatagtttttagagtttattgtctcgttgggtttcgtttttataatttttagaagtcccatcaaacgctgccattatactcctctacagctcatccactgcttcttctgtttattgtcattgggattttaaaagtcgaatgtaattatcgattgggttcagtttttactttctagaagtcccaccaaaccataagtgactttgccactgtactcctctacggctcacccactgtctcccttctttattgctattgcgattttaaaatcaaacatgattattcttttaccttttagaagtcctgaacctttaaaaattggacctcgtagtttttaaagtttattgtctcgttgggtttcattttttataacttttagaagtcctgtcaaacactgccactatactactctacgactcgtctgccgcttactctttgttgtcattgggattgtaaaatttgaacataactatcattggaattcattttttactttctagaagtcccaccaaccgtcgacggctctgccattgtactcttgtacaacccgcccgccgcctcttctttttattgccattgagattttaaaaattgaatattattatatcattatgcttttttactctctaagaagtcccgccgaccgccttgacctgttacttcacggcctacgcgttatccctcctattaatcgtcattaggattacatttggtgttttattaatagttttttagatgtcacatcaaccgccaccactctaattttgattttttttattttttttattctgaatttttataatctcgtattgggattttatatggtctcttcttttaatattgcttaattttaattccgaattttagttatttttaaattgtatttctactcgaactcttcttttcctttttttttttgctaattttggattttatttttttatttttaattttgattaatctcgtattgggttcttatagggcctcttgtttcaatattgcttatttttaatttcgaatttcagctattttaaaattgtatttctagttggactcttcttttctttttctccgattaatgtggaaatttctagcccccacagcgaacgtggtgtcttctttcaaagttgttttaataatataatagatggatacttcagaacgcaccaggtttttttttatctctattcatgaacaaaaactatacatgtattttgccctggtaactaggcaagtagcaagcccatgcctgtttgtatttcagtagaattcatctgttcgttttgccacttcacattcatagcattttctcttcttgtttgttgtagctttcagatggcttagtttatgaggcagctgatgattcaaactattttcctcatttctatggccctggtcggagttttgcacctcttcaactagacgctgttatcaaggaggcagagaaaatagttctggtaaacaatgatttcacctgcagtctacttgatggagcagaccccttatcgtgatgtgtaagggtgacctttcccttgatctttataatgttttgaaaaattcgctacaggacgctcaaaagtttgcagttatttgtaaaaaaagctgcaaaaatgcaaaaatattactgctccatatctaacatctccaggaagttgaacctggtatattccaaggatcatagtaagggcagacatattgtatgcatcatatttataaacatcattgcatattcttcagtagccttaactgtatgccaagagacaatcttattttttgatcaccccaccaaattaatgtgaagaatgatagctgtataatctctaattcctgttaaaaagggtgcaaacttgaagtattgattagttctcaaatggttccaatagtacgtttattgtgagaattttgtatcagcaagttattccatttaaacttccatgagttctcaattatgcacgaggtcttttagggacaaatcactcttttttataggattaaacattgttctttctttcctccaatgttttcttttccatgccaatcgctttttgaaaacttgcacgcgtgtacgcatagctccagtgcggatgtgtttcatcatgtcgctaatgagcatcaatatgttcctaacccgtgaagctgctatatagggttgtgtcttggtaggttgaatacttgaatggtacaggttgtgttctcaattttgccctcgccgcagcccacgtcacgccaccgagtgaacagcagaactgcacgtagcacgcatatactgcagcgcacacacatagtatacttaccgtatacgtatggcacacgtaatgaacttctcattttaaaattggtatcgatcggtcaattatggtcatccagtttattaattgttctggcactaaaaaataagctgattaggttgctcgatcaacccatttgtctatccaagtcagaccatcaaaatacataggctgtgtttagatccaaagatccaaacttcagtcattttctatcacatcaatctgttatacacacataacttttcaatcacatcatctctaattttaactaaaatctaaattttgtgtttaactaaacacagccataattaatttgtatatgtcgttcacctcttgccaaaaaacaaaggcatcctctgaatctcggtttagggatatatcagtggaaaatttcatctgcaaatgtcatttgcaggtacatcaaagtacatcatgctcatgtgaataaaatttgatataggtgaacaaacagtatcacatttaacccggtgatatataccagcttggtgatatattaaatttataaagaattaatttgtgtatgtagtactccctctgtctaatatgatacatctacatcgctaaattagttttattaaatataacattgaatatatttttaataatatgtttattttgtgttaaaaatattattatattttcctatagattaggttaaatttaaaagagttttactagaaaaaataaagtgacatataatataaaacaaaggcaatacttacctagtaaatatttttgtaccaatgacatgttccttttctcataaataattaaaagtgcaacctatttaacgcagagctgaaattttgaatggatttgcatgtatttctagctgtaccgatgtaatatagtattattagggcaagtttggtatagttccaactcctaaatttagctccaggagttgggtctggagtagagttgtggagtagcctaaatccagctccaactctctagcttattttgtgagagatcttcacctagtgcagctcccattttagctgtaactgaaactgtttggctgagcatcagtccaagagagttggagaactggagttggagctgtgccaaacatgcccttagattaacgtttgaatttactttcatatagcatatgagaattaaagctaaaaattagttttacttgaagaccatgataaatttaactatgctttatattatgagatagcagggagtactaaagacaaattatcctgccatttaccataggaaaagtatgaattatccctctgaactattgcgacagtacgaattaccccctgaaccacaaaaccacacatattaaacctcgaactattgataccggacaaattaccccactgactcaatcctgagcggtttttctcctacgtgccatacacatggcgtcgacgtggaaatccaattagcaaaaagaaataaaagaaaaaatagggcccacctgtcattacccctctcccctcttccccttcccccttctctctctcgggcgcgcgtggacgggcagtgggcggcggcagcgacgtgcggacgggcggtcggcgtgtggggggcggcggcagagcacgggaatggcacggtgtgcggcgctgaggagggtgttggaggaggccagctacgtcatcatcatcatccctctctctctctctcctcaggctagcggcgagcccggtggggagggcgagacgagtagcgggcggcgctaaggacattggagatggtaggcgtctctctctccccctcgttctctctctctctatggcgccgtcaggagagccgagcaaggaggaggcggcagatcctgaccggcggcctccaaagaagaggacaggcggatgaggtggacggcatccagctgccgccaggagggggcgaatgaggttggaggatgcaccggcgagggtgcgccctcctcgccgcagcccgccgcctcccgcgccctctccgtgagtccgtgacgccacagccccacagcctcctcgctggcatccgtggcccgcggtgcgcctcccacgctgccgcccatcacccgcccccgcgcaatgccgtgggcgccgaccgtccaccgctgctcgacctgcgctagacgacccgaaccccaacgagaacgtcaccatgaacgccgccgccaccgccacgctcgtcgtcgccgaccacaattcggagccaggagatgacacacagagggagaagccgaggacaaagagagacacggccattttgacttgccaccaccgcccaccacccgcccatgcacgccgccatgcacgttgacctcccgccgccgctcgacatatgccagatggcctagacagaggggggagagagagtccggcggcccgagagagagggggagagagagagagagaccgacggagtggaaggggaaagaggaggtgagagagtatatatgacaggtgggccctaccattaaaaaaagaaaatgctgactggattgtcaagcatacgctacgtaggataagatcgctctagattgagtcgaggggctaatttgtccggtattgaacgatctctggttctcgggtttggggggggtaattcggtcgaccgcgatagttcaggggggtaattcgtacttttttccggtggccctcccttctcctcctcctcctcccgatttggtggcggaggtagcagcaaaggctggcgcagagcacgaggtggtggccggtgactaggaagaagatggaggtggaaaaggaggctcccccctctctcctggtggccctcctctctgttcacctcctcccttctcctcctccagatctggcgacgacggtggcggtggagaaggccggctcggagggcaaggtggaggccgttggctgggtaggaggtggaggtgaaggccgtcgcactcctcccctcaccgagctcttccctggcctcgccatgcgcctcgccgtcagctgccggatccggcaatgacggcttcttaggctcttttttgttatttcacttaatactataggtgttggtcatagggtaagaacctgacacctattgccggtttctaactggcacctatgggggttcatgtatactagcgatcattatcatagaatcattgatgtgtgatttaaattgtatgaaattctgtgagtttgttgcaagcctgaaacagctcaatagactcctgtttctagcgagtagtatattttatcaacgccacacaagttgtagtgcaactagtttcttaactattcagggctacctgtatttagtatcatagcttgacttaattgaacacttagaaataagtataatactgtggttgattagcgcgtacttgagtttacttaacaaaatcttcttttgaccaacaaactacctaccacggaatgtgttgtacactacaaaatcaaattttacaggcgagacactttcaagttgcaggcggatcataactacccaacatgcaaaaatcgcttcccaaacgcagttcaagggttgcatacgaaaatctatttttgaaggcgacctcttaagaggtccaatgcaataatacaccaattatcgcatgtgggcctcttaagggggcctacaaaaatagattttcgcaagcaggcaacgtggagagcaagtgggctatctccacgtgtcctcgcactggccacgcactactcttttttctcccgcaccttttttctcctcatcccccttctcactcaatgtgcctcctttttttctcttctcctcctctccatcgtccgctgcctccccatctgctccacctcccatcactcctctcccactccctctcctcatatcttccccttcgctccccccttctcctctcctacacagcggctgaggtggatgcgacgatcggctcttctagtggcggtcaacaggcgcggcgaatctggcgacgacagtcctcgggaagggtggatttgccgtcggcgaactcgggagtagcagatccaccggccattggtaggcttcggaagggcagatccaccaccagcgggctcgagagcgatggatccaccctcgcgcgtggtggagaggaggcgaaagggcggccctgcaccgggagcagcgaccaagatcaccgtagctacgtgcgggctcgagagtggcggatccaccaccggcgggcttaggaacggtggatccattgccagcaacctcgggagcggcggatacgtcctcgcgtccggtggagaggaggcggaagggcagcgccgcactggaagcggagaccaggaccacagcggctgcgtgtgggctcaggagcggcggatccaccctcacacgtggcggagaggaggtggaagggtggtgtggcaccaggaacggcaaccacgaacttgcgggtacgtgcgggctaaatcgagagcggacaacccaccgtcgacaagcttaggaatggtggattcgctgccggagtgctcgagagtggtggatccgcccttgcacatgtggagaggaggcggaagggtggcgcaacaccaggagtggcgaccacgaccacgacggcgatgtgagtgcttggaagagggcggatccgtcctcgcgtgctgcacggaggaggcggaagggcggcacgacatcgcgagcggcaaccacaaccgcaggcagcgggggcaagggctgtagcgcggcacacaacggcggcgaccaagggtttgggttttggattttttttttctttttttattttttaaatcattgcaatcaagcatccttatttgcccgcatgcaaaaatcgggtctttgcaagcggctttcttaggtcatctgtccgcgaaaatgattttatgcatgcaattgtgttgcccgcatgcaaaatgccgatttttgcagacacctggcgctccaggcgagtgctcactcgcctgtgaaaattagtttttgtcggcatgaaaagatcatttatgtagtatagtggtatattgtgcagacatctaaacaacacattttttttcttctctctttctctcggtcaggaaattatggagaataaaaataaaatggtattacattttaaaagtataatgggatgcataaaacccacgaaacactagactcacacggtcatggcgtaaacatgtacaccaaaatgctgtctaaatatctttgtatttagtataatccctctggtttttgacggataatgtcgttaatttttgaactaccatttgtctcatatttttttgcaaatattaaaagcataagtcatgcttaaattatttaatgattaaaaaaatcagaacaaaataaatggcaataacatattttttttaacaagataaatggttaaatgtatatttaaaagtcgatgttatcgtactctagaacacgtagggaatataatgcatgtgtatgtgatttgttgggttagaacatctatgttcactaagctataactgaagaaaaatatatgaaacttcttgaatgtataccatgtttcacaatgtttatttcagattctgtgaaatttcatgatagttttataggtttgatgatgtatcctggtgttaagaacttaagtgaaacttatttcaagataacctggtgtaaagtgaaagtatatgctaaacctagtgcaaaacgaaacacgatgcggtttatacccgatgtagtacaatttattgagctagtgtcatagtgatcacgccgttgtccaaaacatcacatattctgtgactggagatagaattcgttccaacatgacaagaaaacacgcgggaagtcatgttgtccttaggatcttgtcaagagttttgacttgaaaacagcaaaagtatttagttatccaaaaggtcagccgtgcttattgcaggacattgaattcatcttgttgaatgtgtcgcccatcgcacttggttcatccgtacttggtcctgcgcgttgccaaactcccgtaaaatctcaatcctatgagtcatgaatctcgaatcaaatttgtaccatgccaagttaccaagttgcctcgttgtagcgcgtcgctgtttgaactctttgcaaattactgccgggccaaaggattcaaatttgattcaaatcacatattcatgacgatcgatgatgctcacatttcacgatgttagtgtccaaagaaaattgaaaattgtcaaaattgaaagacaatattctgctctatttatgagcagagctctttcttgtaggagtactagtagtagtagtagtatgtgattacatgggaatctctatgcacaatgtggtcaccttaattacaagtttaaaattgcaaaatccaaattagcctaggaatcagacaaggagtagaagtcgtatctcaagctgcagcttccacccaacactttgcctccctccttggcgcaacccctcgccagcagttgatcaatggcggattccaggcacatcttgcagtcgccgccggagaggtccttggtgcactgtgccatcccgtgcagcctctgcgcaccgccgaccgccacggcctccccggcggcgaacagcagcggcgacaggtaggccgtcctcgtcagccgcttcatcagccgggacacctccctgtcgaggtcggccgacctgtccgcgccccgcaggacgcgggccggcgggacgacggcgcggtgctggcgtgacctcgccgaagaatggctcgccggagtagcggagcatgcaggcgtcgagccagacgacggcgtccttcttggacgggcacacgcgccgcgccagcgcacccgccgcccggatgcactcggcgcacgttgcccttgcgacgtcgccgcggcagagcgccaggccgcgcacgcgctgatcctccccatcgccgccgaccccgaccgtggcgatgtcgaacccgatggccggggccttggcctccaggagcgagacgaggcgccccaggttaccggcgaaggagctgtcggcggcgaagctgtccgtggcggagcacgacgcgacaggctccaccacggtgctcgcgccgccggcggcggcggcggcggttagaagaaggaatgctgccgcctcaagaatcatcatggcgcgctgcgctggtgagtacgtggtgagcacggaaacgatttccgaatgctagctaggttgtagaatgcagtttgagcgattgagggagggaggatcgatgcggcggatgaggtggtgcgggttataaagagcatgagggtggcgagagcggaggaagggaagaagtagaaagggtgggggatatgctatgcggtctgaaaagttggaggtggtagagtagttggggttggaccgtagttggaagatggaaggaggaaggcgcgcagggtgggagggagggagggagagactggacgaggtcgtactcgcggcgcttactactactactcggcagcggcaggccggcagcctggatggacggaggaggagccgcaaatcatgcaggttttcttcttgttgatgttggtagcaagtagtagtagcaaccaacgttgaccctgaccaagccagccaatcacacgcgcgcgcagcggggcaacacggtttgctgtgctttacgcgaacgcgaggaatgttttttgattttgattataaatgttgtgtgttttaggatctgcgtcgtcttaatctgtggattattcctaactcctaacacactcgatcggtctgcctcccgtcgtagaaaaacgactgctaatattataccagtgcattttgatcgctaattatgttttatttaagtagagccaaattggtcaacacaaagtacatacttcagtcagatttgtttagcttcttcattatgcctccgccggccaattacgatgacatgatttagagtttagacggatgattctctcatattatctttcgttttagtttgatgtcagtcgtcagtggtaattaatgtatatgaaattctatcaacacagtaatcagtcattgattctgagattttacttttgagttaaggaaaataggactacatataacttgtaagtcgttgagaacaaacaatgttatgatgattctccccaactataaaataatgaaagtaagtagtggttttcataattcgtagtcactcgtcatttctcctttgtattgattagttgtaatttccttgaagcaaagtccaaaataaatttcattatgttaaacaaggccaattgtgaatggaatatctacatttcaaatggcttatgcttcacattctttggataaaaatctaaaggctctcaccacaaccctcattctctattcgaacttgtcgaatggttgaaacacaattacaatagttgtgggtgtgtagggcaacctggtatgaagatacgtacgtacgaagaacacatcacataaaagatatgagatttatataggtctgggctcatggaaacatacgaaatagccttcctcatatttatgtgttgactagatgttgacatgtacaagagtatatggtggaagcctagcaaactaatacattgagattgtgatctcgatgggttgtggcaagggctcctgatggattagcttttgtgaaaagagcttagccccctccatcacaaaaataacgaatggatgtgacaaatcctagtatatctagatttgttatactagaagtgtcacattcagtcttaggttagttttttatgggatagatagactatgtctctgtattgatcctaacgaaaacttctacttgtcttgtcgtactcaactcggactttggtagttgtgttatgaataaaatttagcagtatgagatatacctagtaagaggttcacaccttaggatacgatttcgtttgggcaggttcccaactcctcttcctcatcttctacgtgcacgcttttcgaattgctaaatggtgcgtttttttaaaaaagtttctatacgaaagttgtttaaaaaatcaaaataatctatttttgaaaaaaaattaacaaatacttaattaatcacgtgctaatagactgctctgttttccgtgcaggggagttgggttcccaaccgcctgacacgaaacagagacactcaaaaatatggtttgcagtatatggtatctgcgaggagagttaacttgtgtgatgcatatcacatatttactttcttgatacaactcatttagataaaaggttcaacaatgaattgttctaagataaaaataaaataaatttataataactgacagtaatatgtgcacaagtaattaaacttagataaaaataaagtaaaaccattggtaacaaaattaatgcttaactaaaataaaattgtatattagatatcattaaaattttagtcctagcaatgtacaactttaaattactgaaacattataccttttcgagcccttggaataccattacaaatatatgactaacttgtgtagtggtttgaaattatatgcatgcaaatcaccggtgctttgcaaacttaactttagtcgaggattacaactcaaaaaatagtaagaaatataatatattgaaaatgtttgtcctaattgaaagtaacgacggacctagtagatctcagccacctaggtcgctgatcttttcttctttctctttcaccatgttaattcaaacaaagctcaaaatagaataggtcgacttatgccaacttgccggaacatttaactatttgccacttttaagatatggcaattaacgatttgccactcgctgtctatgacatgtgggtccactggcaaatcctttagaaccacttgtaagagtagcaaatagttaattattcccaccttgccaaggtttacaacaattaacaggacatctcttagccaataatataatatatttcttttgtttagtgaattacagagaatgaacagacagaagcaagccataacattttgacggcttggacacaataaggtactgtgtaatattgagaatcctccccgtcggtcgctcgggggggagggaggaaaatcgagcactccctccctccacgatgtgcgcgccccctggggcctcacccacgtgccgctgcccccacctgtcatgtgtctccatcacatactccattgaaacaaatcacccatatattttagaaaccctctattaagggaattcattttattttttgttccaccaaaaatgtttcacctagtgtatttataatgtttcattatgtatggatcaaatgttgcagtgaactgaaacattctttcgctacttgtgaacattatttttatataaggtgaaacaatgaccgatttaaacgattgaaacattttcaatctacttaatgaaacaattccgatatacttggtggaacatcgtgcaacattttaaaataattcaataataagctaaaaaaattttcatcggaatatatccatgtgtggtcttgttttgaagatttaattgcaacgaatttaatggtgaaccagatcatgatttggataaataatttaagagaaaaaatagtttaaagtggttttgcacgtatgcgtatatgctgacgtcagcgcccgatttttccacgcctggatcgagcgcccgatcggtagtctcgttcgtgtaatataataaatttctcttgccatattaattgtctaatgtgtatgcctcttattatacgcataaaaaagtataaagatggatattggtatttgagaaaatttatgtttcgttaaagatggatattggtatttgagggaattttgtctaacgaaacatggcctttagggcatccacaatatggatgaaaaatgggttgtaagaccctttactttatcattgtggaggtggataatagaggagatagcaactatgccataaaagacattaaactattacctctctcgccctctctcttttctatccaaccattgctttacatgtgcgccatatcttactcacacattgtgagagatagaaacaactataacctaattttgtaagtcccacatacattgaggatgcccttataatctggtttgtatgccacattttgccatgaattaactaaggcatcatcaatgtttattgcaaaactaggtagtaaggtgggcccatgtcaggtggtaatagtgtgtagagtggatagtacggtgggacccatctaaaaagttatttaaacatgagtcatgccaattgccacaattaaaaaaatagatgggacccaccataaagtatacctggtagtaagcttataccctggtagtagttctttaccacctccacaatgtataatagctggtagtagggatgcattcaatacttattaaccactacttcattacatcgtggatgcccgaataaaaacctgctccttcgccatcattagacccgacgagaagcgggagtcatttggtttgaaaacgaactaggacattgtttatgcttttaacattcattttcagaatctcttgtcacacgccatcttggttcaaagcttaaaaaaatcatttaccaagaagtcactttctttcgagttctatcctttacccgtccgatttagttttgtcctaagttaaatttgtctcattttaattacttttataaaaattataccaatatctacaataaaaagtcaatacaatattaagatatatttcatggtgaatttagttaaactaatttaatgttatgttgatatatttttctataaacccggtcaaaattttagaaatttgctaataacaaaatttaaatgactcataatatgaacggagaaagttggtcgtgaatgctcgcaattgatatttttgtttgtacataatctctcacttaaccaatttatgattcctccttggcagtaaaacctagatcaataaaatttaaatatacgttagggtatgaaaaagaaaagcataaaattattatcgtctatcgatcgaactaaacatatatgatcgttgctacatctcgatcaagaacagagaatatatattaaatttgtttgtattagtaatcctcttgtcctcaaaatcaagaccgatcattttgactttctgtgtatcatcttaatttatcatttgtatgatgaccgtccagctcgtaccacttggacggctgagaataggaaaaaattaaacttgcacctcagagtatcttatgaaatagaattaaagcatcatcaacatactaccaaaattcaatcctctttttttaatctctaatggtatttaaagggggagtagctacatttatgacgccatatttttcaaaaaaaaaaatagtcggtatatatttacattgtaaatttacaaattacatatgtaattttagtgtatttataatgtaagtcctaaatttacatatgtaaatcccaaaaatacatatgtaattttagtgtatttacaatataagtctcaaaattacatatgtaagttcgaaaattacatatgtaagtcctaaaattacatataatgtaattaatatatagtcatcactcatcatgatgtatgtgagaaaataatcttcaatctcacggtaacacagttgggaggcctctgtgcagttgtgtggtatagcgcataggtatgcaaaccgactgtaatcaatggaattttatggcgccagagatttagcaaatccgtttaaaggataaaaatatcctcccttctaacacaattaaactttgaaaggtgggccacataaaaaattaaacgaatcggtcgtctcctcccgtgctcccgtatgcaacgacttcaaactttttaagagatgagatgagatttttttttaagagtttgtttagggctactattcaatacccatttttacttaaaacctcaataatctaggaattaggatcatgggcagtataggcactctgttggccacgctcttgtaaacatgattgcagttttttatttttcacaaaaagatcgcagtgtccttttcttgttagtaatgccaagttttgtttcctaaatgatttggtagctagtaaaaatatttctctgttattattgagttgcgtgtgcgtgcactactgtcgctttattatagggcattattctttttaggtgattagcataggagattagaatatgcctaagtagtaggttgctaccagtccctaaatattaagaaagggaaaagagaaaagaatcgacctcgacatatatattttatgtttgtttcggaaacttccccggataactcccgatcctaatcagcaagggtgacgcccccacctactgctgccggtcgctgcagcaattattctaagaggctgcaacttttttttttaaaacagaggctgcaactggggacgcatacactgtgcagagagatcaacccaatcatctatccaaatgcaggcttctaccactcgcccgttataagatacttcctccataaaagaaaaattaagattagatgcaacgttttatctagatttattatactcagatatgtctgtcggtgacatggggccgggggtatcgtgactagaggcttgggtagccgcggtcacccacgtggcccgaccccctcgggggggtcgggcccgagggtgacgtggccacccctccctctgtctccccgaggggtcaggccgctcccgtttcggccccgagggctggagcgccccgaccccctgtggttttggcgccacgtatgtgggttagatgagcacagcgggctcacctaaccgcatttatagcaggttggacgagcgcgccacgccgcatttaatgcggggcagcgcacgcttatccggtccgtgaccggtcacggtgtgtgaccggtcacagaccggtcagatcgcgggttaggtggcaacaggcggcctgtcacacgcctcgccccgtcccgtcggaatgatgagagctgcgaagggacgacgagtctcttcgctcgtacattcagcggttctgtcaagtccgcaacaccataccgtgcatccccgcacacgcggtgatctacgcgttcaggaggggcgtgcggcacaaccgcatgctcgagaagatcgcctccaaggagccccagaccacagcgcagctttttgagctcgcggaccgtgtggctcgcaaggaggaggcctggtcctggaactcctccggttctggtgtggcagctccggccgcccccgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccagcaagtggtgtaccgtgcacaacacctccctccacgacctcgcggactgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgccgaggacatcgatgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgcccctcaccttcgaccaaaccgaccacccgccgtgcgttgcctggggaggacagatcgcgatggtggtttcccccaccgtttgcaatgtgaagttggggcgtgtcctcatagacgggggtgcagccctcaacatcctttccctcgcagcctttgacgccatcaaggtcccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccaccttgccgcggcgtccaagcccgcgggtggcgacgagagactcagcacctccatcccggccgccccaaggcagcagatggtcacgtgcgacgaggtcccggtcaaggaggttaccctgggcgacggcccgtccaagaccacacgaatcggtggtcttctggacgacaaataggaagacgcgctcgtctccttcctgcgggcaaacgccgacgtcttcgcctggagaccggcggacatgcccgtggtccccagggaggtgattgagcaccgtctcaccgtgcggccgggcgcaaggccggtccggcagaaagtgcggcggcaggccccggaacgtcaagccttcatccgcgaggaggtggcgcgacttctggaggccggattcatccgtgaggtcatccatccgaagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcagatcctacttttcaacgtactactcgaatttctttgggtagccagataagacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttgtcgggttcttggtctctgcccgaggcatcgaggccaacctcgagaagatacgagctatagagcggatgcgcccccccagcaagcttagggatgtgcagtgcgtcaccggctgcatggccgccctaagtcggttcatatcgaggctgggagagaaggcgctacccctatttaagctcctcaaacgctccgggccgtttacctagacggaggaggctgagcgggccttcactcagttgaaggcgtacctcagttctcccccagtcctggtcgccccggagccagatgagccgttgctactctacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccgaggcccccgacggccggagctggccctccgcctgcttgtccgacggtgccaggtgcccccgacccccaggatggccccggggccattgcgggaaggccgcgcctgtcgccctctaaccccgaggtcgtcggcacagaagccgagtgcgccccgcgtggcctctcggacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctgatgacttcgaggaagttgcgccattatttccaagcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctccgggtgttaggcgactcccagttggtcgttaaccaggtctgtaaggagtaccagtgctctgacccgcagatggacgcttacgtgcgccaggtgcggcgtatggagcgccatttcgacgggatagagcttcggcacgtgcccagaagggataacgcggtcgccgacgaactctcaaggctcgcttcctcgcgagcccagaccccaccgggcgcctttgaagaaaggcttgcccagccgtcggcgcgacccgaccccctatgggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggaatgaacgcgtccggcgcatctccaagcgctacgtgctggtggaaaggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagtttcacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcaataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcaccaacgcggaaatcctcaagggcctcaaaaccaagaccttcaacatcctcaagaagcacggcgactcgtggatcgaggagctgccagcggtgctcagggcgaaccgaaccatgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgttctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagcgggggtcgggtgtcatgtctcgggctcgggccaaccccgcaccccccccccgggcgtgcagggttagccgggggctaccacatgcatatacttaccctttttctcttccgcatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctagccagtctcgacacgaggatctccccaggcactagcctcgacccgcgccgtttgaggctgggacctgggcacgagcccttgttcaagccaagacacagaaggaccgcggcacagaccattctcgtctcatacacacaacaaacagaactgacgcagaaatttcctctttacttgattgcagattaaatcagtctatacaagaagggggcccgaaggcctcggaagaagaaggaaaagttattaagattggcgggggcctgggggctcactccgacgcgcccgggtcgtcggcctcgtcgtcactgtcgtccgcaccgtcgtcaccgccctcctcgtcggagtcgagcacgaacgcgagccgaggggccgtaccctcgaagctgtggacgatgtggtcggcggcgtcccggacctgcgcgcgcgcgccgtcctcggttccgggagggaactcttccagcgctgcccacggagagaagtcagggtccctgtcctggtagcttgccagtacgagctccaccgccccccgggcgaggtccctcgaggatgacttgatcgtctcctcgagctcctcggggagccgctcgagggccccggccatctttgagaggcgctgggcgaggcccccctggttggcggcgtacttcgcgtattgcccgccccagaggcccgcctgccgcccggcgcggtctagacgggagacggcgtcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgtggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgcggcctcggcctcctcgagagctcgcccccgctcggtgagcgcgtcctcgcggaggcggagtgcggactcctcttcggcgcaggcggcctcgtgcgccgccagtgttgcctcccgggtggcgacggtggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttcccgggcagcggcggcgtcaaggactccccaggtggcgtcaagcttctcctctagctccaccgcccggctcccgtattggaggcggaggtcgtcccgcgcctcgtcgagcacggcggtggcgatgagggcagtctcccgctcctcctccacctccctggcgatctccgccaggtccttacgacgggcctcgagctgtgaggcgtgccggcggtgtgccttgtggcccgcctccaccatggcctccaccgagcgccgcccctcctcgacgcacgcccacgccgcgttgagctccgcccgctccgcctgtagggcctccatctgggcacttaacccgtccagcaccgtgctgttcgcggcggccaaggcctgcaggaggggctccgcgctcagtggggcagcggaaggcagaggggagagccccctcggtgtgggtgccgcgcggctcggcccgccgatcgacgtgccggactcgggggcgtcccccgaagctggctcgtcccaagcgtcgcccgaggggtcgggcccgagcggcgtgcccgcggcctcgtcgtgggtggcctcggaagtcgtcatcgcctcgggcggagtcgggtcgggggtttggcaggccgcctggcgtgcgcgcgccgcctctgcctcctggacggactccccggcccagcggagtctgacctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccggccggacttggaatggcggggggcgcgacgggatctcgctaaggcagaagaaaagccagaacacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggcacgatccccccatcttgcggagccgtttcttctttcgctccccctcgggctgcggcgtcggcacggcaccctccgggcgcctgctgctggcacgcaccgccccgccccctcggggaggagatgggggaggggtaccctcctgcttcctcttcccc

SEQ ID NO: 3357 - DNA, 1696 bp, Oryza sativa
cgccccgactacctgcatgatgaccaggatcttggcgcgctctggatcgcagcagagggggaggaccccttgggggatgagggatgcctccacggagctgagattcagcacccgttggaccaccatcctgaagtcctcagggtcccagtcccatttgcgcccctggtgggtcctcatgtagtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggcgacaccggctgtacggtgaagaaccaccggaacagccggagagatgggcgcaccccgataaacatctcgcacaggtgcgcgaagatggccaacgtcattatcgcgttgggggtgaggtgcgccatctggagatcatacaactccagaatatccatgaaaaaaatagagaatggccggaccagccccgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatccctttctcggcgtctttacacccttgccaatgctatgcccggctcctcgcttcccgcgcccgctacctcgccccctcgtttctcgcgcccacgcctccactaaccccactcgcccgtttgcggcgcacgcggcagatgtgcggccgtagcggttgagatggggcagatcgtgcgcgcattaactacgcccgccaaccgtgaaaagcgccatcatcatgtctccaggcgaaacgaaccggctcgtcccgattcgcgcgctgctcgagtaatgtagcagtcttaaagaggccgctcattattgtcggtcggttttcccttgccgatgcgcgcgatttgcgaccgctgggtttctgcccgcctatagggaccggccccacctgtcaccgggcctaaggagtggcgtcacgcccgagcgcttccctcgaggggggcgatcgctctggcataacgccgggggctcctgtcggtgacatggggccgttggtatcgtgactagaggcttgggtagccgcggtcacccacgtggctctgaccccctcgggggggtcgggcccgagggtgacgtggccacccctccctctgtctccccgaggggacgggccgctcccgtttcggccccgaggtgggggcgccccgaacccctgtggttttggcgccacgt

SEQ ID NO: 3358 - DNA, 33809 bp, Oryza sativa
  unsure (1)..(33809): unsure at all n locations
catttaatgcggcgcagcgtacgcttatccggtccgtgaccggtcgcggtgtgtgaccggtcacagaccggtcagatcgcaggttaggtggcaataggcggcctgtcacacgcctcgccccgtcccgtcggaatgatgagagcttcctggctctcgtccctagccggagccggtgtgctaactcctggagttagtatgtcagtcccggtcagatccattccaggcttcagcgcaagtatggcaaggaagtcgctggccattaaatgaatgttgaaatgggcgtccaccggaaaagcgggcgagcggggcaggaggcgtgtgctctgcttgtcagaggtcacttccggctgtagactagccctcattgtaaaaagcatgtttcctttcttaggtagctggaggcccttgtggtgacccctgaccagataaaaaggaggcccaggcctagtaaaaaaaaaaggaggagagaaaagagaaaggggttgggactctggcgaatgggttctagagcctgaactctctctcgctctccggctctctgtattccttcacgcacagatccaccagaacacaggagtagggtgttacgcttctcagcggcccgaacctgtctacgtcgcccgtgtcttgtgcacttcctctctcgctgactttcctcagatcgagagcgaagaacctcacttagcgcccccggccgaaccggcaaaggggggcctgcacggtctcccggtgaggagccccacgctccgtcaatgtcatatttaattttagatttatctttttttatggaggaagtagttaaattaaaagattcatttttgtcggtttagttgttaatttttaaattttttaattgcttggattttcaatctaattagctttagaatgattgcaatgattggaattatgaaaattagtatagaaatacttacattatgatataaaacttaaatatcctacaaatctttatatttaggacggaggttgtagcttaacaagtgtaattgcttaacacatttgcgatttgcgaggcaacgtgtgctagctacgtactcacttattacgccgtacctgtttaatttctgcctaattccttctgaaagtcgtcgctactacgttcagccgtagacttggctaatcataattcagacgtgtcaagttgcggcattgtactgttgttatacaaataaagtgcatatttgggggttgattttgcatggggtagatggatagctgctcgtccagatggaattgaaacatgcctctaatcgttgctaacatgcgcaattaattatcaatgcttctggagaccaacgcatactgcgcttaatttgtcgtcctcctcgttttagttaatgtactagagcagaagtttccgcatgtttctgtccaatgaaaatgtttaattttgacaagcttataaacaatatatagtgttcgcacgattcaagagttggcaatttgacatacgtatcagatactccacgagctacctagttctcgaagggaatattacaataatttgcacttggacaatacatgtatggataacaaacatccaccctaattacgaaactcctgagaggatctccagtagcagtaacctctagtttagagctcctaaatgtcaaatgggggctgccccaattcttttggacctaaatatgtcatcaactctagcagtagccctcatatcttagcctctatttcttttcctcttttattttagtatataatttatgtttatatatagtttaacaccataataattcaaacataaataattctagcacatagaatttaaccatattcgaatttacaatttcaaacatcacgattcaaatttgagttcaaatttttctaacatgaaaatgataaatcttacaagcaaatattgaaaataacccatagttgatagaaaatgcaaatgaacaaactaccgagcaccatgaagtgcccacaaatatttcacaagatcatctcgaagttgctcatgtgcttgttggtcttcaatttctttatgtatctttagaaacttctccaacacatgtttatcgcgtcgctggtaatcctccttcctcaacacctcactgtccccctgatcatagtcaaagtctacatcttcatctcgctcattgtcgatgatcatgttgtgcatgattacgcaagctatcattatgtaccatagggtctctgtatcccaaaatctagcaggacctctcaccattgcaaagcgggcttataaaacaccaaatgctctttcaacatccttcctcactccttgaacttttgcgtaatggattctttttgttaccttgtggattagaaatggtcttcacaaaagtagcccaagaaggatatatgccatcagcaagatagtaccctatggtgtatttcttaccattcaccataaactccaactcgggcgctgtccctggagtaagcctttgaaagagcggtgatctctgtaggacattgatatcattaagggaacctggtaatccaaagaaggaatgccaaatccacaaatctttagatgcaacagcttcaagaatcatggttggcccatccacatgccctgagtactgtcctttccagcctgttgggcaattcttccacctccaatgcatacagtcaaacctgtccctatgaattatctcacgacctgggactgaaccacaacactttcttttggttctcttatgctctatgtccgtaagaagagcagctgcaatatagtagttgtcatcatcggacaacacctcttgctcccaccattcagcaaggagatcatcgtcatcgtcggaaaagtccatgtacaaaaatcactgccatcacaacattgcaaaattagagaatataaatgcaactacagaagcatatgcacagcacatagtatatatatgtgcaagattatatatatgcataggacaagcaattattttaggataaacttgatgaagtatatatgtcaatggttcagatcgatccattgcaatactagtgcagtccaacacaatgcagtgctactaatataggtacagtgatacatagggatgaaactggttcggatagtttccgtccgtccggactaattttcggattcggaaaaattcggtcggaactattcggaatctctcggattcggaaacgaattcggatattttttctcggatacgaaaacgaatacagtaagggtgatatccgacggaatcggaaaacggtcggaaactatccgggattttttcccggatatccggagttgtcatcaaccattcagaataatcagcccaaagagcccatcagcccaacccaacccaacatgcaacaggcaacacaaaccctagctagctaagcaacaggcgacactcacacaacagccgccccacgcggccacgcatgacggcggccgccgccaccgcccaccgccgccgcgccccttcgccgctgccgccgccgccatcttgccccttcgccacagccgccgccgccgcctcgccccttcgccgccgccgcctcgtcgtctcgtcccttcgtcggcgtcgtcccatcaccacagccgccgcctcttcgtcggtgtcgtcgcctcggccaacagccgccgcctgttcgtcagcgtcgtcgcgtcaggccgtcagccaacagccacctcttcgtcggcgccgtcggccaagatggtgatggtaatattgagatggactatgttgatgatgatgacgacgacaaagtgccaatgagacaatgagtgtttgaatgaaatgtttgtcaatttaatttgcaggttgcatctaaactatgtctgtaatgaactactacgtccaagttgcatttaaactttctgtaagaactacttaaattttctgtaagaactacgtccatgatggacagtccatcagtccatgttacatctaaattctaaactatgtactgtgacttttatgtgttaatgtgtgtgactatgcaaatgtgtgcaagtttgtggctgttatgtgttaatgcgtgtgactgtcagcatgtacaagtttgtaaccggtaatgtgtgtgacagtgtgactttgtcactatttgcaagtttgtggatgtttctagttatggtattattaatcgttgatctttggaaatgtaacattctctattagaaaaaacaataagttatatttctttgttgatttgtgaaggtcagtttgatgggcttttatgttccgattaatattcgttaccgtattcgtttcgattcgtattcgctccgtatctgtattcgataatattcgattccattttcgtatcccggtttccgtttccgatttcgatttcgagaaaaaaaatatgaaaacgaatatgataaagctagtttccgatcgtatccgatccattttcatccctagtgatacaggtcagaattcaggttctcctctacggtctacaaagtctagcacaattctcaaaacgtattaaaaaaaagtaaagatccaccaggacaaccacagtaccacaagtactccgatcaagaagtgctttcagaaaagatgaactagtattcctaccacaaaactacttctgagttctccagaaaaatcgatcggtgagtgactgggcggtgtgaaggctggctggcgcgtggacgggcgaccagtgtaggggcgagcggcgtgcggatggggaccagtgtgtggaagcgaggaactcctacggtgaggagattacgtgttgataattgccacaaaacgggcgccaggattacaatgaggtatatagcttcggttcagagtttgttgtgagaacctagattacaggtataagttctatctcttctaactaacacaacaaactctatccggcagctatatggagcattatcacatgtacaaagaatatccggactctaacactccccctcaatcttatcctgtaaggtttagattatttctgaacatctctacctgtttgacagtcagagttttggtaaatccatctacaacttgatcattagtagatatatattcaacctgcaacagcttctgcgcaactcgttctcgaacaaagtgatagtctacctcaatatgctttgtacgagcataaaacacagggttagctatcatataagttgcaccaatattgtcacaccataccttagcagttttaggcacctgaatccccagttcatgaagcaaagtttgtatccacataatctcagcagtagcattttccagtgctttatattctgcttctgtactggatctagacacagtagcttgtttacgtgcactccatgatacaagattgggtcctataaacacggcaaaacctccagttgaacgcctgtcatccagacatcctgcccaatctgcatcagaaaaagcactaacaagcaaggaattagatttaccaatcttcaaaccaagcttaactgtatgttttagatatctcagaatcctcttggcagcagcccagtgttctgttgttggagcatgcagatactgacaaactttgtttactgagaaggataaatcaggtctagtcaaagtcaaataatgcagggcaccaacaagacttctgtaccatgtactatcaactggtccaagaggtgttccttcataagcactcaacttttctgagatagacagtggagtattaactgctttacagtcactcatattaactcgttttaacacatccttagcatacttctcttgcgttaaaactataccatcatttaccttcttcacttcaatccctagaaagtaatgcaactcacctagatcctttagtgcaaactcttgattaagactcttaagcagaacatcagtagcattatttgaggagctagctattataatgtcatctacatacactaacataaacattgtaatatctcccttactataaaagaacaaggatgtatctgatttagatgacttgaaccctagctcatgtaactttgtgcttagcctagagtaccatgctctaggagcctgttttaaaccatacaaagccttatcaagtttgcacacctagttaccttgttcatatcctggtggttgcctcatgtatacttcttcctctaggattccatgaagaaaagcattctatacatctagctgacgaagcatccaccctctagaagctgctatagacagtacagttctgatagtagcaaccttgactacaggactaataatctatgccatacctttgtttaaacccctttgctacaagcctgactttatatctgtctagactaccatcagttttcctcttaattttgtaaacccatttatagtctatcacatttaatcctctgctaggaggtactagatgccaagttttatttttcatgagtgcattatattcactattcattgcctctgtccaatttgaaaaattttgctacatgacacttctattgtgtgattttagccctaggacactgctcaaactcacttttgagggaaaacactccataaacatgatattttgccggtggacattgcgccgactaaaataataatttccagttgaggaggagattgaaatcgcgtgaaatgccaaaaatgcccttgggcccacatgccagctcttccatctccgcctgatccccatcgcgacctaccaccctctccgatctctctcgatctcctccggccggccgtcaccgctgtccgttttcgtgccgtcgtcgtcgtcgccgccgccgctgccacattcaccgtcgccatgccgacgcagcgccaccgccgccatcaaagccgtcgcaattgccgctgcaactaagcgccactgccaccactgccatcgccaccgccaccactgccaccgccgcgcgccaggatcttgatctcggggccgtccgccgtcgcctcctcgtcgtcgtcctcacccttcgccacagcctcctggttgtcgtcctcatcctccgccactgccaccccacgcggcgaaggcgtagacaccacacgccgcatttgccgcagccgccatcgccgcgtgtcgtcgtggtcgtcgtcggcgtcgccgcccccacaaccgggacagtcgcagccaccgctgccaccgccacttccgccattgacgccgccgcacaactcccagtgctccggcgctacactccaccactgccggcggcggacaactcccaacgctcccgatgctccactctacggacgatggcgctcccggtggaagagagatggaagatatggcatgtgggcccaaggacattatagaactttcacgcgatttctctctcctcttcaaccggaaattattattttaatcagcgtggtgcccactagcaaattactacgtttatggagtgttttcccccaaaagtgagtttgggcagtgtcctagggataaaaccacacaatagcaatgtcctgtagcaaaatttgccttccaatttttatctcctaaggcctcatccaaagtttgtggctctccagaatatgtgaaacacagctgtatctaacaggttcatcagtgtaaactttttcctttctaatgccactttgtagcctagtttttggtctcattacctcagtagacacaccgtgctgtgctggctccatttgtgtagatgatcctgacggatgtgactgctgcacacctggcgccgaggaagtgctggtactgctgtgctgtcggggagagctggcgacaggagatgacgcgccggctcccgattggtccctcgccggcgagcgcggcagccgtgcaggggagcctgcctgctccccctgagttccagatcccgagaccgccgtcgtctcgtcatgcactgctgccgaggaggattctcccgccaaatttccggtgctccgtgcacccggctgtgtgtaccagcacagctctctgattcaccattttcgttgctgatttgaccactgtcctcagcactgcacctgtcatttatccctgcgtctgtacaggcatcattagtagcatttggtatgtgaatattaaacatttgatcattttgttcctctcccccttgatccaatgtgctagtgttcataagatttgaaggaagcaaagatatttctgctctaagacgggcaccggcatttggatgaagggttgcaaagggaaaaacttgttcatcaaatgtaacatcacgagaaacatacaccttgccggtagacacatctaagcatttgaatcctttgtgaagattgctaaaaccaagaaagacacactgtttggatcaaaattggagcttatgagagttatagggacggagatttggccaacacgcataaccaaaggttctgagagatttataatcaggagcctatttaaacaaacgctcaagaggagtatcaaaatttataactctacttgggaggcgatttatgaggtagcaagctgctaaaaatgcctcatcccagaacttgagtggcatagaagcatgggctagaagagttagaccgacctcaactatgtggcgatgcttgtgctcaacagctccattttgttggtgtgtatgaggacaagacacatggtgggatatgcctatcccattaaaaaaggtattcaacttgacatattcacctccccaatcggtttgcatggcaaggatttttcgatctaattgtctttcaacaagtttttgaaactcatgaaatttctagaaaacctcagatttatgtttgaggaaataaatccaaacaaatttactgtaataatcaataaagctaacataatatttctttacccctacagaagtagaagaaggtccccaaacattagaatgaataagttccaagggattattcgacacactagatgatctaggaaaaggtaattgatgacattttgcttgttgacaagtatcacacacagactcattaactgaattactaagacatggcaacttattttgactaaggactcgaagaacaaccggcttggagggatgaccaagatgaccatgccaccgttcaaacgatggcgcaacagcaaaggcttgtctcaagggggtgccgacaggaagagggtagagacccccgccgacatggtccttcaagaattgtcctcctcgtggccttgtccttaatcaaaaaatattttccatgaatctcaagaaaggcataattatctgcaatgagtctatgaacagagactaaattctttgatgcttgtggaacatgaagtatatttttaagatgtaagggacgactaggggtaggaacaatggtatgaccaatatgtttaatattcataccttcgccactagcagtgtggatctgatctgttcccttgtacttctcccttgtagtcagcttatctagctgccctgtgatgtgatctgttgccccggtgtccacataccaattggtgtcaacaccataggcatatgtggccgcgtcgcctagcttctcgtcggggacgtagttctcatcatagcggtgccagcagtcacttgcaatgtgacctcgtttatggcaggcttgacacaccgggtgggtgtcgttaccgcgccctcgcccagtgttggccccgcctgcgccaccacggccgccactgcgaccgccgcgaggagcaccgcccgcgatttccaccgcgaccaccacgaccgccacgatttgcagtgtttgccgaagtagggaggtaggtttggcgaatactgatcctgttttcatagctcaaaagttgggaatacacatgagagattaagagaggagcaattcttgtcgttgccatcaatccttcaaccgctgcgtcgaagtcggagtcgaggccgttgatgatgtacgctatcagctcttcatcgtcaaggagcttccctgccgccgccatctcatcgccaagggatcgcatcttggcaatgtactcacttatggacatgggtcccttctgagtagtcgtcaaggcgaggaggacgttgatggcgcccgccttggatttgcaggagaatatgtcgttgatcatgttccatgcttgggctgtcgtctgcgcgccagccacctgctgcaggatctcccgtgatagggaggagaagaggaaccccaggacttgttgatcctgactgaatcacttgatgtattccgggttggagatggtggtcttgactttcttgtcgccatcttccttctcgcactcggccgccggagcttcaactgtgccggtgacatgcccttccagctgcgcaccccatagggtggtaaggatttgcgcagaccagagggggtgatttttcttggtgagtttatccgagatttgaatcccgaacagaggattggagatcgccgctgctgaggaagagctcgccatttgcagaaacacaaagacgaactaatctaatctagcaacaggctctgataccatgtggaagcgaggaactcctacggtgaggagattacgtgttgatgattgccacaaaatgggtgccaggattacaatgaggtatatagcttcggttcagagtttgttgtgagaacctagattacatggataagttctatcgcttctaactaacacaacaaactctgtccgacagctatatggagcattatcacatgtacaaagaatatccggactctaacacagtgtgcaggcaagcagcgtgtggccaggcggacgatggccgagcgtttgaacggctggcatgcaggcggaggccaggcgtgcaagcggaggtcggaggccctgtggacgacgacgacaacaaaggtaggaaaaaatcctcaccttttttggggcgatcttggcggaggtgggtgggggagtcgatggcggccgtcggaggagatctggtcgtagtgccgcgcgggcgaggcgagatcgcgcgaagcggattttttttcacgccaggaaaaaaagtcgatgggggccgtactcggaacccccaggactgggggcttgggaggagaatctagggtcctcctcactttgggggctctagtagggtccctgctgaatctagtttttatctctaaaccctcaaaaactgattaggggctgagtttagggtctctgctggagttgctctaatggggattgatcgccaggggcgatcgggtctcccccctctcctccacgtggtttcctttttaggcaccgctttactttcctattttagtaaatttatacacctaaagtttgtacacctcaagtttacacatctaaagtttacagacccaaagtttataaatcaaaaattatatatcccattcaaatttgaatttgaattcaaatattttttgtatatagtatttctatacatctaaagtttatacacctaaagtttatagacccaaagtttataagtcaaaagtttaattaccctcttcaaatttaaatttgaattcaaatattttttatatatagtatttctatacataaatttttccaactttgttttttatttttttttaaatttgtagtgtagtaggaagagaagaaggggaggaggaagggaggagaggtgtgtacagggggggcatggggatcgatctctccaagcgatcgatcgcccattagccacaccccctaattatccatttagttgaattatccatacccaaatatacaaaggtaaaaattactggatgtccattacacctaccaaatcatgatgtggaaaggacgggcatgcacagtactatccatttacatcacccaagcccattaaggctccgtttggcacagctccaattcccaactccaacttacttcgagctggagctgtgccaaatagtaccgattctcctttttttttggagcgaagttagtagagttgctacagaaatttgtactatgggggtggagctagttttttgctgctccataactccacaccaaaagacccattaccctttaatttttttactatatttacacaaaaatgccattgaactaccccttcctacctctctcctcccgttctctctcctctccatcatcttccccatccttctccgatggccacaactggttgtggcggcggcggcggcgtctacgttggcagcatgcgggggtggcgagcgcgggccacggcgtgttggcgtcggctcgcgggcggcggccgcggctcgcaggcggcagcgtcgacaggtggcggcctaggtggcggcgtgcgcgaggcagccggggaggcggcggcgtcgacagtcggtggccaggggcggtggcggagatgcgtgggccaaccggcggcggtggctcgcgggctgaccggtgccagcggctcgcgggctgcccggcggcggcaacgccagggtaacgcctacaaggtgttggacgaaatggcgatgagggatgtggtaacgtggagctgagtaatctagccaaacacttttttacctacctcagctcctaaaggagccagctctcactggagttgaagtttagagttgtgagtttgaattaggagctctactaaatggggcctaaatatgaaccaagagtttgtatttaaattttcttaatttgcttttgcactataaagaggccttgaaatagtccaaactttttggacatgatttacatcctattatctcgcttacacttacgcttttaagccaaaatttgatactttttaaatttaattttgggattggttttgtggttttttcatcatagtttattttatagccataatataaatttaaaattttcatttttgaagttgattttatgtttttttatcatagtttgttctttaaattttgaagttgattttgtgatttttttttcgtcgtgattatttcatagcatttgcttgataagggttcaacaggttataccctatatggtattcataaagtatggggatcgttggaaccaggatgtacgcgagatcggatatacaaacatgggataaggattgatactagttcgagcccttaggatgagtaataagcctactcaagtttatatggatatatggatgggaataccacaaagattacaatgggaaataggacaactagactgatccactgaccagaagctgtcgagaacgacctgacgaaatctactcagcgaatatggctctggcttcctccggattgcttcttgatgtggctttggctatggcttgtaactcaattcccctccctggacaagggggccttgtatttatagcgtagattattctattctccaaatataattcgaagagataaaacaggatatgggcctaagaagaccttatcttccccaactaagactcggacaccttatattccaggaagataatttcattctttatcaatcgtatttccttaattaaaggatacattctcatatactatcgagtatatggtattgccgtattacacaaacccatgtataggaggtatgtcttatccttgacactgacagtaacgccctgacactgacagtaacacccgactctaatgcaaatgagtaggttaatgttccagagcaaagatcctgaagaaaatcattgtcgaactcacctaaccattctcgaacagctgagtaagtttagagtacatgacatggtccttctattctctttgtccgagacttcaactcaaatttgaatttggattgaagtcagaaactttaaactgctataaacaaatccacaaaaactccgacggtgatttctccgtcttcctccaaattcgaaccgtcggacgtgggttataaattccacttatgagatccatttgggttacgttttcctaaacaaacattttgcttccccttcgcgcaccttcccactgctccaacaagcaaaaaaaaaaccctaagccacaaacttccctcatctcctcagcgactctccatggatcttccggagtccttccgagtttctttcacttcttcttgatttctatgatatgcaccttctccatctgaatcctaactcccttgattccttagtatcttcactcatttatgcgaggcttaccttggggtacagcttttcatagctctatttagatattttataagcttggatggatggaggcctttagaatctctggatgttgtagtctccatctgagggacaagatgaagggtagatacatcccctttaactgtccatcctctagaaaatactagagggatagctggttttatcttcatgtcactgataccactccttgtcttgctattcccgaagaaaatccctcatattctggggtcatggacctccaaacattctctgacccctgctctgaagggattcaatgacaaaattcatgatctctaagaacgcggtctgactgggtacgaagttgtagagaagactttgttcgtcgtctaatccagtctctccaagcccgtgctcaccctgcatacgagtacatgggggcaaaggacatgacgtggatatcgcactttggtagaacccaaagttttctgataaccctagtactatgaactgtctctaacatctaatctttcactgttatctttgttatagctgtttctgatgcagccgtggtgaagtgggtagggcaggtagtggtcgatccaccatcggccactgctgacatcccgatgccgataagcaacctcccataggccaagaaggacatcatcgtgaacgtaagcatctcggactattctccatatctatcatatatttggctatagaagtagtaatcttgacccatactagcatggcctctaacggatgtgatcggccagcttgtcaaccactaggcgttcgcttctttgaaggagctggctgtgttggagcaagcagccgccaccctcgtgcccagggcagtggatccaaaagaaaacgtttgccctctctcgagaagactactggggtggagacactagttaggacgagcagctctgaggtgaggcttctatttcaggtttgtctgacaatcatggtagccttctcgatcttaacctttcttgtttgcaaataacttccagcacaaagtccgcctccatcaagaagggaatgctaccgatgaaacaaaaagtcggatgagtaccaacttgacctttttttgtttccacttgacgtcgtgtagcttttgtaacccaagatgttttgaatgcagcccttcacctgcggcctcgggacaatgtgccaaggcttgtgaggaggtgagctccaagtcgcctcatgctactgctgctgctactgttgtccctacatttcttcctccgtcggccggcgcccttgtcatctcaggctcgacctctgcctccaacaagctgctacaagcttatcgattgttggaagcaagtgcctgagatgctgtggctgagcttggacaacttgcaaaagtcgcctattcggttgacaccgcattgtggccctggaagcccatctaacggaagagcgtgcggacaacgccaagctgcaggaggagattgccagcgcggaggaatcaccaagtccaaggacaacctggcttcactctggcaagctctgcactagaactacgggcgcctcgatgtggccgcaaaagggcctggggatgagcgttcctcatcccgagtttcctgacgaaaccacggtcctggtgtcccttgggtcgctgataaccaagctggagaccgccgcgagctcccatgcagaccaagtagacaagggaatgaggtctaggatccagaccgacgcatgccacgttcttatgtgcctcaaactcacacgcccggaggtcaacattgaacaaatgatgaccaagggaggagccaacaagcgtcgcgaggacatgatatcagaattggaggatgtcgaggagtctgtgatccccttttttgaagagtaatatgctaattttagtttcattgcaaccttaaggacaagtatttcgtctgttgcccgagaacacttcccttctgttatccttttaaggtttccatcttgtcttttgtattctgtagatgctttgaagtcgagaatgagaacgtccagcaaggcggacgctcgtcaggcttaattgcacatcctagtacgccctaggcctcgtcaaccccgagtgatggcgaccgtgctctggtcgtcgtcacttctgatggcacgttggcctctcaagatgatcaactcacgctccttcgtgagaaatatcaaggtgcgaaaacccgaaattatagtgtattgctcctgtactcagaacaaaggatgctaatggtgtcgctgtctattctagatcttaaacattctctcgaggagatgaaacgctgggccgagtactggagaactaagttcgaaaagaaagagccggagcgagcaaccgacaatatcaagaaaggctagaactcgaagcttctcaaggaaagagaagtccagatggaagcttatactgaaggttgttgcacatcgcttgatcagctatgccaagagttgcatgtggttcgtctagctcctaagagatccataacaggttatctaggctggctgtggagtacatgcgatgacctggttggcaccgctcattggatcaacaaaagcctcaagcaagagagtgtcggaccaatcagttcgctggtggtcatgtgctcgcgtgcatccgtattttgtgaccgcagatgaacatgaactgtcttcggcaaaggttttctctttctccacagacggccgccaagatcgatcaactagcccccgagccaatgtcggtggtgatattgatgtcgtcgtccagcgaactcttaacagatggactgattaatacttctaggaacatgccaggttccatttgctctctactagaagctcgtcgagcaagtttgtcgacgtcggcgttgtctttgctttagacatggtgtactataggcccgtcaaacctatgctccagttttctgacttctacaaggtacttggacaattcaggattagagcatttgtaatccttatgcacttgtttggtgactatttctgagtcgcctttctgaactagtcgtttgaccacaagtgatgcggctgctctaagtccttcgtactctgcagtgttgttggttgctcagaaatctaattggacagcgtgtcgaaattgatctccggttggtgacgtgagaacgaatgcagctcttgctccttggttgttgaatgctccatcaaaggccattgtccatcgctcgttgtccatacgatcgactttgccgtccttggggcggtccagtcggtgacgaaatctgcgggtacctgagacttgatagtcgtttgtgggacgaagtggacattgaattggccaagctcgatgacccatttggcaatgcatcctatgacttctttgttgcgaagaactttaccaagggggtatgacaagacaaccatgaccttgtgggtttggaagcagtgacgcagctttcgggatgtcatgaccatggcaaagagcagcttctagatcttcggatatctagtcttggcatcatgaaggacttaactgacatagtagactaggaattggaccttgtcgtgctcgacaacaatgacagtacctatggagaacggcgttttggcgatgtagaggaagagttccacctatggttgtggggcaacaagtgctggtggatcggcgaggtatcgcttgagtacaaggaatgcctcttcagcctctgatgtccactcgaacctgtcaatgtttcttcaataaattaaagaaaggcagtcctcgttctcccatcttggccacaaatcgactaagtattgtcatacatctggcaagcttctggacttcctcgagcctcatcggtgatttcatttcctcgatggccttgattttgttggggtttgcttcgctacctcgtccaaagactaggaatccgagcagtttgcccaatagtactctgaacatacactactctggatatagcttgagccgatgtctccgaagaatgttgaatgtttcccttaggtcatcgatcagacgatctcgattttttttttcttgacgatgatgtcgtcaatgtaggcctccacgttattgctgagttgggattggaaagccccttggatttggcgctgataagttgatctagcactaatcaggccaaaaggcgtcttgacgtagcagaatacaccgaagtggtgatgaaggttgccctttcctcgtcttccttggccatgctgatttaatggtacccggagtaggtgtcaaggaaactcaacagctcacaccctgcgatagaatctatcggttggtcaatccgtggaaggggaaaatagtccttgggcatgccttgttgagatttgtgaagtgtacccacatcctccacttatcgttggatttgcgtaccatgattgggttggcaagccactctggatggaggatttctctgatgaagcctactttgaaaagtttattgagctcttcttggatagcctctttgcgatctggcgtgaagcgacgcaacttctgcttgacaggttttgcgtcgggtcaaaccatcaacttgttctcaatcacctccctgaagactccggacatgtcggacggctgctaggtaaatacatctgcattgtcatagaggaaggtgatgagcttgagttccaatttgcagtcgagctcggcgccaatcttggccgtgtttgtcaagtgtgctactagacagcgggattatctttatggcgtcgtctggtttgggtgccaagttgggtttgctcactttcccaggaggctcgattgtggcgggactgcggtagtttgctcgactatatcaaggctcatcttgtcacattgcacggccatcttcgcgttccctggcaccgtgattatccttttaggtcccggaatcttaatcaactggtaggcgtaatgcgaagccgccatgaatttggtgagtgttgttattctgaatatagtgttgtaggcaatatcgaactctgctacatcaaaatgatatgctatgtctgcaagttgtcaactctgccaaaggtcacgggcaatgtaatcttcccccaacaaccttgatgatgactctggggtaatgccatggaagggctgttctgaggggatgagctcgcttctaggaatccccattgcgtcaagcgcgctgaggaagaggagattgattgagctgccaccgtcaatgagaaatcgcgcgactagaacgttctgaatagtaggcttgactactatcgggtatcgtccaggggttgtcgtcagagaagggtagtcgatgtcagagaactctatcttctgatttgaccaattcatcttagacgtcgatacccgagatgtagagcatacttcgtgttcttgtattcccgcttagaagaatagaaggttgaaccgccgaagatatacgccacatgttgatcgaagtcaggaaaatctagttcggcatcgaacggaaggtcattggtgccctactctaccatgcaaactcgttttcccttgtcttgggctatcttcctagtcatggctttctaaaatacattgcactccttgaacatgtgagcgttggtcttgtgcaccggacaccattgcagtacaaggccatcatcttgaggaggaggtcgttggggagcgcttttctcttattctgcgacaagaacctccgactgtgccttttgctttcctcctttcttgcgactagattgccaacttgattccatagcatcttgtttggccaactattttcattgactaacttccccttcccatcatttcttcgaacggccttgtctgcgtgagcacacctatcaatgacctcaaacagcttcattgtagatattatccgtcatgtcgccagttcttggattgtgtagcaatcttagacatctgatttgaatgctcatatcacatatgcatcggtgatctctgggatcatattctgacattcgttgaattgtcggataaaatctcgaagaggttcaccgtgcttttgtttgagggcatgcaaggcatcttagaccacatgtctcttgtaggtgccttgaaaattcgcgatgaaatgcttccaaagatccgcgcaggaagatattgagggaggaaggtgcaccagccatgaccgagcagatcctttcaatgttgccagcaagtaatttgccagtgcattgtcatctgcactggcggtgtataggatagtagaatagacgtgcaaaaactcctctagatctatgctcatgtcgtacttctctaccgctgcaggacggaattttaagggctagttgactttaaaggctctgcatccacctctaggtaataggggtggtcggcgactatgaggtccacgtgaaccgccttggatgatgacgaggacgatgaaggcggggtatcggtagtcatggcttcggccttgccttagagctggagatcgtgagtcttgtcattctcgatcatcgcgatgacttcgatgacctcgttcgttctcgtcttgtcggctctagcaatcatgacgatctcgatctcggtcgcagttacgattgtcatctcgacgattgtctctacaattctggtcgcgaggttgtcggtgtccggcatcgtgttggtcttgttgctcccgccttcggccgttcaattggtcgcggagatcgtgagcattttgatagggaggcggttgatgagtatgtcgtcgtggcgatgcgttctcggggatgcgatgctcactgttgttggcatagggccgttggcagcgttagcgtcctcgagaacctcatcgttctggagagggtcttgagggggcggaggcccagcatcagccactaaggcggagttgaggttagcgacagtggactccattcactttaactacgcttctgcatttcagcgggttactagatcaaacggagcttgtcatagtagggaatttacgaaagttaggtgctcggcaggagtgcagagtggcttgacttgtctaggaactctcccaagaacagatttcgccatcttcagtggagccctaagtatggctgtccgtgcccatgtcttcgaccacaccctgacgttcacgtcacgcatagaattggacccagaagattctatgctaaatttttctgcaaacttagtcaaacttgaaaaaattaatgaggaaaacaatcaaagcgacctatttataatatgaaacggaggaagaatatgcataagctgaacaacgttagtgcatttgcaaattggtggccgtgtgaaaatgtgccccataaccgtgcagcaagattttgtgataattcaaattttgcaagccggttatgttcccaataatttttttttctcaagatcaactaaaattcgttgaatatgatccaacaaataacaaatttcattgaatatgatccagattgtagattgatcttcaaatgcttgcgactcaataggtgaagaactttatataacgctggcacctaaaatacaatctaatctaacagtatatagtagttgtctagttgcctaattatgctgccaaattgcggtaccacccatgggtgaaaagaacacggggattgcttctggaagcaagcatatcgcatccaacatttacagaggtcactgacctattggccccttcaatgctaatgatttccattaagcaattttccaaaatgacaatgcacctgacaagctacatcaaccacgatacatcattcgaagaaaccaaaccaataattcaaaagccaaactttcttgttcaagtgatagatgtgcaatgtcataattcctctgcataactaacatgacttgaggtctacatatttcatactacagcatcagaaatttgcaaaaataaacttggcaagtcccaacactccaaaatatgctctatctcagcacggtcaaagttggataattccataacctgaaataacataagcaaataatgaaatagttgtccaacgtagcatagcaattgttatgtaaaaagactaaatgatgacaattagtaaacagtactccctccatcccaccctctatcccataatataacacgcggtcaaagctggcacggtctccaaaactaatctttagcttataatttctcatatactataaggtttgtagcaacaaaattataaccatattaaagtaaatttaaatctcaatctaatgatataatttttaataaataaaattaatttcatattatactaagtgttggtcaaatgttttaaaagttgaatcttaatatgtgtgcgcgccatatattgtggtatggagggagtattttgatgtcattggctttagtgccctttacttagaggatgatcaatctgggatggagggagtactatttgtacattcttttaagaaacctgtagtttaacctacccatttttgaaaataaacatggcagcttcattattaatctactatattcaagacgcaaggtccggagcataaatgaactacttgttaaccacaacttcacttttttgcggccttcacaaaggagaggctaaacagcgaattgatcgtgaacttaaaagagatctaatcacattatagctccatcatggatactaatcagaacaaatgcatttttattgtctggcaatagagtagactagacactgtgaaatgaaccaaatactgataggcataatatcacacacaacattcattggctacttgttatgtttatcaatggcagggcatatgaaacaatttcatgcatggcatttgtattttttttcaatccacttctaggatgttgatgttcgctaaaaatatcaggtaagtatgtagattatatgaaaatgctaataccatttatcatgaaaaattattttatcatgcttttctagtatttaccagaatattgaaaacattttgaagactaaagtaatgaaatattaatcttcgaacattaaaaacatactataaaagaagattgtttgcaaaataatgttttgcatacacaattaataaatcccaaagtttccattagaactaacattatgttaaaccccaaccatcttcccattaggaaacgcccacaaccaagcctaagccttcctcccaactgcacacatgatttttaggctttaagcttttgttgctcaggaacagaatggttaaaccctatagcttcttgtgttttccaactacaatatggtatggccgcattagccctacatgtttgacttttctaaaagtgtggagtgtggattgcaggtaatttattttcattaagacataaaataacatggcaattttttagctacatggcactttggagttgctcgttcaagtgggtaaggtcaggccaagcaactgagccatcagcagagtcccatttgcttgacaaacagttgaaatacatgttttcagagtagaagcaatcaggtaatagtaaatcatcaactgaatgcactggaatccaaaacaattttgcagctagactattaacatatctaaaatgtccaaaatactattgagcatatcagttttctttgaaaaaaagtattagttaactgtatgctcaacaatgagattactgtgcctatcattagatcatcaggataaaaaaaatctgaactgcgttggctttcaacaatcctattgactgctacaactattcataatgatatagccaaaatggtttaactgcacatttccaattctgacacttggtcgtgattggagagtatagtagtacaccacccaaatggccaaatcattatgccccttggagttgaacaacagtatgacccagagtagcacagtcaaagaaaatatattgttacatctactctgagttacttagtaataacaaactaattgtaaataggacaggagggaagttgaaaaaagactgacccaagcttgcactgtatttttctcctttcgtgtcaacaaaaatgtttgaacatacagtaacttctacaagtagccactacttttacatacaagtttagataatattttgactgcggtcaaagcatctagctagtagaacttgaatttgttattaagtaggcattggttgagacagccaaatctagtagtatctatacacaaaccttggtgaatgagtctttgaaactgttcatgcattagcatcaagaaacccaaaatccaagaacatcaatcatatccacacaagatgtttcaatagacaaggtcaatggcaaaaagctgatcacatgttctatatgacggatcacatattgtttacaaatgcaggatgaaactgaagcattgatgtggaacagcaaagccaatatagagagcacatgggaaacataatgtaccctaaaagaaacaatatagcatcaatcctagactaaacactttgatgcctaattatacatttcatccgagttcattgatgagaacataagcacccctaggtgctcaaaggtgctaacgaagattaaaaaaaaaaagctaccatgggtctaagcaatgtggagccgatatgtattcatgaaaaaaggaatgtaaaggtaggtgcggctaaaggtttgaaagctaaaaatgcttaccatctaagattaacacagtaacacctagtgctaagaaacatatttttttcaacgtgattttagtcaacactgtcaaaatttgataaccttagccagtgacaggtccacaactctgtccacatagaaattgtggggtcagctcaaccccgcagctttttagaaccaccttgtaaaacttcattttcatgtgtaaatccagaaagaattagatatgacttcacttaaatatgggtaagaattgacccaatagtataaaattccttgatctaccattgaccttagcatcttcgatggagcacaaaaaactaacaagcatcttgagggagaaagtgctaaagcatccaccgtgatacctaaaataggtcttaagggatgcacatgctcttatcatctagcagtacgttatacaaaagacaattagaacaacagcaaattcatgcatattaagcacatataaggcgtcactgtagtatacatatcctaaggctcttcagaaaggacatggtccctttttccattagagaagccaatagcaaaatacgtggaacttcatagctacaacaaagtaccaactactaaggatgcatatgcctatctatccacctatagaaattgggcacttcctaggagctcccacgttaaccataaagatctaaccgttaattagatggatcatcttcttataaccgtagattggatttaggatttgtgctaaataaaacacgacctgaaaatatcgtggactctttggatgcaatctctacatccataatgacattgatatctctatcaggctcagtatcgtagaaattcatggctctgcccgcgactgtatcgtcgacagccactctaggactgcgagacatggcatatcgatctccttcgccttcttagcttcgcggtacacctgggagaggcaaagcagcagggttgctgcatattgccgcaaaacacaacataccgctgtagctggtgtggcgacaaagcagttaggtggcactgaatttatggagaaaaagccgtcaataaattgtgattttgtattgcattgaggcagcgggcagcagatggtgggggtgaagacacaaattggatcaaaagcggaattcgatggacaacagtagtagagaaccaaaatgatgaatgtaggtgggattgagggcctgttcactttattgccaaaaaaaaccttaccaaattttggcattgccaaaattttggcatagttaccaaaattttggcaacttgccaaaattttggcaggatttcttatatagttaccaaaatttgacagcaaactaaatgtagccacttttttggcaactttaccaaaatttggtaaggttgaaaatggcatcaaagtaaacaggccctgagttagaagatagagaatgatgtactaatttgcatgaaatcatgattcatgaaggcacagaactcaacagtgaagacaaagaagacaaagcgagatcacagtgtcaaataaaagcattctggtctatccatgaaccaatcaaataccactatgcgtcttttaattggccatgcatgcattgaagcaaattaaagcaagaagaggaatatacgatgcatggcagcttagggaccggggtgacacaactgaacaagttggaggatctaaatgagtgatctgcaaatttagggaccgggatgacacagtcgaacaagtttgaggacctgaatggtcgatttgcgagtttagggaccgggatgacacagcggtacaagtttagggaccggtgatggactttactctttatgagtttgtaattgcagcaagtgctttagagcctcatcggttgcccatatttcctaataagcccaaacggcttattagggaataaaaaattaatttataggtaaaaatttaatatatttgtttgtagcgacttaaaagccaacactaaaaagaaattacgctaaaaatatcttaaaatcaagctcaaaatcaagttcaaaaattcaaattttggcttttgctttggcttattaggccaaccgatggggctcttagcgtttaaatattaagttcaatcattcaaagggattttgaagaaaaaacattcaaccacttattcatcagtttaaaatttgacagatatttacattttttacaatactgtcaagtgcaacgcacgggtgagcaactagtgttatataacgaggctagcaagtcctgcacaaaatattgaatgatctttgattctgttgttcgatttatgttaggaatctgttatgtcactcagaagttggggcagagtagtgtttgactgaagaagaatttctgaattaccaaaatctacaccaaacataacaagtagttgctaaaaaaagcacagtcatgccaaacgttcaagttacaatatttcatccaaaattacagacatgaaaggaaggtgaaattccatacctcagaaaccgaaggaagaaaccatccatatcgtctgccattgtacaagcatttacctccagctgctgggccagaaggtatgaatgctatatccagtcttccagttatccaaaagaatcaccttcttcactgcccaccacccaattatcatgaccgccagcatcgtaaaacgctggatctgcaggctctccaccctcaccagcaagtgtgtcaccatggcgatcatgagccccacgagagtgtacaagaacccaaccgcaaaaccctcggcgccgagctgcatcccagacccctggtagaagaacacgagcttgtttggatcggaccggtcggtgatgaacatcggcgtgtgcctgatgatcccgtacatccccccggacacgctgaagaagtaaatgaacagcgccccagccatccaaacccgtcggtcatggaacaaggtctccccgtccatgatcctcttgatgaggaacggaatggagaccaagaagaggatgacgagtaggatcatctggttgcgggagacgaggggcgggcggacgatggggccgacctcgaggccggtgcgggactccacgaactccgccatggagtcggcgaggcgggagaagtgggactggtccatctgctcggagccagcgaggcgggtgtgctcggggcggacgaggcggacgtgggggagggagttgacgccgaactgcgcgaacgagtgctgcgactccgagaactcgatgtcggcgaagaagaggtcggcggaggcggggttgtgggcgaggaaggaggcggagaggagggcgaactcgcggcggagctgggggaggtggaggtcggtcttggagtggagcgaggcggcgtcgaagaagacgagcacggagtaggggcgcggcgccggggcggataggaagcgggtgatggaggtgtcggtgaggtggatcacgcccgacggggagcgggaccgcagggattgcagctcggcgaccaggtcatcggcgccggcggaggcggcgccggcggcgacgaggagcgtgagaaggaggaggagggggtggggtggggactccatgggcgattggcggatctgggcgaggagacgaacggacgagacgaggaagaagacttgggttggaggtattggactggtactggtaggtgggcccgcggagtcgtacggcctactcgtactactagtgatgggctagtgccccgaaaattcggcccaaactgaacccaatgccattttttgcggttttgttttcaaaggtttttcccttaaaatttatccatttttcagccgttagattagaggtatttaactatttcccattcttcaatgtagtatttaacgatttaccaccggatccaatggcaaatttgttaaatttcacatcttaaaaatggcaaatagttaattaacccgttagattaaccccgtgatatgcgcatactttcatgtggttttggtcccacattaaagttccaactcggcatactttcagatggttttggtcccacattaaagtttcaactcggctgtagagaatatgtaaaacaagtcacatacataatccagtctgaatctgatttgggttttgggccttgtaaatatatcgtgggctaagtccaaggggtggacgacctagggctaacccccagcctagtcctctttgcggaattcacattagctgtcatagttttatagccggatttttcttatattatttatgtcgttgcagtttcgctgcaagttcagtttgtggaaacccaactttaagttcttaatcattcatctgcaaaataagttgtaatataccttgttcttgcttgagttcttcaattcgcatgcagggattagccttctcgaagaggccaatcgggtagcacacggttgattaccagaggagacgtggtgttgcgattgtagggtttggatcgtgttgattggaagccggatcatgtgtgtcaagtgtccgccaaatcaagagttataaatacctatcagaagattagaaccttgttcctcaccagagcccatgcacgggccaggcttggttggctactcttccaccatcgaggagtcgggatagatggctaggtggcgctcggctagggaatctctcctccctcttgagaggacgcaacatcacttggggatggttcgctaacatttgtagcgggaatttctttcgatgaccacctgcatagatcacagctatacaagatacactcaaagacatcacatgcaagttcaagccaaagtcaagaagttgacaactttatggtgggagcgccacgatagctgagtctcgacgcctcaccttgctcctctgtatgatgtggaggcaaaggaccagtgtctcttgcctaaggccaaaaacggtacggaaactttccggattccggacctatttttgaaaacggaatctgacggtcggaatttttcgaaaacggaaacgaggaaatattttctcgtaaacggaatcgaaaatgataagggaagtttccgtagcaactcggaatcggttggaaactttccaaaaattttctcggaatttttggaatttttttcggaatttccaaaaattttgtaactgaaataccctgcgttattttttaaagcacttaatagtgaataccatggtgttttactgttattttttaaaaaatattttttatgcaaatctaaaattacataagaatatttttttcctacattgggatttatcaacatcattactctcttaaacatagataatttttttcatagattgtgttttgtgatgtactgttaatacttaacaattggacttatatgattatgttttatgataaatcgttgaccgttgagacttgagaattggatttatcagtttgatgggttttttattccgataaattttcgttacagtatttgcgccgattcattttcgcttcgttttcagtttcgataatattcgattccgctttcgtatccgaggttttcgattccaattccaattccgaaaaaaaatatgaaaatgaaaacgataaagatggtttctatccgtttctgtaccgttttcacccctactcttgcctatgcgtgcggcaacgacagatatcctagcctcgagcctatgagatgaatgtgcaggtggtgaggacagtgataaatcgatggtagtagatatcctagcctcgagcgatgcaaatctcttggcgatgagtgctagagtagatgtgcctaccttggcgttttcacatgattgagtggatagtgaaaggaccttgatgtcgcctagaggttgggtgaataggcgttcctaaaaattatcacaacttcatagcatatcagagtgatgataacttttgattcaaatcgaaacttccggtatgggattggaagttccggtctcaatcgaaaagttcggcggataacggaataaacactagctatgaacttgtagctcaaacaaacaaaatgtatatgaatcaaaaggtgacaaataaggtatctaagcaagatataaggtcacctactaaatcaattaagcatgcaagtagatcaggtaaaaacaagctcaagcacaatatgagagaatgcaagaacgggcaaaccaagaggggagatgcgtgatttgtttcccgaagttcggatccacggatcctacgtctccgttgaggagccacaagggccaggcctatttcaaccctttcctcacgagggtgcacaaatgcactcctcggtttcactattgatttcttcccttgcggaggcgaaatcgaagccttcacaaactttccatggcacaccacaaccttgggtgctcaccggcaacgcctagccgtctaggagaccttagtctccaagagtaacaaacacaatcgaagatttgcttgctatgaactcgagtgctcaaagtatggagtgaagctcactagctctcaacttctcaatcactcaatccaactctttccccttctcaaatccctctcacaaagaggcacacaaaggatggagtgaagctcactagctctcaactcctcactctctcaatccaactctctccccttctcaaatccccctcacaaagaggcaccacaaaggtagggaaatggggatggctatttggctttggatgtgtctaatactccccaagagcagcagcccctcaaaagaggggtggaggagtttatatacccgagcccctcaaaaactagccgttggaggccaagactgtaatttttggagtttccgaaaagcattttcggacaagtccgaaaacttacagaagcaaatctcatattcgcagccactttcggaatgtccgaaaattttcggagtttccggtaatttttcggactttccgaaaagcacagagtaaaacgactataacttttcactcgggagtccgttttcgatgaacttggactctatagaaagctcactcagaggactacccaactcaaccaaaaacaaggtctaaaaccactcaaaggataggttaaagcttgggcttctctcaaggtagcactatgataggtcactttgagcaccgagacatacacaaacacctcgacgttgcatccctcttaatagtacggcattcctaaactcaaatgtaaataagaagataattataccattaggaatgcctttttttcatccttctttcattgtctagagggacgccaatgccgataccgtttcaccatatattcttcaaatgattgatgcggttacttgtagcttcaaatggtctctcacggtccatcatgacaaagccgtcactcgccctttaccaccaccggatttggtccttcggcgccaagccccttgcttgcccttcaccgccgcatggtccatcgcgaccgagcatcgcttgcccttcaccatcttgccataatagccacttcgtatcacacatcttcaatatcttcactttgtcattcttggtattgttaggtgtaatgatatcacttgagcatcaacacctttgtaatccttgggacctatttctttcattcaactcaataaaattattagtcccaatgatccggttgtcaacctccacatgttgaccaaccgatcgcatgtataaaaggatatgaataaatgatgagtattaatcaacaccacaagtgtcatatactcaaatatatgttcaaatgtaaagatcccaattaaatgaaggtgaataacttggattgattacatgcataactaaagtataggatttgctccccctaaatgtatgcatacaaaatatttgtgtgaagcaagagcatgcataacaagatattaaacattgagagcttatcctatacaagaatagaaggcatttctcaaatatagatattaaaataaaaatataccttcatcatctccacgttctcaatgtaaatagactaaataagagataatactcaaacaaaacattagtctcacatgcatatgccaatcacgtggaaatattatatacgaacatatcaatatgtacatgaagagaaagagtgatacatatagcttgatctccatgcatttcatccttgtgatttaggtccaccaacactccaatttcatatccacatgagaataggcaaagaaatgcttataaaaacattagtctcacataattggatttgttattaatcatcaaaaccaaatcaatgtcacttgaactttcagatagctctctttgcggggtagtaggcttttgttgacgtatccctaatgagggataagggtggcctcacgcctacccaaaggctaccgactttggggccacgcaaagcggctactctgggagcctgcttcttagctttttccctgcacgcttggagcttaggaactcggcgggatctttggcgggcctttttcaggagcccttctccgaccatcttaggggctcggatataaagatcttagcatgatgactaacagttatgggtggaagtaaaacgaaggacatagacaataatgtgcgagctttacctaaagatgtggattctcgatgttgaaagagtatgggcaccccttggtagtaaccactacgcctagcttgaagatttttgtccaggtggtggcctcattgtccctattcctctcatccaattcccaagtgggatatgtgggggccacaatactcaaaactcatatgcaccctgttcttgagtgtttggatgtgccgaagcacgaagttcaaagcgatgtagacgtcggccagattcgcctccttcaacttgttgaaagaagataagaggggcatgactagcatacggaggaagagaaggggaggggtttgagtagtaaaaaacactcaaaattccaccccttcaaagaagatttgaggggaagattgaagtaatccttcttcttcttgggccacagctggtggacgacgcctccaaccacctggggatttgctcaggaaggctggggcttgaggttgaacaagtgacggaagagggcgaagtgtgggggatcccaagaaagcttcacaaaggttgatgaagatagcaatctggagaatagagttaggtttacatgaataagctcgattccatagaaatcagaggttgcaagagcaaagccatggtggaagaagggctctaatcctataatctcactcgtattaggggtggggaagagctccgtgatggctaggcgccagccgatgatctcttgtgctggcaatagcttgtcctccaccagatcatctagtttgctcccattgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3359 - DNA, 753 bp, Oryza sativa
cacaggactgaggaagatataagaaccagatcagctttacaagaacaatcaccttaaaacttacaaagaacctaagtataaacatgtgatgaacaatgcgtgcaaccgtgcaagggagaaaaaccaagtatattcaacattcttcgtgtcctgaatatccggttatacagcagaagaattatacagtgctcgtgtgctagtacattttgggggtggaaacgtaccttctacctcgagcctgcttaaataattgttacaaaatgagaagtatgagaagacatcgacacaagattaccatttacacccaactcagcttttctaaggcagatcccagcagccaatttgcaaacaacaaagcaaatgggatatacagagtagagacatgcgaaagttatatgcccttcgtccaaaagaccatgcgtaaacagaagcagcagcaatacagttgtcaaggtctgccggcgatcctcttggctcctgcaatgtgccgatatttcaaagttgcatttaatgctgaataacagtaaggattcacaaaggagtacttgtgtaacaaaaagacctaagtgaatagtacgggagaaaatccattaatccatttatgctggtataaatatctctcaaataaaaaaatggaggtggtttcaaaatctcagaatctaagcccattactaacatcaaaatgttcttgagaaggacatcagaaaagataagccccttacaggctagtggttgattaattgatacagtaac

SEQ ID NO: 3360 - DNA, 695 bp, Oryza sativa
cagcaagagtacccgcaagagcatgcccatctaaactgtcatccattgagtgcacaaccggaatgcatctttctgctcctctacattctggatatcttttgtcaactcctctctttcagccaaagcagctgcaacagatgttggaaggaagtcttttccacgatatattacaatgtagtacttatttcgaagaagcaaggtgccccctgttagattgtgaaataatgttaaaaagataaggcttcactgattcagaaatcctatacaggttaaatcaaatatagtgcatgaacagttgaacacagttgattcatggaaacacacctttggaactctatgaaagttcgacaaggaatagaactaaactatatgaagctgtctccatcatgatcttggtaaagcatgattgtctatgatggtgtttagacaaataaaagcattacattaagcaagttatattcattagagcaagcagtgcagcacaattttgttattattttccgaaaccctggtgttgctttggatgattaacaaatcatggattttgtaatattcacaggacaaatatggacttcatcaaaacctactgctgagtaagtgagtactgagtattccttatagttgccccttttttatcaggatttttagttgaatttcttcatgcctcaaattcgactagatatatgggctgcagg

SEQ ID NO: 3361 - DNA, 1324 bp, Oryza sativa
cctgcagccccctagggtttatattttcgatgcacgaaatctcgaggttttgacacgggttgaaagtagattatgaatgtaattttgaataattttttagaatccaaattggaaacatgaaaattcggatgaaatttgatcaaaaattgacaaaaaaaaatgttagactgctaggggtcgagatctggcatcaattggaaaccctaggtacgtacccactaattaatactctttgttaattgtattttctaggtagacttcagttaattagatgcattagcctgatttgcaataatccctagaaatcgtacggtgatcgatcacaaattttgaacgacttagtgggatagagggaaccggaatattactgtcagcttgacactaatattttcctattccattatctaacaaaattagtgtcagtctgacttagctcaatgattttaacacgcgctttggccagtaaaaccatgaagcccttggtaattaccagccaagaaagtgacgctactcaaaagtaagactggtgttgtttcagctgtctgcttgtgccatatgtaccatgtcaaatgtagcgtctttgaattcgtccaattgtccagctgatgccgacttaacgatcgagccacggccatgcatgtacggaagaaacggcgagatgatggtcggcaggtcattgatttggcaattatcgtgtttcttaaaccaacttggtgagtttcttctgtgaccagccagacgcccagagtccccagaccaacgttgccagcgttcagtttctgttgatacgacatgccatgcaaatatggaattgcagtaacaatttataactgacccggtaattaactcgagattctctgaagagaactcggacgccatttcagtgaatggctagctgcacagttcatccgggacgacaccaatatggtcaccaaatatctctatcagaaagacagacagaaacatggaaatgaacctctgtttcgagacccgggaccatgaaatggccggtgctgcagtaactgaaggtcacatcgcgtctcggtaggcagcagcacacactggagcggcacacatttttgcaggaaaccgtgtgcatgaacctgtcgccgatctgtccgttggtccgatgtcataggttacggcgggggggacgcacgtgtagcacgattagctagccgagtttgtttgcacggtttcattcaacgggaccgcggttcaacaaattctctcctaatgaccagcttagctagacatgcaggagtagcaatcatcaggcttaggccgaaatgggccggcgagacctgactaatcgactgattat

SEQ ID NO: 3362 - DNA, 3605 bp, Oryza sativa
ggtttccctagttctacttggacaaggggacacctatgggtataaatacaagaccccctaggaggagaggggacacggacaacatagacgccacaaagccacaagccaacatacgccaagacaagccgtcggatatcgacatcagagatatgcctggatcgaccctatctggtacctacagaggccggccgtagggatctagcgttgtctatgatctcgctgggcacaaactcgaggaggaaggctaccctgttgtcgactacgagtcagaccttcagaccgccatatcgacaacagttagataggctaccccaaatattgtactggtgtgattatggtgaataagagcaatattggcttcggccaacatgatatagggttattacctgacaatttaagggcccgaacctgtataaaaaccctcgtccccatctcttttacttcagtcttgcatataccttaataccaacgatgtccatactatgcaaataccagaatcgcgacatcaaacgtcgacataacccattttaaattagcacactgtaactagtctataagttctatgtaactgtaatataattaaacttattttgcatagcgcaataaaaaattaatgctctatgtgtagatgataattgacggtgactgtgcaaccaaacaaatatatcacatataagcaacagtgcaaccaaacaaatctctcacgaatcatggcgccagatcgaacggccagaaaatcgaatgtttccggcattcaaaactgttaacagctagctagcaaaaccatgaatatattttgataatatatttgttttgttgaaaatattactatatttttctataaactttgttaaactctaaaaagcttaactaaaatgttaaacaatttataatataaaacggaaaaattactatcttggtcataaaatggtactgatcgatagaatattttttagcataacaaattcggacagtgagtaatattttaggacgaagaaaatactgacacaagtcaaaatccaactcccatcccacctacccagccaccaacaaaccctttttttgcttttttaccatggtagtatcacctaagagcaggtacaatagtaggctataagccagctataaacatattttaaaaagataaaaaaagagagagaaaagcagcgggctacagatctgcagctggctgcagtacggactccaagacataatgtgtgtatgacagatgggaccaggtactaatagtatagtaagcaattattgtataaattagctattacattgactatagatattttggagctcatagtgagctatacgagctcactatgagctctaaggcttcgttcgttcttgggcgatctgggggattgagagagaaaagcatctcgttttccgcgcgcacgcttcccaaactactaaacagtgtgtttttttttaaaaaaaattatataggaaaattgctttaaaaaatcatattaatccatttttgaagtttaaaatagttaatactcaattaatcatatgctaatggctcacctcgtttcgcgtatcttcccaatctccccaatccctttctcctcaaacacaccctaagagcacccacgatggttatctataggctctctacaagatatctatatcagcatattttcctacttgaaagagattaaatgaagaaagagagcaaagctatctactaacttagagatagtctatagagaaaaacgaggcaatgcatagagagctatagatacccatatagacatactattgaggtggtttactattaatctaatctattgctgagatgtacatgttttataaaaagcacattcctttaccattgcgagtgctctagaggaccaacaactctagccagaaatatgaagaggactggacaatgaagccttgcaggccacaggatttccacgcactcgcacaccgtccaccgtgcgtgtactgccgcgcgcttgcacgctgcagcaccaccaccatggctcactcacctaacgccgtcacagttcacgtcgtttctcaagatcaccaaatgttattagatcattcataatgcgcggacgtgtcgttgagcgctaggaacggaatatccgacgtcacgtcctctgtcagcgttgccccgtaaagaacacggagccaaaactgatcacccattcttcggcctgaccgaggggaaaggggcacagctccacgttgtggaggtcggagcctcgccactcgtggctttgcgtaggcgtccacgcaccttttcccctcccgtgctttcctttctctcgtgcaagagcggtggaaaggagaacgagaacggcaggctggcaacacaagatggcagtggaagcgagaacaagcatcgggagagaagaggagcctactagggtctgtctgccgtcgcccacccgcccgccgccgaggccactcaaccacgttgccggcaagccgccaaaccggtgtcgatttctccgccaaatccgccgccaaggccactcaaccacgaaagttggccaggagaggagggccgccggttggggagatgatgaggagcgctggccgtgggaggagacggggttgccgggtgcaccgccccttcgatccgtgtcggtcaagctcgccgaccacgccacccggagctcgctagccgcctgcctctcgccgaccacgcttggactggtgtcgacattggtggagagaggaggggagggggagaggggcgccgccggcgagatagccgaagccggactgccggtgtagggagaggaaaagggagagaggggggaggtgaggggggattttatatatttgtttttttagatttttggggtgttcagtgtgaattttggacctctacacaaattacgaaaaatattagaactaaaacaaaaaatttagggactgaagtataaaaattaaagtcacttctaaagccacttacactgtgacactgtgaaggattaagattttagaccagtgatcttaatttatgtggcactctgagctcctcaaatgagagggacgcatgaatggccttagcaaccaaccaatcctccgccaccaaactcccctacctacccacagccgtcaactcttcaacggcgactcccctatataacacgcacagtcgcgtcgcgtcgcgtcgctcctccagcaacaacgaaccaacggctgagagtagagtacgtgaagttaagtgaagtgaagagacgctttgcattgcagttgccaccgcttcccacgcggccgtcgtcgtcgccatggacctcctcttcgtggagaggctcctcgtcggcctcctcgcagccgccgtggtcgcgatcgccgtgtccaagctccgcggccggaagctccgcctgccacccggccccaccccggtgcccgtcttcggcaactggctgcaggtcggcgacgacctcaaccaccgcaacctggcggcgctggcgcggaggttcggcgacatcttcctcctccggatggggcagcgcaacctggtggtggtctcctcgccgccgctggcgcgggggtgctccacacgcagggggtggagttcgggtcgcgcacccgcaacgtggtgttcgacatcttcaccggca

SEQ ID NO: 3363 - DNA, 6927 bp, Oryza sativa
acgacccgctgttcctccgcctcaaggcgctcaacggcgagcgcagccgcctcgcgcagagcttcgagtacaactacggcgacttcatccccatcctccgccccttcctccgcggctacctcaggatctgcgaggaggtcaaggagacccgcctcaagctcttcaaggacttcttcctcgaggagaggaagtgagtactcctccatgagcgagactccatcaattagccaccagaaatcctctgctcacgtcgcatggtgggtgtttctttcttgtgtgtgtgcaggaagctagcgagcaccaaggccatggacaacaatgggctcaaatgcgccattgatcacatcctggaggcgcagcagaagggggagatcaacgaggacaacgtgctctacattgtcgagaacatcaatgttgccggtacgcgtgcctcggttcagttaacagtttcttcttcttctttttaatttattttcgttaaccatgttgcttgcagcgatcgagacgacgctgtggtcgatggagtgggcgatcgcggagctagggtgaaccacggggagatccaggagaagctgcgccgggagctggacacggtgctcggcccggggcgtcagatcacggagccggacacgcacaggctcccctacctgcaggccgtggtcaaggagacgctccggctgcgcatggccatcccgctgctggtgccgcacatgaacctccgcgacgccgagctcgccgggtacggcatccccgccgagagcaaggtgctcgtcaacgcgtggtacctcgccaacgaccccgggcggtggcggcggccggaggagttccggccggagaggttcctcgaggaggagaggaacgtcgaggccaacggcaacgacttcaggtacctgccgtccggcgccgggcggcggagctgccccggcatcgtcctcgcgctgcccatcctcggcgtcaccatcggccgcctcgtccagaacttcgagctgctgccgccgcccgggaaggacagggtcgacaccaccgagaagggtgggcagttcagcctccacatcctgaagcactccaccattgtcgccaagccgagagcgttctagagtgcacactaactagacagtgaactgcatcgtcttctctgttcctctagaagtatcaaccccattgtttggtttactcgtcgaataagccaaacgatatatatatttgtaaactagaactaatttgtgaataaaatttttatatatatgttattggtgatctaaaagcaaaggctgaaaaataaacttcgataaaaaaaaccctaaaatcgacttcaaatttaaggttgaaaatttaatttttgagtgataaacataaacataaacataagtgaaaagattattgcatcgctagttctctacagaagttccattatcatgtttcatgtataaatcttaccaccatcatcgtcatgtgcttaatgccgggctaaattcttgaaatgatcgtcagtcagaaactttgaaatggccaaactgaaaaatggtactcgtagaatttcttccgcataaaacacctaactcactactgtaatattttgtttcaattagtacattccccaacgttgtaatgggggataaaacgttggatccgctggttacgtacgtacgctacgtgtgtggacgcgcgatgggtgaaagtgactgaaggaggatgaccccgtttttaaattactagaatttccttctgtcttggaattcaaatttccacggtccgcaacactggtttttttttcagattctagcaaagcaactgtggttgtgggcagtctgctttggttgtgatgtttcagtttctgctaaaccacttcttctcttctggttaccctgacttctaaaatgcttgtgatatgtactagttgctacatagaattttcatcgatgcctgaccacatctgttaatcatcacatttcactggccaaatacccgtgctttgctacatattaaaacaaattaatactgaggtttttgggataattttgtacctatggatgttatactgtacatctgaaatatgatagaatatatatttacacggattattttataacattaaagtacatatgtaattggtactttctccgtctctaaatataagagattttgggtagatgtgacatatcctaatactacgaatctgcacatgtattcaaaatcccttatatttagggacaaagggagtagataacatgatggagcatgtggtaaataaaaaaaaagtaaatttcagaaaactgcaactttagtgataaaactatcaatttgttgcaacattagcgacatgtttcagtttgctacaacaatagcgtgtgaaattatcacaaactgtaacttttatgttatatgatgctacagtacaaataggtgacaactgaagcatcatatagatattataatgtacaaatattgaatatgtaaatacctgtgcacttctgatgtatttttaaaccacttattctaagttattttcagtttatttttcaaaatatttaattatcactgtaatgaacgcagttaatccgatcataaatcaatctctagcatggtccgatcaaaagtttagaccttactaaatttttagataacaaaccaaacataatctaaacattataaccataccacaatatgataactctcgggaaaaaatatttattaaaaagtttaccaaaatgtagtaaggtctcaataaaaatgtatatcaaccttccctagtcctttagtattatcaaattttagcaagttttatttgccataaactaaacatgcccaataatttatcaagacaaattgagttttctagtaaaattgtacttttaccaagctcaagagggggagaaggttacattgcaaattgcagtacacacaaacacatacttgaatgtttgacgtttaggataagattcaatcaaaattttaaattttgataatttcttgaatgttcaaatgttcaggaaaaaaagaaataatatatgtggatttgcttcaaactgtaccatatcataatatcataaatctgtatgttagaaatttaaaggtttaatcacatgttttttttctagacattaaatatttctgacaaaaaatactccacgataagtaatcgagagtggcagggacctaagagcaaaggaaatagtggactaaaagtcaattataaaattattatatgaaggagagagataaaggaaaatattgagtgtgggctctcaatgcaagatatgctgtaaaataaaatgcattaaattcatggtgagagaaaagaaaaaggagaaaaatgaaactaaccttataaataacttattatacatgttagctctaatgtgaagttatagttagtgttagctctagtattaaacttgctctaaacaaggttttccctaactcttgcactacctttggtatgcagtagcactgggatagaaaagtttccaatttaataagggcctcagactcagagaccttcatatgcaccctgcacagcaagtttctttgatcaattttttacatcagggtgcctctatatgtgatacacacgtgcatggtaaagtgcaaactttgcaatttgacatgtcaaaacacccacacataatcacttctttgcatgcatgagctgccagcctgtccgtccaataatcatcagaggtaaaataaaatcatcagccaacaaagggcaaaaacgcaaattatttttctccccccgtcttcctcgcctttcctgcaggtaggcccccgccaccgagccctctgttacctccccccttctcctccgcttcacccgacgcctcctcctgcccgcccggatctacctcggcgccgcgtcggcgggcggaacccaccggcggccgcgcggggaggaggcgatcgaaaaaacccgaggggggaatcgcgccgggataatcctagggcagaatgttcaagttcctcaaggaggtggtcgcgggatccggatcgggcctcaaggacttcccctacaccatcggcgagccctacgcctccgcgtggggctcgtggacgcaccaccgcggcacctccaaggtacgctctcctcccttcccctcaccgctcgatcgggggcgcggatcgatttgatagatccccatgagatggggcggcggagatatgcgagagcgtgccgctgattcggttcggtggtggtaagctagtgagtgatccgggtcaagctaagtttgagttggagctgatcgtgcgctgattctaacggcgagtctgagtgggtgctccctgggtacggtttggagctcgtgttaggtcgatattagcttgagtaatacctcaggaagtagaattggtgggctcagtgctgagtttatttgaggctgatctggtttaagggagcctgtgatttctgccagattactgggagttcgtcattgctcactgcacagttgcatgccatctggtaatagtgaggaccttactgatgtcagcacttagtcattagatttttttttttggctgtggaattagattattcgtgaggtttccttcatggttagtgatgttattgatttcagttggtggtaattgagcatccaaataaaagttatttttgatgttgttgcattgggatgctggagattgtgtcaggttttatcttttgttgactagtgggggcatgccttgtgcatgcgtgttctgcaaatggtgctgtagattagcacactctgatgatatatgtgacattggaggcctcatactgatgcttatgtcgattggagatcatggctcattcaactagggatgatcagatgtctaattatgcctaatgtacctgtgtttgggtggctgttaatggactaaaagaccaataatccatttctttttggcagttatggatgacctttcagggtgcaatgatctaagtcaagatggattgtatgtaacttatagtggcctttgtgtagttcaatatagagatgtgtagaacattcatgcgtcaattttaccacccagatggttgtgatgtgatgttgatcaaaattaggaggtctgttaagtgtgttatctggttccatttctttttcgcaagctttgatttatttgcgcagcatactcttttcccccaaatgattacatattgcattaattttacaacatatgtatatgatgctatcaacataattgttgccttgtcttttctgcaggatgatgggtcgcccgtgtcaatcttttctctgtcagggagcaatcctcaggacaggcacttggttgctggtcggaatggtgttaagagattacgaacagtaagttactaatgttgatcttaaatatttgtaatgtctacttgtactgcaagtgtcttattttaacagatgagaatggagtctatggtgatatactattgagttctagaagggtacaacaaaaacaaggaaaaaaatctgcacagagaagattcaataatggtggcattatatcatgccatattggcatttttttaaaaccaaaggccctttgacccagctttataagaaagccaaaaggttcttgcaacaatagattttggtttttgctgggatttccagcttacattaaagagtaggcaggaaattccatctgggcattagccattaggtacgaggttatgcatgccggtccacttttttggcatctcgcattaaattttctcagtgacttgcttctagtggacatctttacttaaatatcactttgtagtgcaattgagttttgcttttgtcatcggtttcattggacttctttactctcaatatgacacctgctaagttagttcagtgttattgacctgctgcacttattgcaggtgcgtcatccaaacattttatcctttcttcacagtactgaagcagaagttcctgatggacctgccatgaagcatacaatttatattgtaacagagcctgttacgccactttcagaaaagcttaaggaactgaacctgggaggcacacagaggtattatgagcttcccctatcctttggtgtttaacattatgacatatatatttgtgcagatatggagtacggttgctgcttaatttagtgtgagcaatatgttttttttgcttaatagtctagaactattggggctaatcaattctagtgcactagtcttgtcagagttggcagtttgcatgtttactgcaccatattgccagtagctatttctcgagagcaaaatttcatattgctcagtttttgtttacaatcatatttattctcactattgctgataaattatgggccagagatgagtactttgcttggggtcttcaccagatatcaaaagctgtgagctttctcaacaacgactgcaagcttgtaagccctccccccccctctctctctctctcacacacacacacactctctctctctctctctctctctctctcaaacggagtacaatcgcataatgcaagctgttgatgtggctactacttatctcacagaacttttcaatttccatcacaacaaaattatttctggtgggcataatttgctcatttttaaaattttaaaaatatcaatttatatttagtataagttacccttggaattagattgcacaaccaaattatcgtcaggatcttcttgtttacatgccaaattcttttttatccagatgagaaaagtatcacaatcagccagcttatactgtgtcatttcttcttgaccatttgatttcagaatttgtacttgtataactttgttgatatgatgttttactcttattttgttaatggcggataatgaacaatagtcaatataaatgcatgttcttatttgtgcaaagtcatgtaatgacacacgaaaacaatgtatgttggaagttctttggtcataaaatttgaaattgtcatcatcaatttcaggttcacgggaatg

SEQ ID NO: 3364 - DNA, 3918 bp, Oryza sativa
  unsure (1)..(3918): unsure at all n locations
ctctcttttggacatgtttggtgaatgtactgaaacaaatgcttttacaccgtgcttgtcatgttatcgtatgtcgagtttccattgtttctagaaagtaagaattggtactctttaatatcagggaaattcaacatgatagagggagatatataccatacttctttttacatacttatgttcctttgcagcaatttgaatggttagttggaacacaatataagccaatggagctaacaaagtcagattgggtgtcaattaggaaatcacctccatgggcaattgattcctggggactgggtaagcagagctaactccttttccttcattacattcttgtttgattgttctgtttccataattttacaattcggaaactgttcaacagttccttgtcggatgtgcactcggcattattgtactttaattgcaaaagttgtttattttctttaaatggatatctctctatgggcctgtatcgtagtttcaaatcttttatggtaaatactataaagttttgcactatagaccaggtcaagatcgaccaagaaaagacatgtctagagtcaaattaataaactatggttacctgaattcctttgttatttgcattttgcttttgtttgctttgctgcatatagactctctttaatattatttccagaatgatgaaatattgataataaatggcacccagcggaggatatatttttcgaattagagaatccattgtttgtaatcaacaagaaaaaaaatgggaaagtaagacaatctaaaggcaaaacacacagagaatagtcatatgttactaagctgaatctctttcacataatcacattcaaggagcacctgaaagtttcttatagcagtatttaacagtaaaaatggtttttagactcatctccaaaaatattgatctctggactcattgcagggtgtttaatttatgagctcttttctggtgcaaagctaaccaggacagaggaccttcggaacactgcttcaatcccaaaggttagtttgcacgatcatggtcctgaatctgtctctatttagctattgattttttttgttggtaatttttgtattgcttctccactgtttgaagtctgtaatgtagagcattatgctgactaatctatacattgttcatgcgtatcataaagttgttggtttccttctattttgctgcagtctttacttccagattaccagaggctcttgagttctgccccttctcgtagaatgaacccttctaaacttattgacaacagtggtaagttcaacatatttttctctcatcatttcaggaattactttttgtatttcgacacttattacatcgacgcccataaccttctacttttgctcttaatgctgtaattctatgtcaattatttggattactttaaataagctgcagtgacaattgtggttcttcattttcagagtttttccagaacaagttagtagagaccatacagttcatggaagttcttaacttaaaggacagtgttgagaaagatagctttttccgtaaactaccgaacatagctgagcagcttcctcgtgagatagtcctgaaaaaggtaatgttcaagtcatgaatagaacccattattcccccggttcttgtttatatgcttatcggttggttactctgtcaatagttgctccctgtgctggcatctgctcttgagtttggttcagctgctgcaccagccttggttgtattgttgaagatgggttcctggcttccagctgaccaatttagtgcaaaggtttgacttcatttctttcgttttcacccaatattcgttagtcattccagtaaatgtgtgttacgatgttataacacaagttaaaaccactggcattttcaggttttgcctacaattgtgaagctttttgcctctaatgaccgagctatccgagttagccttttgcagcacatagatcagtttggggagtcattgacagctcaaactgttgatgagcaagtatgctatcatttcctgtatggacatctgcatgtgtttctggaatgttgatgcttgacaggataaatatctctaatgcaggttttcccccatgttgccactgggttctctgatacttctgcttttcttcgtgaactgaccttgaagtctatgcttgtattggcacccaaagtaagaccctcccaaccctctgcatgatcaacatttgcaccccgaacaaaatccttgtggatgtctttcatttttactgattgtgctgtgttaacagttttctttttaaaaagtgttctaaatttatctatcgctctctctggttgtgtgcacagcgggcttttaaagaaaaaaaaatcctgggattgcaaatttctgtggtattattttttcaggaagattattgcttctttatgactaattcaccaatctgttactgtagttatctcagcgtacgatttcaggatctctcttgaagtatctatctaagctccaggtgatgttctgttctaactgaaatgcctcagatggactcagtttgacatgtgaaggtatacaatttagttaaaagtaaaaaaaatcattgttatctgtgttcaggttgatgaagaacctgcgatcaggacaaacactacaattcttcttggaaatattgcaaactacatgaatgatggggtatgtcctttttattgcttttttactaattttccttgaaatttcactgtagcaagctgactttaagataggtagccagtatatctggatttctgaccagcaagtttctcaattatttaaaatccacatgttttttgtaccatttatctccatggtctgtgataaactttgttaaaaactggctggttactggagattactgatcatagtgatcctggctagtataaggccaaggaaatgcataaatgcatgatagtaaagaaagaaagacaagaggaaataataatcacctgaaaattactagaaaatatgtttttgagttttgacccaaagaaagcaacacaaatatatcctggagttctccattcccttgcctagatatcgagttcattttctgtttgtactaaataagtaaatagtcattcctaacaatgtttggctattttgacagactaggaaaagggtattgatcaacgcatttactgtccgtgcattacgtgataccttcccccctgctcgagcagctggtacattgccctgtagagttgttctgttttactacttacaatgctatatcgtactaattattgacaagtaagtattgctttaccatttgtctggcaggcatcatggcgctaagtgtcactagttcatactatgaaatgacagagattgcaactcgtattctgcctaacgttgttgtcctcacatttgatccagataggtataacatacagcatttagctctcagtctctactttctcattgttgcttgttgtaacaagcaattaaaggctcagagatctgttagtttgatagaatagattattgtctcactaaccactagtagttatatccaagtaaaattcaaatggttggtaccctttccaacatgaatcatagcaccattgctcaatgttttgcatatgctagtagctatcagtctgatttgactttttttcttagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3365 - DNA, 693 bp, Oryza sativa
ttgtaagtctctgtcatacaagaaatctgacctaattgtgggaaccagaccccaacgaccaatctcttcttctaacaatagaacactcagtatcaccaattctgaagataggagaggaactgatgcagctagggcaagagatgacaagttggcagctcttaaagcatataggagatctaaggggttgtgttttacttgtggtgaaagatggggaaaagaacataaatgtgccaccaccattcagttgcatgtagtagaagaacttctggaagctgtgtcagtagaagctgtgtttgaaactgatgatgaaaatgacaccaaggagacacttatggctatatctcagcaagctatgtgggggatagaatccagtaaatcaatcaaattaagggggtggattcagggttttgaattattgatgttaattgattctggcagcactcattcctttgtggatgctagcataggacagaagttatctgggctcaagcaacttgataatcctgttgctgttaagattgctgatggagggactatgcaatgtacacaggaaattcctaactgtaactggtggatgcaaggatacaatttcatcagcaatttcagattgctgtatttggggggttatgatattattctgggaatggactggctagaatcatacagtcccatgcacattgattgggtacacaa

SEQ ID NO: 3366 - DNA, 2279 bp, Oryza sativa
ttcctgcagcccaccaaataaaagtcaccaaaaaagggaacccttcaatgcaacgaacataacctcctaactctgagcgtaaatcattcgatgtaccactgtgtagattctctccaatttaagaatcattcagcgttcgcaagtcttgcgccaagtacattgcatctcattgtctacaacaaaagtacactgcatttctatatatttgtcttttcagtcgttcatgcgattctgatctgaggtgataaaagtggatgttttccagctttatgtctaactacaccgtaacctcctaactctgcgcgtaaatcattcgatgtaccactgtgtaaattgtccccaatttaagaatcatccagcgttgaccttccaaaaaagaaaaaaagaatcattcagcattcgcaaatcttgcgccaagtacattgcatctcattgtctacaataaaagtcgtacactgcatttctatttgtcttttcagtcgttcatgccattctgaggtgataaaagtggatattctttccagctttgtgtctaactacaccgtaatactttacgtgtcaacccggagtgattgggtctaatccttttttccattgcacaagttgacacatgccatgttcatatcatatttaacgtacgctgactctcattgggacgtgagaacaatgactaggaaggtctagggaaaaaatatatatataacggggatagtgatgctttctcaccaggactacggtctaacgggacatgtgcagcaactctcgagattaccggttgcagtcaaaatttaaattttaaaagttaatttgaagttgattttagtttcgatcttgtacttattttattttttaacattgggttttaagtcaataaaaacatacacataaaaagttttacctataattttctttttctaatattaatttgctacggcttataagctctaggcgaaacgctcgggccggcttaaacaggtttagcttatactcctagttagtgctaattaaactcgttttgtactagtaattaactaatatctcggatcagtaccgctttcagcatgtagctggtgagtgacatattctataagttggatctccttattgacattggaccaagattgaaccgaacttggacaaataatagtacgggtcgttgggcatatgtgcaacttgatctcagatttattagattcgatttaaccagtctccctaacgcgctctaacatgacgctgatgttctcttatctcatatcattggccctggtatctgttggttgctagtgctctgatctcgacttagaaacctctccaggctgttggatgtgcatccaacggctgagtgcttctttcttaacctctccaagataaaatgaaaacggttggaaacgatatcatctctagaaaatagttcttgattatttgattttttttatttataaatttaagtatttgatgacatctttaatacgacgtcaataatattataaaataagtcaaatttatatatggctaaaatagaaaacggcttaatataatccatccttacagaaatgatactcacttaattggtcaggaatttctagcaccattatgttttccagatctttcttccccccgtgttctcaagattcgtgctcgaagcatctgacggctaggccgactcaggctaatcgtgggagagatgacgcataggcatagacaagctgaataattaaagacccgtgcacggtctggtttttctacggcctggaccggcaagcgcatttgacccgccagttttttctctgtcaactccagcagattgcatggcgagggcccatcacattttagaatgttccatccacgcatgcgtagttagtttcacgcaacaatacaaaacaacgctcaaaatctctgcaatttatattataaaccgctatgaagtcgctgtagcttgaggtctctgacagaaatctgttctgcaacacacgtacgtgtgttttgaccaaaaccggtcggggaaattaaatctcccttgtgatgaatatatactagtttgtttttaaggtcgatgaatatatactagtataaaaaactgcgaacacgcgcactgacgttctactgaccaattagaatttctcttctgtaggagtagttttgacccagatcttcgcatttgtcaatataagcataatatatatgtattccctggaaaatggcttccatggacggtgcgacgagctcggagttacttactgagtgatgcttacgcgatggcacgcggcgggctgcaggaa

SEQ ID NO: 3367 - DNA, 5522 bp, Oryza sativa
gtattgtttagaactttggggatagtacaagattacgtacgtttcgtaccttgaagatgtcaaaatattatacttctgaagaaaaaaaaaaggagtcatcgtcaaatttcaacagtaaagcttgtagagtcggccaaggacagtgaaaccgacccctagagagggagtagtaaagtcttcctatatgaaaaaaaaaaggaaggaaagggtgtagtattgactgtactaacttgaatgaagcaaataatacgatggctgggaagtctatttgtaacaagtcccggatgacttactggtggggacaatgtgtgattgatcgctgcttttagcacactgttggtcacataagggcattagcagtgcatccggcttgtttcgtgtgaccatgtgctcgacatagacaaaaaagtgaatgaagccacacataacaaattttaatctcccacagtacgccggcctccctctcccctccccaggtcattcccctaacctccccaagccgacatgtctcctccccttccccaccaccactggcacaactccacttctcccgaccgtcggtgcagctctccctcctctccgtcgctccccctccctgtcggcgcctctcaatcgtggacgccgcttgagcccagctcgacggcttgcggcggctgctgcctccgacctctccctccgtcgtttcctcctcgtttccggcctctccctccaccgagctctctagatccggcccgtgactcaccgaatctggacacgataagcagcaatgggccggcggctcgatgacgatgctggcgacggctccatggtaggcctacggcggcctctcccttcttccctccggcaccggcgcgacgtccctctccgttgctgtaacgtcgcacctctcccaggctgggcccacttacatctggcagcttttccagatccggcccgtggcttctcccttcttccctccggcaccggcgcgacatccctctccgttgctgtaacgtcccacccctcccaagtcaggcccacttacatctggcagcttttcttggatatagattgccctcacagaccaacacaagtcttttctgcacactttatccttacttgtgcacctgaaaagaatttcctggtcggtcacccatcccaaaattccaagcacgcttaaccacagagttctttggagatcggcttccagaaaagaagttgcaaacttgttgttatgagtattctattaatctatcaagccttgggccaggatgtcacagttgcgaatcggagagactggccgacgagctcggcggcgcggagaggagaatgacgagcaggggcggcgacgaggttccctctccggtgctgtagcagctctctccggcgtcgcacggggccacgaagcgcgaggccatgacccccacagagcggccgtgccgttcttccctgcgtcgcacgacagcttttctaacgaagaacgagtgcccaatgtgggctacgtgaaccttgttcggtcacgctccaagctgagttggcggagaatctcgggttagccgaacgccacgcacgcgcattgtgaatgccctaatgacaaatacaacatatggtgccctcccctttctcttctgttgggaaggaaaacaaagagagcgtaaatgtcacgccccgaacaagtcccgagcggaactagcccgtgacgctccaaattaacctgttaatcgataccagtcccaggaaacagtgctggtatcacaggaagacagaatatcacagcaacaaaggtctctttattatagagtaggagtacagtcatgttgggctgcggacagatcccgagctcacaactgcattacaaaagggaagcggaagccaagacttatgggaaataagtgtttaatgcaggcttcaaggaaaggctgttgttttttttttgcaattgattttatttgaactcttttctaaaacaactaggtgagtgcttctcaaacgacacggatgagacagtgcgactcatccggtcggagtatgtgcaatgtatcagtcttttgaattgatcaagattggcacccagccaacagctttcaaacggccacccgggcctggctgatcccatcagccgcagattttccaaacatcaatcccgaaccacatcagcaaatttcacaaagcagtagtcaaacaaaactacgctaggaatcacctcacatccgcccatgaccgtgggcacggctgttcgaacagtttaataacctctgcagagggggtacactttacccacacgacattactaacccggatcatccagcccgtgcagaacggccacgactagagaccttaaggctttcatgacaaggcatttcgagagccgacacaggttcaccatatgctgacgagaggggtcccagaccaacaacaggttaggtcccagaccatactgtgccaggaagcccaggggtcctccccgacaccaccccggcgaatccacttgtctctcagcatcaaggctcccctgtttagctaattactcagccagggatgtcccattccacccatgtggtcgtacttgtcttatgttcggatgaaattccaaggaaacggtccttaagtgcaaaagcgggaaaccgtacacccgatacgttccccggtccgcgattttggaaattcatttaggttcgcaagcaccgacccaggtgtcgggttttccaagtcttttgtaaaacccaagttttacccaagatgtttctcaaattttaagtttgaaggcgaccgtcgatactcgtgcagagtgcacgattaccgaggcgcaactaggtggttacaagggaacatggtataacaattacaatggaagggtcaaatgcaacaagttaggtaggtccgccaatctgccttgcagacgggacaagtagattaagtgcgatcctagcaatgcataatatttttcaagcaacataattaagttcaaatataggctcaagatgttcaaaggtggcttgccttgctcgatatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaaattttagaagttgaacggagtcaaacggacttacggttgggaagatattgaatttctaagattattggatttttggtctaaaggaaaaggatttatttaaatcctttttgaaaaagaaaagaaaagaaaagaagaagggaggggaattagactttcctcgggcggctagggcgcgacccgagagaaggggtggctcggccgagcttaatgggccggccgggccaagaaggcggcccaaggcgcgcgcgcgggcggggaggggagagagagagccggtgggccaggtccatcccgcgtggtcccaggtgggacccgcttgtcggcgactcggctcaccgtgagcgaggtgcacgcggggcgtgctagggtttggggagggaggcgcggcgcatgcgtgcggttcgcggaggacgcggtgcggcggagcgaaccatggcgatacaggcgaaggcgagtacaccgggacgttgcacaggacgaggggagacgagccaacgactcagattcaccgagggtgctcgacggcggcggattgcggtggcggcaatcggcggcgggagaaggggaaaacggcgatgaggtcacgaggggccgattcccggcggcgagagcatccacacggctacgggaatccaccccttacgccggattaggaggaatcgcatcgagggaggccggcaacgagaggcgcttccgagctcgggcggcgacggcggcgagcacacggcgagcgacggcagcagtcggggcggcgccggctagctacggggaggctatacatgctactaccgaaaactaaggggaagagatggattgaggagggagaacggggagatgcactaccgtgcggacggggcgcagcgacgatgggccgacggcacgggagcgatctctccggcctcgggccggggaagaggaaggagagggtgcgtccggagtccccttccgcgtcctaacgtgcaccgactccttcggcacacgtgacggtggcggtcggcgatcggcgatcggcgagacagaggggacgacaatggcgcgggcgaaaaacggggaagattgggaggggaaaaggaagggagggcgcctgggtttatagggcggcgatgttggtttggaaaccgacctaggacggtcaagggagggagctagcgctcgacggtcgcggccaaagcggcgacagggaggggaggatgacgccggcgggagggaaaagggaaaaagggggagagaaattgggcttgcctccttgccactttggggaaaaggaggagggagagggagcgatgcagcagaggggggcggggctcagcctccgtcccttggaagccagcgcgcggcggtggcggggccgggtcgatgacgacggcgatgacggcggaccggtttggagtggagcggcaacacgggcgacagacgcggggcaggcgcggcaggcgttgacggcggcggcgactggccggtcggccaccacggcgcgcgcgcacgcgcgggcggcgcggcgatttgggcggcatcggcgggaatggcagcgagagcgggagggagggctcggcgcggctcacggaagagcggggagagagagagagagagagagccggggagggagggggagatgggccgagagggattcggcccatcgaacccgagggaggtaaaatagacttttgcggagggatttgatttgggaaggatttggattcgggattgaactcgacaatagattggggatttgaggtctgagatggcacggacactagacaacaagcaaagaaacagatttcgcaactagggtttttaagagatagttttcccgctaagcgccacgacggaacgggtgctacagtaaaattcctttcttttatgggaaataacaagataggctcctactgtggtaatatgttaaaaagggaaagatatatacaaagaaaaagaaagaaagagtcaggggttgaacatttagaccggcgatgagcgctcattcgcatgtgctaccactgtgcaagtgttgtttttgtattagttacatgaaagttatatatggattatattatagttgcatgcaagcttatgttataaggctgtattcggtgggaagggctagaaacccttcctacgggcacgttaaaccaagcagtagattaatgcgtgcttaattaagtattattttgtcggtgacatgggaccgggagtatcatgactagaggcttgggcagccgcgatcacccacgtggcctgaccccctcgggggggggggggtcgggcccgagggtgatgtggccacacctccctttgtctccccgaggggtcggactgctcccgtttcgaccccgagggccggggcgccccgaccccctgtgggtttgccgccacgtatatgggttaggt

SEQ ID NO: 3368 - DNA, 18169 bp, Oryza sativa
  unsure (1)..(18169): unsure at all n locations
catgcagcttgctaaactgacgcgtggtggacgagagtgaccggtctgtgactggtctgacagctgtcatgtcatcggcaaacaaccgtgcttccacgttgcacctgcttccgacggagtggaggttggtatgacccatcccatcggagggtcattcaaacagcaccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagggagaaaaaaaaggagagaggggagctcgtagaaaggacgaggggaaaaatagtagggagagggtctctagagttcaaaggctcttgctcttcagctctttgtaactccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaatggccgaacgagcaaaagcgcacaacctctctccgagcgctagcggtgacgacagcgagcagaacccgcgtcgtcgagcttgtactccgccgcccccctctcgccgaagtcttaggcgggaggaggcgctcgagggggtcgaaagatccgcgacttcgccgcccatgagtgatggagaaggacggcgagacggggagcgtcgtctcctcgtctacggtgatggcagcacgccccagggcgcgctccaggctgcgggcgcgctcctgcgtcacccgcccgtcgtccctgatcaagagactccaactcgacgttggctagatgacgtggccaacttggtcatgacggcgcagcagcgtttaggcgccggcgggcggtcctccgccaccaaggccactggcgctgctactgccggctccgtgtcgtcgaggcggagggcgcggcgagcggcggccgttgcccgccgttcgtccgccattccctcgtcaatgcctccgacccaagaagatgtgcgtgaggggccggatgcccgcctcaatatcgagcgccggcgcaatgatcgccgtgctgcccacgcatcggagggcgcttcctcgtccggagcgccacttcggtccgggcacggaggccagccccccgtgtccccggttggcggtgccggctgtcgagactttgtggcgagccttcagaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtatattcagcggttttgtcaagtccgcaacaccataccatgtatccctgcacacgcggtgatctacgcgttcagggggggcgtgcggcacaaccgcatgctcgagaagatcgcctccaaggagccccagaccactgcggagctttttcagctcgcagaccgtgtggctcgcaaggaggaggcatggacctggaactccaccggttccggtgtggcagcttcagccgcccccggatctgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaaggccccagcggctccctctggcaaccggcgaagtgaggccaagcagaaggtccccgccgaggacattgacgatggcaacgatgacctagggttccaggagcctggggccaccatcgccaccgtcgatggggagcatgcgctcacgtttctcgccggagcctcaaggccatgaagcgagagcttctggccgcggcccctacccatgaggcgatgcggcgtgcgtggtggtcggaggttgccctcaccttcgaccagaccgaccacccgccgtgcgttgcccggggaggacagatcgcgatggtggtttcccccaccgtttgcaacgtgaagttggggcgtgtccttatagacgggagagcagccctcaacatcctttcccccacagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggctcggcacctccgtccccgccgccccgaggcagcggatgatcacgtgcgacgaggtcccggtcaaggaggttgccctgggcgacggcccgtccaagaccacacgaatcggtggtctgctggacggcaaataggaagacgcgctcgtctccttcctgcgggcaaacgctgacgtcttcgcatggagaccggcggacatgcccggggtccccagggaggtgattgagcaccgtctcgccgtacggccgggcgcaaggccggtccgtcagaaagtgcggtggcaggcctcggaacgtcaagccttcatccgcgaggaggtggcgcgacttctggaggccggattcatccgagaggttatccatccggagtggttggcgaacccggtcgtcgttcccaaggcgaatggcaaggttcgaatgtgcatcgactacaccgaccttaacaaggcatgtcctaaggacccttaccccctaccacgcatagatcagattgtcgactccaccgcggggtgcgaccttttgtgttttctagatgcatactctggttatcatcagatttgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaagagaccttactctcggatctagcggaaactttcgaaagtctccgcaccgcccgcataaagctgaaccccgacaagtgcgtgttcggtgtgcctgcgggcaagcttctcgggttcttggtctctgcccgaggcattgaggccaaccccgagaaggtacgagctatagagcggatgcgcccccccagcaagcttagggatgtgcaatgtgtcactggctgtatggccgccctaagtcgattcatatcgaggctgggagagaaagcgctacccctatttaagctcctcaaacgctccgggccgtttatctggacggaggaggctgaacgggccctcactcagttgaaggcgtacctcagttctcccccagtcctggtcgccccggagccagatgagccgttgctactttacctggcggcaaccccgcaggtggtcagcgcggcgttggtcgtggagcgtgacgaggacgaccctcgctccgcgcatccccaccctgtgtcgactcgacccgggagagagcagggaggagaggcccccgagccgaacggtggcccaaggcccccgacgaccggagctggccctccgcccgcttgtccgacggtgccaggcgcccccgacccccaggatggccccggggccactgcgggaaggccgcgcctgtcgccctccgaccccgaggtcgtcggcacagaagccgagtgcgccccgcgaggcctctcggacgaagagcgccctggagatgcggcccctagtgaagaagatcggccccgccgaaaggtgcagcggcccgtctacttcgttagcgaggccctccgggacgctaagacccgatacctcaggcccagaagatgctttacgctattctgatggcttcgaggaagttgcgccattattttcaggcgcatcgggtcacggtggttacgtcttaccccctcggccaaatcttgtataaccgagagggtactggacgggtggtgaaatgggcaatcgaactctctgagttcgatttgcgctttgaaccacgccacgcagtcaagagccaggccctcgccgactttgtggcagagtggaccccggccgctgagcccatctccgtccccgaggccagctcgggcccctcgcagctgcctcacaccgcctattgggtgatgcagttcgacggctccctgtctcttcagggcgccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccgtgtgcggcgtatggagcgccattttgacgggatagagcttcggcacgtgcccagacgggataacacggtcgccgacgaactctcaaggctcgcctcctcgcgagcccagaccccaccgggcgcctttgaagaaaggcttgcccagccgtcggcgcgacccgacctcctaggggagacggacgcgcctgaacggcccccgaggcccgtcggagtccaggcctcgggacccgaggggagcgatcccagctcccttagattgattgcttggatcgctgagatccaggcgtacctcgcagataagactctacccgaggaccgcgaagggagtgaacgcgtccagcgcatctccaagcgctacgtactggtggaagggaccctctatcggcgcgcggctaacggagtcctcctaaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcggtcgacctggtccggcggtgcagggcgtgccagttccacgccaagcaaacccatcagccggcccaggccctacagacaatacctctttcatggccgtttgctgtccgggggctcgatatcctgggtccgtttagatgggccccgggcgggttcgagtatctgtatgtcgctatcgacaagttcactaagtggcccgaggcttatccggtcatcaagatcgataagcactccgcacttaaattcatcaagggcatcacagcccggtttggggtgcctaaccgtattattacggataacggcacccaattcactagtgaactcttcggtgactactgcgaagacatgggcatcaagctctgcttcgcctcccctgcccaccccagaagcaatggccaagtggagcgcgccaacgcggaaatcctcaagggcctcaaaaccaagaccttcaacatcctcaagaagcacggcgactcgtggatcgaggagttgccagcggtgctctaggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcatcttcgcagagatgacctcgactacttggaagagcgaaggcggcgtgcggccctccgagccgcgcgctaccagcagagcctgcggcgctaccatcagcgccacgtccgggcccgatcactctgcgttgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgtttctacccctagtaggggtcgggtgtcaggtctcgggctcgggccaaccccgcaccccccctgggcgtgcagggttggccgggggctaccacatgcatatacttatcttttttctcttccgtatttcaataaaagcattttcgatttcctaaggactgtgtctgtgccattgtttcctttcaaagagtcttggcttgaattagcatgctcgtgctcgaccctgccctcggtgtcccgggccggcggaaatcgccaaacagggcccagaatcgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagccctcgttcaaaccaagacatagaaggaccacggcacagaccatcctcgtctcatacacacaacaaacagagctgacacaaaaatttcctctttatttgattgcagattaaattagtttgtacaagaagggggcccgaatgcctcggaagaagaaaggaaaaactatttaagattggcgggggcctgggggctcacttcgaggctcccgggtcgccggcctcgtcgtcgctgtcgtccacaccaccgtcgccgccctccacgtcggagtcgagggcgaacgcgagccgaggggccgtaccctcgaagctgtggacgatgtgatcggcggcgtcccggacctgcgcgcgcgcgtcgtcctcggttccgggagggaactcgtccagcgccgcccacggggagaagtccgggtccctggcctggtagcttgccagtacaagctccactgccccccgggcgaggtctctcgaggatgacttgatcgtctcctcgagctcctcgaggagccgctggagagtcccggccatctctgagaggcgctgggcgaggaccccatggttggcggcatatttcgcgatccgcccgccccagaggcccgcctgccgcccagcgcggtctagacgggagacggcgtcccgaagcatgccgggccctacctcgcctgccaagcggagggcctcgacctccccggcggacgagtccagcgcgccctgcagctcggcgatggtgtgttcggcagctgcgagnggncngctagatcgccgtcgcccgtggccgccccgccgctacgcgccctcgcatccagctcccttgcccgtgcctcgagctcagcggcccgctgatccagtgcggccctctcggcgcgggcaccttccagattgcgacacgtttgtttctccagcgctgcctcacgaagggacaggctgtccgccagcctttgcgccgcggcctcggcctcctcgagagctcgctcccgctcggtgagcgcatcctcgcggaggcggagtgcggactcctcttcagcacaggcggcttcgtgcgccgccagtgtagcctcccggatggcaacggcggcctcgcggtccgccaggtccctctccttcacacaggcgcgctcttccagcgccgtggcacgggcctcaagggcttcttcgcgccaccgggacgccgcctcggtctccgccgcccgccgtttccgggcagcagcggcttcaaggaccccccgggcggcgtcgagcttctttcctagctccgccgcccagctcccgtattgaaggcggaggtcgtcctgcgcctcgttcatcactgcggtggcgatgagggcagcctcccgctcctcctccacctccctggcgatctccgccagctccttccgacgggcctcgagctccgaggtgtgccggcggtgtgccttgcggcccgcctccaccatggcctccaccgagcgtcgcccctcttcgacacgtgcccatgcagcgtcgagctccgcccgctctgcctgcaggacctccatctgggcacttaacccgtccaacactgtcgtgttcgcggcggccaaggcctgcagaagggcctctgcgctcagtggggcagcggaaggcatgggggagagccgcctcggtgaggatgccgcacggctcggcccgccgatcgacgtaccggactcagggacgacccccggacctggcttgtcctgagcgtcgcccgaggggtcgggcccgagcggtgcgcccgcggcctcgtcgtgggtggcctcggaagtcgtcgtcgcctcgggcggagtcgggtcgggggcttggcaggccgcctggcgtgcgcgcgccgcctccgcctcccgggcggactcctcggcccggcggagtctggcctcctcccgagcggcttcctcagcccggcgagcccggacggcctcctgggcagcctcctcggcttcccgaaggcgatccgcggcttctcgccggtcagtttcccgtctccgggcctccgcggtcgccgtatcctcggcctcagaccggccggacttggaatggcgggaggggcgcgacgggatctcgctgaagcagaagaaaaaccagaagacaaacaaaacgggtgagtgaaaacttgcattgggagaatgaatacagccacagtgggcgcaggacgaacctgcgaggaggtcggttgaacgaccaccttgggggggagataaggtttccccggtatgattcggtcccccccatcttgcagagccgtttcttcttccgctccccctcgggctgcggcgtcggcgcggccccctccgggcgcctgctgctgacacgcgccgccccgccccctcggggaggagatggggagggggtaccctcttgcttcctcttccctcgggcgtcggcagggcggctgccccccgggcccctgtcacggggcccagaagcacgaccccctcctggggtagattgttctcccctgcggctcccgcccgcgccatcgtggcctcgaggagcccgctcctccgacgccccgaccgccatcatgatggtcaggatgttggcacgatctggatcgctgcagagggggaggactccttgggggatgagggacgcctccacggagctgagattcagcacccgttggaccactatcttgaagtcctcaggggcctagtcccatctgaccccttggtgggtcctcatgtagtcttcggacccggtgtactcccaggcgccccgggcgcgccgctggagcggcgcaatccggcgacgaaggtagtcgccgtacagcatggcccccgtgagcccctgggatcgcagacccgccagacggtcaagaacggcgtcgtagccatctcccagatctagcggcgcccgccaactggaggcctgcgctgggggctggctccgaagttggaggcgcgcttcgtcggcgaggggggtgtagaaccagtcactcttccagtcgtcccacttcttgcggaggacgcagggaatgtagcggctcagcgccggcccccgcggctggaagtagcagccaccaactaccgacggcggcgacactggctgtacggtgaagaaccaccgaaactgccgaagagatgggcgcaccccgataaacatctcgcacaggtgcgcgaagatggccaacgtcattatcgcgttgggggtaaggtgcgccatctggaggtcataaaactccagaacatccatgaagaaagaagagaatggcgggaccagccctgccattgcgaaagggaggaagaagacggaccgccccgggtagtgtggtaccgggcgtccctcgcctagctcgaccacctcccggccggtggcagatgccggcatgaatcggcgcggcagcccggcctgcctctcgctcacgatgcgggaagacggcagcacgctaccgtcgagtggtgcggagccccgtgccatgacgccggcggaggaggagcttgaaaacgagtgagtgcggcgagggtagggcacaggaaacaaggagttagggcgcaagcggcgaaggcaaggggaataatgacgagaggaaggaagcgaatctcttcctcggcgtctttatacccttgccaacgctatgcccggctcctcgcttcccgcgcccactatctcgccccctcgtttctcgcgcccacgtctccactaattccgctcgcccgtttgcggcgcacgaggcggatgtgcggctgtggcagttgagatgggacatatcgtgcgcgcgttaactacgctcgccgaccgaagcgccatcatcatatctccaggcaaaacgaaccggctcgtcccgattcgcgtgctactcgagtaatgtagcggtcttgaagagaccgctcattatagacagtcggttttccgttgctgatgtgcgcgatttgcgaccgctgggtttctgcccgcctgtagagaccggccccacctgtcaccaggcctaaggagtggcgtcacgcccgagcgcttccttcgaggggggcgatcgccctggcataacgccgggggctactgtcggtgacatgggaccgggagtatcatgactagaggcttgggcagccgcgatcacccacgtggcctgacccctcggggggggggggtcgggcccgagggtgatgtggccgcccctccctttgtctccccgaggggtcggactgctcccgtttcgaccccgagggccggggcgccccgaccccctgtgggtttggcgccacgtatatgggttaggtgagcacagcggggctcacctaaccgcatttattgcgggttggacgagcgcgtcacgccgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagagagaaaaaaaagaaggagagaggggagctcgtagaaaggacgaggggaaaaagagtagggagagggtctctagagttcaaaggctcttgctcttcagctctttgtaattccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaaccggcaaaggggggcccgcgcggtctcccggtgaggagccccacgctccgtcatatttaataaaacttttaaattctattaatataatcttttaaagtaacttcgtttagaatacttttacaaaaattaccattcagcagtttaaaaagcgtgcgcgtggaaaatcagaaaatagaagtttggaagagaacaaatcctaagttacatttgtaaatttttggatgagttttctatggaagttgtatatctagtccttattttctaagcccagtaattattgcagcagacatgaaataatgcaattgcccctgaaaaacaaacattctctggaaactcaagctgaaggcacatacttgcgattatgttggagtccaaagtgcttggatgcaaaattccctttgtctctactcgctcacgtagcgcttgctagcattaagaaaggactcgctgtacggtcgtagataagtccaccattccgcgttaaagcgttttcccgcacgggctgagctggtgcacctcccacgagccttctcatcccctccggcccatccacctcgcttcgctagctagctgctctccccacctatataacagcgagcccgcccaacacccgctcgccctcctctacttctgccgcgccaccaaccatccatcgctgacgcttccaacccaactgaattcaaacgaagcgaacaacacgaaccatgcaggcgcaatcccgcctcgctgctgccgcgagcggcggcagcggcagtggaattagcgggagcggtggcattagcaggttgggtggtggagcgggggaggagcacgaggcggtggtgagggagctgacgcgcgggcacgagctgacggcgcggctgcgggcggaggcgctgcgggcgctgcgcgggcaggggcaggccgaggccaccgctacattcatcctcggggaggtctcccgcgccttcaccgtctgcctctccatcatggccagcgcctccccgtccgcctcgccgccacaaccggacgagacgccgccggccgactcagccgtctcgccaccaccaccgcgcgcggcgagagaggacaacgtcccgcgaaagtgagttattctgcacgtgctatacagttatactggaagcataaataaatgcctagctagctagcttccagccgcagaactagtagctagctaatcaattagtacaagatcagctgggttaaatatgctataggaattgagtacgagtttatctgattcatcccgtgcattgatccacaggagattattgacagcctctccttacgacgatgggtaccagtggaggaagtacggtcaaaagaagatcaacaacaccaacttcccaaggtttaaattaatttctcaaccccgtgcctgcaggctagatatatcatataccttaacccatggattaattaatcgacaaccctgctcatgtcaaaatgctcagataattaaccatcgcgactactcgttttgtttttaaatgtaacgagattatggttacgaatttagatacgcatgcatcttctcttgtccagattcatagccataatttttatatttagaaacggaaaaagtatatatttagcaaaaatgggtaatttaccatgtcgttgtaaataaaaaaccaaggtgagtacttttggaccatgacggttctagctagctagagacagcgtataggagaaaaggtattattcgtgatgtattgattggactttgttggatagcgaaggcgtggcaccggggacggaagagacaaacggaaaatgtcgcttgacacgcaccctacaactttatagattcttttgagcagccaggcgaattaattgatcgccacatgtttgaaaccatccataaagttaagccttatcagttggagaaaccaaagttaagctgattttttttctgtcatgtggaaattaagctgttctgttttcttcacatgatcattttgtccctggtgtcacgttgtgtagcgcgagcaaataactgtggtttatctgcgtgtatcactgtgagctctctgctagtttaaagctggagtttgggttatattatatcggaagcatcttgtgacgtcatcacctaataattatttcttgtgatgtgacctcatcaggccagcttgctagctagccgccatgttcttggattaggttacctaattatgtatacagtacacgaatcttaattaaatcttaatcgtttgttatactgatgattcttcctaaacacgcaggagctactacaggtgcagttaccaccgggagcgcagatgccccgcgcagaagcacgtgcagcagcgcgacggcgacgacgtcccggcgctgcacgtcgtcgtctacacccacgagcacacgtgcctgcagggggcgcccgccgagcttcccgacgcggcgacgaacggtggcgccgccgccgccgcgtcgccggactacttccccgccggcggcgagacgccgtcgtcgctgcggcggctccggggcgtcggcggcggcggcctgcagcctcagttcgtggaccaccgcgccgccatggaggagcgcgagcgccaggtgctcgtctcgtccctcgcccgcgtgctgcaggggcggcagtgctacgacgacgacgacgacgacgacaccgacgtcgcctccctcggcgccgtgcacgcgcgcgcgcctgcggcggcggcgccggtcgccgcgtcgtcgtcgtcgtccgggcccgtcgacgctgccggcgaggagctggacgtcatggactacgacatgacggacgcgctgttctgggggcctttcggcacggacagcaactcgtacgacggaaacctgacgtcgacacgctgttttgatctaattaattaatcaggcgcgcatcgatcctacatgtggttcggtcgatacatatgacgagtcgcggtgcgcatgtccacggctatcggtaggccgttggattcggatatactactactactactactactacattttgcatgaatcgtatactacgtacaagcgtactactactaatttgcattacgtatgtaccttgtgtgttgtaaaattaaatcaaccctgtgttgtgcaactattatgattgcactaggttatatgggttgcgtagttgattaagtttggtccggtcggttggagtggtttttgtatgcacacgtaccaatatgctgtacgtctcactgtctcggtgattctcacaccaaataggcaaagtgcaaaattagcaaaggctgtgtttagatttaaagtttagatccaaactttagtccttttccatcacatcaatctatcatacacacacaacttttcagtcacatcatctccaatttcaaccaaaatccaaactttgtactgagctatacacaaccaaaatacacaatagtgttgtatgacgtgtggctttccctatttgtcaagcaaatagcaaatctgatatacagtattgactacttgtaccactactggtataaaagcgttctcttttctctaaagaaaaagtgatttggatccagacctgtttttcatcaaagtagacatgtgtctaatcaaaagtactactctgtatatgaatataaggccccctttgaatcaaaggaaaaaccataggaattctagaggattttatcctatgggaaataatcctacagagtcctttaaaacaaaggattgtttcctatcaattcctttgaaattcctatggaatgaaccttactagagcaattttggaggaaaataagcatgagatctcacctcatgttttcctcttcatgtgtctaaggttcctgcgtttttcctgtatgctaaccaaacgacagtttgaagactttcctgtgtttcaaaatcccataggaatccaataagcgtggtattcaattcctacgtttttcctattaatatgttttctcaatcttgcgattcaaagaggccctaagagattatgagcttttttttttgttaaatgatgatggatgagagaataaaatagtataaattatgatgggtgaggagggtaataaaccaataaacctttcctcctagaaaaaatcaatttcgattatgagcttctttttagaagttaacgaagtagtaaaaaaacaaagcatggtacaaataatgatggttgagagaataaaatacaaaatatgatgggcgagggtaatacacctactcccagaaaaaatgattttctttttttcataaatgcgtaaaagaattgtacgtcaatatattagaagaaagcaagagtttttattacacaacacaatcagccagacatgactatgcctgtggagggaaaaagaaaaagaaaaaaaggctgctgggcaaaagaaaagaactactattcaaacgctactccaataatgcgggaagttggtggtagagccacactacactgacaataaaccctccaaaagcagcagctcctgcagaagaccacagacgactttccagatggattgaccccataaccactaagatcgaggagagcgaaagatcaaacaccctagagttctgcttcttctataactgccaagagatcaagaagactaggagccggagcctgcacgaagatgctcgaataggcatatcctagaagacagccatcagatctaaagctaaaaaaatactctttttgaaaaaaaatgataaatgagaagtagtaaaaaagataataggtgaggagtaaagcacggggtgagtatggagtatggagtagcagtaagccagtaacacaagtacccatcaaaccagaggcgtcgccaagataggtcaacgggtcggattctaactacagattagtgcatcatgacatgatagcctgaagacagaatttcctttctctgatgatcgcgacgattgccacagtgaccctatcggtttgaccaccgcaaggaatttcgctgcgcggcacgcctgcagcaaaagatggtggatggccgaaacggggacgaaaggcgacacggacaggtgagatcaatgtgcgtgtgaacccacgcctcaatcacacgcccggatgcccggaatcccgtggtaattaagctcgattaattaataacaatactaacagtagactactactcgtagtacttggggtaagtactatgggcatccaagcacaaaccccaaaatgccacataggactaaatagtgaggtggaggagagaataaggaagagagagaaatagtcaactctcatgcaagaggcaacctctatacaaacttcaataaacatatgagagtgttagagatattggggattgtgtggtagagataacctattatacgtatcacctcttaatttaattatctatgtcatgcatgaaattggatgtggtagtcatctctactataaaacttgcccttattacgttctccctccgtaaaaaaaagacaaaccctgaattttcgtgtccaacgtttgactgtccgtcttatataaaattttttataattagtattttcattgttgttagatgataaaacataattaatattttatacgtgacttatctttttaatttttttataatttttttaaataagacggacgatcaacgaacgttggatacataaacctaatatttgttttttttttatggagggagtaacggctatcagcctatcagcaaaagaaactactggaaggcaatatatacacggcagatgcacggatctgattagccggccgggtagtacgtgatttgaccgtatttctggcctcttcggccccaccccgctctcgcgctagcagcctgccgcctgccggctgcgtggctggctgggctggctcgacggtgacatcacgacgcgggcgtcacgctgcgccgctgtgggcaacgtcacccgtgtgggcgtcgccccgagttccccacttg

SEQ ID NO: 3369 - DNA, 2933 bp, Oryza sativa
ggatcgtaccgcgcccaagtgagcagaggaggcgaggcttcgcgggccacgtgaagttgacggatgagaaggcgatgtacgttcctccgcttccgattccgcgcgcgcgcgcgcgctcgtgcaaagcattgggcatactgggcggcccggtgcttgactgaaatcgacgtactgtacgtcttttttggtactgtacgtgcggtgcttggctggctgcaaggcgatgtgtgcggtgcggccttggccgggcgtcctttctctttacggtaaagacggggagacgttggctgtgtttagtttctaaaaaaaagttgaaagtttaaaaaaaagttaattttttttaaaaagtttaaagtttatgtgtgtagaaaaattttagatgtgatggaaagttgaaagtttagggtagttgggggtgaactaaacacggccgctattgctacaaccacctccatcagctcgaggatgtgaaaacacacctgaataattgcatatgagcgatgatggtaaatgcgtatgctactacatggtggatgcatggatgtcaaaaaacgggggcgttttttgttctatgtgtttttggaaggccgaaagggtagatatgaatgctctgcggaaaaatgtacgggaagcaatatgatccgtcgccgcggcggccagccggccggcaagtcatccatcggctcatcgtcagacagtgatgagtgatggactgcgaggacggatggcacatcgccgtcgaacaactctacatcctgcgccgtggcgtttcttccatttgtgcttgggctttgatcttgaacggcgcggttcatacttcataccataccatgccgcaatggtcgccacgacaccgagaaaactgggccggcgcggagccgtcatatgtgtgcatgtgtggacgtcattcggactttctgagtttgtcctttggcttatcagtcagccatcaattgctacctccttacttatatatttttatatcaaacgtttgatcgtttgttttatttaaaaaatatttttttaaaaaaaatagtcacacataaatttttatttatgttttatttttatgttttattatcgaataacaataaaaatactaataataatttttttcaaataaaacgaacgatcaaatgctgaatataagtagtacaaaattagtatagttatttagcttacccgagccaagtcaaccaactgacccaaccaagccaattcattgttgtcaatgatagagcgtacacatccttagggtacccacaatggttatctataggctctctataagagatccatgtcagcatattttcctacttggaagagattaaatgaagagagagagagagagagtaaagctatctactaacctggagatagtctatagagaaaaaacgagacaatgtattagagagctatagatacccatatagacatactattgagatggtttactattaatttagtctattgttgagatgtacatgttttatagatagcaccttactttaccattgcgggtgctcttatttctgaaggcaatggaaacaagctagaaaccccaagggaaacaactaaataaattttaggataacttaactagttagatttcttatggtgcaatctaatctacttaaatttaagttttagacttaatacatatgctcatatttagaataattattctttcagcagtagacgacatacctgttgagagtaggacgtatcttgatttcgttagtctcaaaatatgcatgtccagttttcgaaggtactcatcgtgatagggtgaaagtgagagcacgcacatatataaacacctgatgtctgtagtgacttcgctatctcaaaatatatatgctggcctactttattgaggtgcatatagggattaggtgtgagcgtgtatgcattaataacagtggcagagtgcgcgcgtgtaaatgaggacttgtgtttttacggtattgaaaaaaaaacctcttgttagggttgtgtaactaaggaacagaaggtgattttctcaatgccaacctctatatatacagaggtgaactctagaaagggaagagactctctctcttttttttttcccacgttggttggttcaaccattttcccttagcttaagggtacacgtacctacttgttatttatgcaacaacaattggcaccgtctgtgggaaagatgtcaagaaatgttaggtatagatcagcgaagctcaaaggttgttatgttggacgaatgccgaaatgttcgacgaagcttaaaatatgacaaaaaccgatcgatatgatcgacaaagccgaaaatttccgacaaagaccggtataagatcgatgaagaccacatatggcctcgaaaacctattctctaaggcttcctccaatggtgccatgtaagctatctcataacatgtccacgtcatcatgtatcctatgtggaggaaagagaaggcaaaaaatcaatccatctatctcctattcccacgcctatctcgctcagttaccgatgccgtatgagcctgcgcaagagacaacagtcgactcttccacgccaaaatcagatcccgtgctcccttcccccaaattgccccgccgcacctcccgcccacccccgcacgctgcaccccgttcaagcccaatcccgcgcgctgcaattcgctcccccaccccctggcgcgccaatttgctctcctccgcgcaaatcctccagccacccgcgcgccaatctttcccttgcaccctccctcttttcttctccagtgtgtgaaatcttcctcgtcggcgtcgacgtatccgtttccacgagcccaacgacgaatccactcctcttgccaacgacgacgagctgtagagcaggatgagctgccggtccaaacgacaagtagctccgcggccgccgccgtcgtcgtcgccgccgccgccgccgt

SEQ ID NO: 3370 - DNA, 3971 bp, Oryza sativa
gctagatcaaggtcaaaagccaaacctgtcatcaacttagatgatggtgacaatgttaggactgctaagcgtcttacatgggcatcagatgaggacttgcggttggtgagtaaaattttagacaacttgcagggatttgtaccatcattctaaaactttactaatacataatgctaaatgtaggtgagtgcatggctgtaccactctaatgatccgatcaatggaaatggcaagaagaatgagagctaccggggagatgtagttgaattatacaacaacactacacctattaaccggaaaagggaagtaaagcatctcaaagatcaatggcaaaggattaagagatgggtgggatttttctgcgcctcctggaagaaggctgcattagtttatactagtggatattcagatgatcagttgagagactttgctaatcagttttatgtgaatgactatcctaacgaaggtccattcacagttttgcactattggaaggttcttcatgatgaacccaagtggcatgctgttttggaggagcttgaaaagccacacaagcggagcttggatgatggaagtgacacactatcacaaaaagatatcggagaaaaggagcgtccaatggggaggaatgaagctaagaaacaacgcaatggcaaaggcaaaggtaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactaatgagatgaaagctgagcacgtgatgggtctcaagatgttgagggagaaacttcttggcgatataatataaggtattttctgtcaatcaccatgcactttatttttagtcaatgttcaacaaatgaccatgtattgtaatatgtattcttagtcaatgtaccacaaataaccatgcattgtaatctgtattattagtcaatgtaccacaaataaccatgcattgtaatatgtattcttaatcaatgtaccacaaataaccatacattgtaatctgtattcttagttaatgcaccacaaataaccataaattataatttgtattcttagtcaatataccacaaattaatctgtaccatgtgactatatattgctctgttatattcagcctagcaaaacaatccagcactgtcctcctctgttccttctatccagtactattcttcctattctattctgcctcatttgttccttccatctagtccaacactgcctcatctgttccttccatccagtaaaacatgtcggatgagtttgacaattccatagacccagccgagatttacactacagatatgttcatggcagagcatagtgtccttaactcttttgccgggcggatcgacaaaaggattaaggccagattggaaggaggtacatctaggcgtacaagtggtccaaggaagtacatcaataggaaccatgaaggagcccatgatcaactatttgctgattattttgctgaagatcctctctactctgctgcaacatttcgtagaaggttccggatgagaaggcatgtgttcctacacattgtggatgaactaggcaagtggtcttcctattttacacatagagtagattgtactggacgccttgggcactcaccattgcagaagtgcactgcagcgatccgtatgcttgcatatgggactgctgctgacgctcttgatgagtacttgaaggttccccagagtactgctctagagtgcttagaaaattttgtggaaggtgtcgtcgaggtatttagtagtaggtacctgcgtcgccccacggctgaggatctcgagcgtttgctccaagttggagagtctcgtggattccctgggatgttgggaagcattgactgcatgcactggcgatggaaaaattgcccaaacgcatggaagggacaatatacccgaggtgaccaaaagtatccaactattatccttgaggctatagcttcatatgaccttcatatttggcatgcattctttggtattcctgggtccaacaatgacattaatgtgctcaatcagtcccctctgtttattgaagcaataaaaggtgaagctccccaaatccaatttgctgtcaatgggacataatacaacacgggatattatcttgctgatggaatttatccggaatgggcaacctttgtaaagtctataagatctcctcaactagagaagcacaagctgtttgcaagggaacaagaagggaaacagaaagatattgagtgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttatatccgagccaaaccaatccatagtcagcttaaaaatgacttaattgagtatatttggcaacggtttcaaactaggcaaaataattagtcactgttatttcagtataatgtaagctctagtgtacaatttcattgtaattttatcttagactgactgtatttatcactttcacttactgtacatgtttttctctctaccggggcgaacagattcgatgtcttttacttgtttttgtggctgcggtccagcttttggtgatcttgttcaaggaatgggataagcacttatggttgctgtccagcttttggtgtttgtcgaactcttctatcacttctgtgacgtgatgcagtcttttttttcccttcagtttgctcttttccgcattgtactaaagtgccatgatatggctatgatgttatctggttgctgtagtggaccgtgagttggaagaattgcacttcattgttatatactctaagtcgatgttgtgctatttatctatattcacactatgctgagatgttcatttttaatcgacagatcttttgaatagcatcacatgaaggaccatagagatattgtgtagtttatcaccatgtcatttactacccatgctgccataaaagcaagaagagataaccttagagacagttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcc

SEQ ID NO: 3371 - DNA, 15653 bp, Oryza sativa
aggtaggaggaggagctgacgggtgggaccgccggtcccacctgtcggcgaagggagagaaggagggacgcaaaacagacttttgcgagcgggccaagtgagaggggagccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaagtattcccggccaatgatttttaagggaaaattttaattctcccattatttcacttgattaaattgatttaacttttatttaatttctagaaaatgtattattaattgatttttaaacccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaactcaaatgacaagtaattccaggaaacctgcttgacctgtcttttgtctgaactgcaaccgtccctgatgctgcttctcaaagctgaactattgacctggcctcaccggtgtacctcagaattcaatcagataacttgagatcggtgtaactctgctgacaccttgcaactggcttcttcaagtactacccggattgttgcactgggttgaaccttcaactaaaacagcgatgaggtgagccaaaactcatctccgagacctatccaccttacagggagtagtcttactttcgcctgactgggaacaattagactattgtccttgaaaaataaccaacacttctcttgcttacaaggaccctcactttgaaaactgaaacttcaccgattcatcaaaatagagcaatgacgacgcactttcatcccagcaagatttggaacttaatcctcagttgctgatgggagattccacataaagaaattctcgtttagctcctgattggtacaactttcttgcttctgacttgatttttggtgtcataagcctaaacagattgcatagttaacattccttgaaacaagcactgatcacccaacagatccaactcaagaggtcctttccatggcatgacatttcacttctttgaccatcctttgctaactcttcctgggttaacagactatagatcctgtaatagcttttcgaaaaatactgcaatctgatcaactatcggaaactgactttgatgctgccgagagtttctgcactttgatcataacaacttcgctttcatatgttcggtaaagatggtttgttgaaaagagattctatgccatataccttgttgactacacatttctatttctggaccaaactctcgtatcttcctgactcatgtatggaacaatttctttttcaacttctgggaaacattgagagttttttttttctggaacttatagcggttgccttgaactatggaaaccattcttgtttcataatcacaccactagggtgtaattgccgcttaccattctctaacagtttccaaggatagagattccttgtatgatgttacttccgaatatatatttttttttccgttactccttacacttgaatacccttggtactgcctttggagagatttcatagtgtcgagcaccatggatccaaccattgtcactttcaaatattccatcactcttttcatttgagtaccactgatgctgcctttagaaagacctcatcatgtcgaggtgttgagggtctaaccattttcactccgttggttaaccattcctctattggctcgcaaacaggttttggagctcaacagaattgcgatgagttagaagagaaactcttggtttcttgagacaccgacagatacacattttgatttacttttgcatgctgaagatgaatcttaaaaggagaggaactggctgactcatattttattcaatatttccttttcattacatggctgccataaacatatacgtacaatgagaagtactacaaaatcaaacaattgtagactgctgctgattagaactgcccttttcacgactgaacttgaaaaatagaagtcttgtctagaattgctattgcttccattattcaaacctgactgacttgttcctttagttcctactaccagaagtctcaccgggaacgttgctctgcttgttgatcttcgatggtggaggggcaactgtcttgtcagctgtaacgggtaggatcttcttgcccgtggggttaccgagcggtgatttgtcgatgggcctccagattggagcaataccaggtgcattgctagaactgacaacagttggacgacctggtgctgacaacacttgccgcgggtgctgacgaaggagcgtaccacctctttgtagctgtagcgagctgttgttctcctggcattgcttaccctgctggcgttggtgctgtaggcttgaaacggttgccggtggaacaatgcgacctttgacggtgcccttgacgataatccgttgaggcggaggttgcacattcaggtgtcgattggtgtcatgggcaatgctggtaacttgtgaatcacgacgaactgcctttgctgctcttggaagaggacaatcactgaaacgatgtcctggcttacgacagttacggcagaatcgacttgcttggtcccgaggtgcaggcttctgattatgcactttggcagctgaaacgggaacaagcagagacttatgaacatccttggtgacgttgcttcttccatggttggcttccactggagctggagttggaggaagagcagaaggattgtgaccgctgttgtcgattgtcattggttgacgaatgggttgcacggttgtcccttgttctttcttggtcttagctatgaccgcgttcaactgacagtccttaggcacatgatctgttccttcacacaagaaacatgttaccttccttaaagggcatgcatctgagtaatgggtatattcaccacagcggcaggtggggaggcataaactagcagtgtgtccgactatcccacatctagcacatgctttgaactccaatcctctttccatgaaactgttaagggtcgtatcatcatcgtcatcagtatcatcatcatcgtcatcagcagcaaaccgctctcctgattcatcatcttcgggtctgggcggaccgtactttatgagatgtcgggttagctggcgtgctccacggaaggtatttcttcctctctgacgcttgggtatccttgctgcgtcttcaggagtaaattctgaactggtgatgatcatggtcctgccattatccatcttccatatcaccttcctgttcgctccaaagttgtgctgcagagtaccatctttcttgttagtagactgacttggagcttggttacttcctgggcactgcttctcgtccttttcaggtgacctggcgaacaccttccatggacagttccttatataatgaccttgctcaccacaatcataacaggtagcacttactttcctttggtctgacattgacttggctgtcgttatcttcggggatctggaccgcattttgacaggggtcttcggtgccgatattgggaactcctgactctgactcggattcgggtcccgggctggcatctgatctcgcacctgtggtgggtgacattgacgtgactcctgacattgtcgttgcatctgttgcatctggtatatttggtatcgacgtcgcatctgttgtaacaactcttccactgtctgagtttgattagccatgacttggggttgaggctgatcttcaagaggctgacgtggaatattattagaattgcactgagttgccccatgaaactgacggggtcttgatccggcgaaattgtccctcttgcagaccatctgctgcaggcaccagagagagggggaaacgggaggggttactagagatgaggtactaaaccacttgcctattgatctgttgtgaatggattttatgattcaagttgtttaagcaaacaacctagtatggtcgcatccccaccaatgacgcaaaccatacccctacacacaagcaaacaacacacgatctagaagctaacgaaactactcttctgggacagattgggtttaggtcaacttcgggaaaactcttcatgatcttcgcggaacgacgactctgaactgatcttctcgctccttgcacgaagcttgaggctcgacttggcttgacttccgaacagacatgaagctgacggctggtcatctaggtgtgacaactaaaagaattggagagactgggaggagaattttgaaaaaccgtttcgcaaagaaaagccgaagggcgaggggagacattttgcaaatagggttttcagaaagcttgtccttagggtttgcccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaaggggcgagctatacttcagatcaagcagttacccactcccgcttgtggcaagcgctgtaagtcttccagggtttcccgtgaaccggtccttaattgccatgggtgcgactcacaaaaccacgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttattacccagggttgacaaaggatagataccaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccaaaacgacggattctacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattatcatttatttttacaaaggaaatggacctcgctgacgtcatcaagggggaggggcggcgccggcaagcgggccccaccagtcagcggcacatgggcgccggtccaccgtggaccgggaccaccgaggctgtccaccgccggtccacgggaaccgacggctcggatcggcacaaagccgatcggacggtcacgaggcggcgcggctggggcacgggcacggcatgagaccggctcggccgagccaaggcgcggcggcggcatgcggccaccggcggcagcagccggcgacgaggaacggcggcgggcggcgggcggccggaggacagcggcgcgcacggggacggcgacgcaccccaagaggcggaggtcggcaagaaaggggaacgggaaaaaaaggaagggaggagaggtcctcaccgaaagcggcggccggcgcggaggaagatgacggcgacgacgattgcccgatggcggcttgcgaggacggagggcggacggggtcgcccttgaccttcagaaagagaagagggagttagggaggggaggaccgatgcggggtgaccggtaacgacggccgaccgcgacgatgtgagaaggatctcaccgatgaccgaggaaggaggagctccggcggattttcggcgaagaggggcggcggccgaggttctcctcgtccttgcgaagctgagggaggcaatggcgcgggtcggcgtcgaccgaagcggcggcgcgacgcggctggagtcggcagcaagcggcggagagaggttacacggtggggaggtggttccgatggcggttgaaggaaaccgagtggcgaccggcgtgcggcgcgggatggcgaagctggcggtggcggcggctcggcgcggcaacggctgtggcggcgggaaacggcgactggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtgaacggcaatggcggttggggtcggccggcgagaggtaggaggaggagctgacgggtgggaccgccggttccacctgtcggcgaagggagagaaggagggacgcaaaacagacttttgcgagcgggccaagtgagaggggagccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaaatattcccggccaatgatttttaagggaaaattttaattctcccattatttcacttgattaaattgatttaacttttatttaatttctagaaaatgtattattaattgatttttaaacccgaacgaaaatcggagcgttacaacaattcattagagaaactatctcttgttctatctcttagatgatgtgtacgatttatgagctagcagttgtcttcaaaggacctttgaaggaggcctaacatggggaagactagggagtagtcttgtctagtcagtgacaatccgataatatcaaatgcgtaacaacagcatgccgcatgcgtggctgtctacatccccgggccgccggccgcaccacagcgtttcatctgtgcggtgtttgggcttcgatcttgaatactagcggcataccatgcctcaatggaacgaatcacgctgcctatatgtcccatccaattaaaagttgctatattttaatatggagggagtagaatggaggaagtgtcaagtgtcaaccagcttttcaaactaatcggggtagtcgttttcgttgaggactagcacaaacaactagagtggaaaataacggcgcatgagacaagctattactgggccgttttcgagaaaggctgctgatacttgtgctcaaatcggcccatcaggaatagtgcgtttggccgatgatgattcgacagttcttaaaaataaggaagatgatgtgagactttttttttaaccaataaagatgatgtgagtgagacagttgccagttgccacggatgaagcttgggattgggagtttccgaatttggtatcaataccgagctcacatacgtacgtggcgagggaccacagtgttgatacatacgtgcagtcattgctagtgctaacacaactcgcgatccacgagtcaacacacccatacatgcacgaactcaaccacaatcccatacatgcacgaactcaaccacaatgattaaatttcctagctaattaagccagacagctactgtgacgaccggctgcctgctcgtcctggtacgtacgttcacgtccaaccggtcggcctgatgtcacagtccagtacagatgtcggcctgatggaacgtcctctcgtacaatgcaacacaattgcaaatgtacagtgttgcattgcacgagagttcgttccatgcactggtaattcttaaatttgtaccatatatgcgtacgatcaatcgatcgatcctctcatcgacgacgtcccagcagtctcccatgcactcgtgtcgcgcgtgtaccgcggccacaccgtgtcggcgatccgcgccgcgacgatgcgctggacgtcgccgtcgtcaccgatcaacacacggtgatccgctgctgctgccgccccgaacgttgactgatcgtactggccgaaacagtagtccatgtcggccatctgcgccgccgccgcctcgtccgccacgctctcgtccgcggcgctcggcgagtgtcccgccgcggacgccacgaacgccgcctctggggccgatgtcggccagatcaacggcggcggagcggctgcggcgcctcctccgctgatgaccgccgcgaggcacgtgacgatggcggcctcctcttcggcggcgctgccgccgccgccgacggcgtggggtaaaagaagacggctaaagaggccggcgccgttcatcgtcaggtccaacatttccgccggcggggaggaggacgactgtcgttgccggctcgtcgtcgtcggcgagctacctgcagtgttgggcgtgccgggaacagcttgcggctgctggcacgtgtgctcgttgaggtaggtgacaaggaacatgggcggctcgccggcgtcccgctgctgcacttgcttcttcgccgcgcaactccgctcgcggctgaacgtgcacttgaagtacaacctgcatgcgttaggtgacacgacgggatgagagtcctctatcataaatgttattatcaggatgtggattttcatctctcgaggaatattacctcgttgtctgcatgtcatctaaatagttatcaaatttttttaaaaaaaatagtaaatatattaatacgaaatatatcactccacaaacatataaaatcaaatttaacctatacatgttgcaacaaaaataacaagttagactaaaaatagttattgcacattcgcaactatattttttttatctttgttacaacttataacagttgaatttaaacttgcatgtttgtgaagtgatatattttatattaatctatgctgctatttttttatattttttatgaccatttaggtgacatgcactaaatgaggggttatcccttcaagggatgaaatcactttttcttattattttacacacatgtgtaatatcattgttacagaggacgtgaaccggcacgacgaagcataggtcaagttaaagaattaattcaagtgatttgttttggcaagtgtatggctaaaacatgccgcctaagtttttgtctagactttgaattatttgatcgaggagtacgtgtgtatgtacgtgtatgacgattgacgacgaaggttaaggttgaccatgttgacggcaaagtcaagtcactggactggacattgatatgctgcatgcatggatgcatttctgtaatattgaacttccagaaagcatgttctgatctgatgctagctatcaactgactcagtctgtagtccaatggactaaaacagctaggttaattactctgaaattgacttggacattgtgtgtgttgcagtgtatattggttaatgcttaccaaatctggaggttgacataacagttcttggtagtactttaggaatcatgtggtttaagttgtggttagttaaaattggtaaagtaccatgcatattctagcgaaacaagtagaaagtagaaactacactctacccaccttagataattgctgtcctgaatgttcttttgcccgtattttctccactggtagccatccttgtacggggaaggtgtaataatctccgtcctcgtaaccacctcttctctgccatttctgacaagaacctcttcactcctacagtagtattccatatatatcaatttgtcatcaacaaaagcaattatcgattcagaacatattgtaaacatcgataagaactcttctgtttacctaacgcgtttaaccctcgccggagtgtgcaagcaaatgctatcgtcagtcctcgtctccggcgccgtcctggtcactccttccggtcgtctgctgctgttgctgcaaggcttcagcatgtagagagacaccatgaacactcgcccgagctctctgctaacatcgacggcctccttctggccgcggctatcgagggggccttcgagcagcgcctggagcttggcgctgaggcggcggccgccggcgagctcccggtacagctgctctatggtatcttgaccaaatgccatcttaatttgagctgaaacttgaggcaccctagctagagcttttgacaaagtgagaaactgagaatcctttcaatttgcaacgcagaggagttgagcttgagtagctgcagtaggcagctttgaagctagctgctactccagtatttatagacaggccgacagtctgcatgcagtggtcatcagccttgcaattgtcagttttcttcagggatgctccaccagtttcagcatatataatttgggtctgactagctcaaaccctgttcattaattaatgttgatcattgatgtcaacggctgggcgattgatttattctggtcttctgaccgatggatcaatcgatagattatcttagatgggttgactggttaggctaagcttgtgctctctctcacggtacatacatattgaactggaaatttcggtctcttcatctggacgtcagttaagtatagttgacatatgaaatggtagtagtaatataaactacaatcctgtttattttattagtctactttgagcttgcaataaagtatgtggcgagcgatgcaatttttttcaaacgctcgtgtcagttgattttccaacttcactcccagaagagacgtcggacagtgactcccctgtgccataaaaactggacagcaacattgcgatgtcgaatgcatagtagaattcatagaaaaacaaggagtaggtccaaaggagaccggccttaattatgtgcctcaaaatctacagaaacatggtacatgtcaagtgatgtccatgtgcctatgaggatgtgtttagttcacgtcaaaattgaaagtttgattgaaattggaacgatgtgatggaaaagttaaaagtttgtatatgtagaaaagttttgatgtgatgtaaaagttgaaagttcaaagaaaaagttggacactaaaccatacctgaattctgaacatacagaaggtcaagtgatgctcagaaggagttaatttttcaccaacttgccgatcgatcgtctgatggtcaaggagagtgatctgtgcccttgaattgtagacctggagtcaactacagtgcctcaatttagaaatagtagagataatttaattcaatctccactcgcaattagaaacttctaacgactcgatctcaactgatctaagctcaaaggttaaatctgactgatctagcttctaaagttatatatgtgagatgctcctaatcgtacctaccagagtcaatgtccagttattttctttagcacaagtcaatgccccaatcataagacagaactgtgtcctagtttgctactatgattacgattccttgttttaagtatgtacgatccgtgtacatactccctccgtcctaaaaaaaaaagataaaccctgattttcatgtccaacatttgactgtcagtcttatttaaaaaaattatgaaaaaaattaaaaagacaagtcacgcataaaatatttatcatgttttatcatctaacaacaataaaaatacgaattataaaaaaaatttatataagacgaacagtcaaaattggacacggaaacccagggtttgccttttttttttggacggagggagtacaatacattattgattttggctgcagtagctcaagattcaagagtcaagatcatatggtgtagtgacctctaataagatagcctttttttttctttacgagacccacaccaatcaaaggactggtcctaccctaacatatttgggtgtattccggagagaacgttaagaacttctcccctcacacataaaactaggtgacttacatgattaactaagtattagcttaaatacttgaaaatggaatgatatgaatttttaaagcaacttttcaatagtttttatttttgcaaaaccatatcgtttagcactccggaaagcgtgagaacatgtagtataacacacccttaaaatatcaaatttgttcatccgctttcggagtgacttgctaagggcatgtacaaggtgagagagcatagcactagtttctttttaactcgtcgccgcataagggggtgctaagtgtctacagtggtggggaccgactgaaagtgaagtgtggcctgtaataagtgccaagtaaatatacaatgataagaaatcagaaaacaattttctctgaatgccaaatatatatttttaaacgaactataccaaacaatgagagttttatattaatataataggaaaaaagaatacaacactactatagcactagaataatcaggaaaacaaaaacaaaaaccaccactatactatacgctgacagcacctacacatcctgaagacctagcacataccgcaccaactgccgctaagtaggatcgagcaccgcggaaccaagacaaggaaccaccacttaactaccgaccaacacacctccaaccagttaaaacaactagaccatctggacaaagcgataaggactacagaaggaaagcgcaatagagaagaaagactcactcgtccctcgtacacacccgtcgccgtccaaaatgttggtagggtcctgccatcgtcaacctccacaagccacggtccctcgtaagggccttcatccctccaccaaacagctgaactcctcctgggggagcgagcaataaccacaaaagctgccacacttggtgactgatgtagccatattccttcatgtccctatagcactagtagaaccctaagatgcgccaccaccctccagccagtgatctccttctaccacgcacacgtcgtggtcatcgctgcattgcactggtatattgcacgatgtgctccccggtcttgtgcacgttgtcttgtgctgctaatgtgcacaagacatttaaatgggtgttgttgctttccaacttcagcagcaacccctgagatgggaccccaagtgcacatcagcggcataagaggggaaacaattttggagcttaggaaatgggcatagccccatttagcttccggtcttaaaatggggactatttattgaagatgctataaaggagacaaaaaaaataaatcatgagcacttcatttcctttttcagcacggggagcgtaagcaccttttgtcattttggatctaaacactagggtggaaaaatggcaactttgtatttggcatttggcagtctggactagcaaatttcgccaaaaagtgcatagggacacggaccacccctcacggacgcgcaatacccccactcgctctctctctcttccgtcgcaccctctctctctctcgcccccaaaaaaatccccatccgcttgctccgcctcctccgccgatctcccccgcggctccgcctctttctcccttgctccgcctcctccttcgccgatctcccccgccgcaggcgctcacgcccgctccgcctcagccgtcgctcacgctcgcttccgactcccttgctccgccgttgatttcgcccgccgcaccaggtcacggcagcctcgacctctgccgatctcccccgccgcaccagtccggggtggagatggacggcgacggatacggcgatggctccggcacaagggacttcatgtcgcagtccgattcacacgccgaccacgacgagctcgacccctacaccgactccctgtactacactggatcccgcagcggcagtgcctccaggataggcatggccgccctcgacctcaactccggcggggatgggtggccggatttggggagctacgagggtcttctttgatccggctcgcaaggaggcgtcatcagcggaggagggggccacctttggggcggcgcacatggacgcggcgtcggcggatctgggagccaccatcgctccgcctcgcaaggaggcggctctgctgatctccctcccgtgcgtgctgtgagtcggacactgggcttacgctcggcccgccctgctccatgtggccgaggcgccacggcagctcgcgccaattcctcaccgtatggaggtggccgttcggcgcccgcggccggagccaggggccgtggtggtggtcgaggcacgcaggcgaccggagccaggggccgtggtggtcgtcgatccacatccacggctgccaccgtctctgaagtcaacttggacgtcgactccgacaacgtcgaagatgccgccgagctccaaaaattttccaaaatcatgggaaggtatgccgaccaac

SEQ ID NO: 3372 - DNA, 24071 bp, Oryza sativa
attcaaaagtttatataggtgtgatatgtttatgtcttgcactctgattcctgtgatccagaagctatgttgcattgtggtttatgtctcctggactgtgatatgtttaggtttaatatacttgtgctttgtgatttgctctattaagttgtcataactgaagatgtatttgtttcccttaaatcgtgttaaatattttttgcttaccgttatgggtgggtttaggttaaacctgacagggccaattggacagaggacaataccagcttgctgtgtgaaatttgggttgaccagatcaataagggaaactgcgtgaatggactcatgcagaagactgggatgagggagattatcgctgcttatcatgcagcaaccaacctgcggcatggtagatcccaaattactaataggattaggcaactgaagggattgtggcaattcattcaaaccctacgcacaaacactggattcaatagaatatgactactgtagtgttgtaatatttgtgttgtatggacttttaaaattgtgcactgggacttttaatatgtatgtggacattttaatgtttctatgctatggacttttaataattatttggacatttttttgttgatatgctacgtacaattttgcgagctattgatacatttgaactatctggaaatggtcatttgggaactgttgatacatctgtgcactgtcaaattgtggcttgtaccagtaagagatgaatctcttgttttcaacttagcagcagcagcatcatcatttgcactaccctcacggccgcagcgcgcatcagcaatagcggcagcaacgacaagcagcagcagcggcaagcaacaagcagtacaagcatgagagagagagagagctacatgttttgtggggggggggggggggggaagcaattaatatgggcaaatatgtctttatggaagaatggtaaaacttttgtatgcctctaaacaccaacttgcaaaaatgcaatgccaaaacttttgctaccaaaactttgccatttgccatttgctattccaaatgcctctaaacatggccttaattattccctgctcaattagtgagcaagtaaccattacgtctcccgcaaagaattaatatgtattccccgtactactcaattcctgatcaaataatggtcacggttaattttaaggtcgtgaccgtacgtgaatttgcactcggtccgttacatcagtaattatcatcaccaccattacagtcatcagggagataaacatggttaccaaggtgcccgtggtcatagtccaaaccatacctgagcgcgtcccacgtcgagaacaggtcgcctccgtcgttcatcgtcgtcgtgagcggcggcgccgccaacgcctcggctgccgtgaacgacgacggcgacgcggccgcggccgtggccggcagctggccgtcgggagggaacgcgtgcggctgctcgtgcagctgatggctgctactagaatcgaagctcagcatcatgaatggccttcttctcgctgtattttgctgctgtcgttctcgctcggtctgctgctgatgagcgccgccgccgccgccgccagcggaggagccgaacctgaggaggtacgcgtcgccggcggcgcccggcggcggctgctcggccacgacgtcgggggtcgggacgggcgtggtgttgcaggtgtgctcgtacgtgtaggtgaccctgtacagtggcgggtcgtcgtcgttctcctgctgcaccagcttggaggcaaggcactgtctgtcctcacggtaagagcatctgtaatataacctgcgattccatttacagtacagatgcataagatttaaatgcatcttaagattaggatctcgccgcgcggttttaccacaaattaggttgattttgaactctgaacttttttaagtactagtacagttactattgttaatagtttgttgtagccaagtagcctactgctgaccatgcataatatttcaatggaaatcccaatatgcaagaaataaattgactaaaagctacttttagatgggattgctacattcacaacacacatatttttttcccaaaaacttttgtatgagaacttttagaaaaacgtctaccaggaaaacattcatccagaaagcttttattttgaaactttcatcaagaaaactttcatatgaaaactatcatctgaaaatgtgtgtgctaaattaaccataactttgctagatagtaatttcgagtttttgttgtttgactcctggtagcttaatattcccatctgtcaattttactcttcacttttttatagtaattcacagcaaatgaaacattctaaaatattataacaatttatttctataatatattctcatagtaaacaataaaagaacaacctagatgattgaaaccaacaagagcacatattatatcatttcttaatatgtcatttctcaatatgaacagaatgcatgacttaaaactttttacagctgatagtcaacagataaataatttaggttctatttagataatgactaatttaattacctagggaaagcagagtccttgatgttcttctggccatacttcctccacaaatgaccatcaaaatgaggtgtgaacgtatgtttcaccaatgatggtctatccttcctgcagcaatactccgtgtatacagttcaaatagaaaaagttagcaagtaattttacaatgttatgaaaataataaaacctgctatattaattaggatacatcaaaagtgacaatatatacttcctcggatcataaatatttatttcatgcaattgatttgcccataaaatttaaccattcatcttattcagaattttagtacaaatatataaaaatatatgttacgtttaaagtaactttaataataaaacaagtcacaagaaaataaaatataatatatattttttaaataagacaaatgattaatgtcaaatgtgtcaaatatttatgatcggaggaggtaatatagaaaaaaatgttccaatatacatgaataatatgcaaagaatcgcacatgactgataatatacaagaaaaagatacctcgagtacagaaatagttctacaggactaaattaataatgaacgatcgatgtttacatgaagttaaaaacaagcaccattacatatataattgctggcctaattaattatgtggccagatattgcaacatgcacgcttatatatatttgaaaaacataaccttgtcagttagttgttgtacaacactaatgactacttgcaaacaaagtcgcattataagtacaacatataacaaattaattatgtgtactatatatgtatatatatgtatgtagtatccagggtgtatttaccacgtactatatctgaacttagcgagattgaagtactgtgttagttgtttcgtgttagcatggcctctatatcaaaatcgactcagtgcaatcttatgacgcaacggtagtactaccaccgtttcacaatgtaagtcattctagcatttcccgcattcatattgatgttaatgaatttagatagatatatatgtctagattcattaacattaatatgaatgcatttcccgtattcatattgatgttaatgaatctagatagatatatatgtctagattcattaacattaatatgaatgttggaaatgctaaaatgacttacgttgtgaaacgaatggagtaagttcgaagcttagtcttttagtttttttttctcttgtttcttagttatgagatttaaaatttaagtattctttatcctttaagtactgtgtatatccccgattttttatccattgttaaaaagaagcatgcatatgggtgagttggatggcctccatcagagtaggacatgtacacgagacatgcatgttgaagggggcctagctagtagtagttgcttgatctccgttatttgcatgcatgcttatgtcaatgtctgggtcattagcttatttaaagggaaatggatctgaatctgttgataagttggtaaattaaatacgtaccccttctaaatgggttaccacctcccccgaacgcatgccatatgagacatgaagaatctagaataattaaagattcttttttcatcagacagattcagaaatgcttctctagcttttcatgtgatccatagtactgtggatctatggaaactagctggaatgtgagtatatatattagtggtgcccactttttattgacatgttgagaatagtggatgagccaggaccacaaaaataatctaataagaaggggcgcaaagcagtgctaattaacactgttcttaacattcctaacagtacacaaatttatatgattttaagatagaataatttcagccaaattcatgacttgtataataatggagcctagacacgaccgaggaacaatgaaatacatgctctcccaacctttttatcaacagttaagttgatattcgaacttgaatttgtttggacaataggttaattagctagatcagctgaaaatacacttatatatgcatggtagttttactgacgctctcgattcttttataaggatgaaaggcaacggtttcaagtgtactgtcaaaacgttcaaataatggggtataacttgtgaaaaatagcgactaatcttttgatgttgtcctttagaaatttttggtcggttttactatgcaatggcatggctatatatatcaccctttctttctttattttaatctcaacaaattcatcacattgatcttgatattgcatgttgcaagcatcattttttttgtgggagttgctacaataagctgggcggtttgttgtttgaatagaaattttgtgatccttaatatggaagcaaattaattaattcattatttcttacttacatatgattttcaaggcaacatatatatactaggcaaaatataggttgcaactgcttagaaattaaaagagaggggccgagagctgaggaactgcttagaaggtaatcatgcttttcccctacatattcatgtgttggcgaaaggtggtcatggtgtagccatgtagtgatcttggaattgcagctatggagttgtttgcaggttcgtcggatggaattttagaaaaaagaattgtagcttggtgttaagtttggtgtttgagaatctgaacttttgttaattatgtttaatgcttcctcgtgtgagggctagagtctagaactcgtttttattttgttgccgatgtacatccttctttgaaggatgtagagaccgggttgatatattcattaattatctgaaaatataagagtatggttcctgtgtgtgtgtgtgtgtatgctctgatcttctgacaaatgtcactgatatcttgctgtactaatatctagatttcaatctatatatcaagatcaaaatttaattgttggtgtgaatatatagtggctaaacactattcatgaatctttgtgaaataatgtgtgtgcaacgtacgcacttcagattgtcacatgcaaaaatattatgatcaatgaagcaatgccgtcagaaatgcccttttctcattcttaaaatgaaaaatggccagaattgaataagctctagtgttcacttacaaataggtgtagttcgagacaggattaatctgagtggatagagaaagagttaaacgtctcccgtaaataataaatggcttagtgttccacataactgatcaatatgtccttatctaatactatgagttaatttgatcaagtctacgcactagttcatacgtatgcgcttggtctctgaccgtgtacactcccccctggaagacttgtagtcaactcacactatgaagggtcctaattcccgattaataatgttcatgtccaaaaaagaaagaagtttaccagcataggaatatatatataaatgaaggatcaaaacattttgtttagaactaaggagtttcaatttgccattgcattaattgaggttgaggcttgaggacaacagaagaaaaactgtatcaaggatacataggtcaatagtaagaataagtcaaaacactaacacacaatactacacaagttgatcaggataacactgtatagttagggggatgggagtgtatgagaatgagaatcacaagtatgaataagttcatggatatatcttaaacttaactaggaaggagaaatggttagtggaactttatggatgctgcatgcatgaagtgatgaagatggactgccgacatgcatgtgcttgttactttcttgtttcctttaatttttacctcttttagaagaaaagtatatgcttgtgagtcataaaatactactaattgtggactattactgctaaggaaagaaacaaaggttggttcgatcagttggtaattcgatatatatatataacaaagaagattcgagacttctctatgtgcattctttgttttcttgttataagctagcatgcttaaaatgtgcaggaagagctccaatctagaactagtagtaaggtagggttctcaagcaattaatggagccctccactatggcaaagatgcatggacatatgttaagaaaatggaacaacatatgatcacttcgggttcctaagtgtcaaaaagaaatggtcttcattcaaaggaggagaatatgcatcttcttggtgaattatgaagaatgctgaaaatggctattagcatatatgtgatgtttgatgattttaatttattaatggcatgtccttttactgtagtgcagaatctcaatccaaacttgagcaaaacattatgccccccccccaaaaaaaaaaagcgtattaattttccgctttcacctcagctcatgaaatatagctagctcactcaaaagtaggacaactcaaaggaagaaattaagatcgatggaggaaagaaaaaccttgatagttggggtagtatgcatccatttaattggtttaatttttcaatctgtttgttttaatagtgcagacgagctagcgttatcaccctcaatcgtacaaggtttcgtcattctttttagtagtaattaaaccattaaattcaagttgcaatatagtacatactatctaccaaccccacatatagatcctaacattgcctgtttatgaccatgttaatgtttcttcctcctccttaatttccccaaaaatttccccatattggcataccacacagaagccagaaactataattcccattctccttaattttggcagactcaagaaacgaagaaaaagaaagggcaaacaggtacacacaactcaaatcagcaaagcgcagttaggatcagcggctccagaaattaatccattcaagacagcaagagaggtaaacaagaagtggttggagagaggcaaaatatatgaacgaatcgacgaaattaaacacgaagcaatcaaggagatacaggtactaattaacaaattaacatctgtgtgtgctagcttagctagctcgtgtagtatagtaccttctcttccggccgtcgcgcggcgaggactccggcggcgagatgccaaagacgccgccgcccccgggagggctgtacgacgccgacgcggatcccacggcttcctgcgcgctcgcctcctcgaagtcgaacgactgctccctcttcagccgcggcgacgccattgattcttcaggccagctctctctctctctctctctctctctctctctctcgtcagctagaacaagagctaatgccttgcaagctagctagaagctgcaggcaaggggagtgggaaatggaggaggcagctgcgtcgctttcgagctgctcgccggagactttaactttgggaggggagcagggctatgcctacgcttaattagccacggcgtgcggtacaagcacggtcaatagtttatggtttggttttgttgtcaagtcaagaggcgttgctgggtcttttgatatgtttaatgtttacagatatacattagattcgagaggatgaatctgctgccccctcaaacaattaatcatgtgccctattatatgggcctcaagcattggccccctcttgatgacttctttttccccttaaattaacttaatttcttggtcagtatgcaattaggttgtgtgtatgtatgtatacatatatgtacatatatatgtatatgtatatgtatatgtatatatatgtatatatacatatatatatgtatgtatatgtatgtacatatatgtatatgtgtatatatatgtatatgtgtatatatatatgtatatgtatatgtatatatatgtatatgtatatgtatatatatgtatatgtatatatatatatgtatatatatatatatatgtatatatatatatatatagcagatgctagctagcttgctctcaatgcatgcacaatttctcatatcgttttttttttagttttgaggatagtttctctagtactactatgagtgtattatatatgttttgcctcttgtttattgcgaccttggtgaggctcttgaactgacgtaagcgtccgggtgcgatgcgggcatgcttttttactggcaaattgcagcaacggacacaaacaatgggtggcagtggattagatgtatttgcaagttgggattacaatactggggaacgccatcgttagccaggatggtggaggctaccaatcccgagccactctcacgtttcggtgcagcctgcatgcagctaagcattttgctgcaaggtgctgaaagaaggctattttatcaggagaatttgtgaggaagacgattgtatatgatacatttatatcttgagggtttgctgatcttgtttaacacggtttagttgcattgccagcggaagtcactaccacagaacacctaataggtgccggttgggaatcccacaaaggtgccggatttcccaaccggcaccacgaaggcggcactgatgtgaagagaaacaggtgccggttcctaaaccggcacctttgtggttccacgagtaaaaaaaagccggctcgatgcatcgagcatgcaccttctccatccatagcaagaaaaaatcatcatccatccattccatatccatccacagcaagaacaaatcgttattcaattcaatccacaacacaaattacacgaactatttgcatgcatcagaggtaaagcaaaagaaaaaaaaaaacaaatcaagcacagcgcctcgcctgatccgaccacccccgagcaccggtgggagtggcggcgccggatccagccaccctcgagcgccggtggccggtgggaagcaccgaatctggaggagggcggcctgccccacgtcgtcatcgccccccagcttggatgtttcggtgaccgccgccgctaggtagcacgcgtcggcctccccttccctcggatctgatggaggggagggtgctgccgccgtgaggaggtgctgccgaggggaggtgagggcgtgcccacaggagaagactccgccgccgccgccaactcaggaaaggaggaggaggaggaggaagggaggagaggaggatggcggagaggggaggaggagggggacgatggaaagtggaggagagggagtcgacggagagggtgcgagagagagagagagaggtatgggagagaagagagacgagtggaggagaggataagggtcacgcactcgcgcacaatcttatccgagaggtcggcttgccagctcggctccgtttgatataggtgttaatttttaaataaaccgacacctataatattttatagtcggtttttaattaaccgatacctatagtgtattaaaggttcttatttttttgaaaaaccgacacctatagtatatataggtggcggttttattgtagaaccaacacatatattttggtaaaggtgttggtttttttattttcagtctatgggtggtggaaaaaacactataggtgccggttttagctgttccggcacctatagtgccgacttgtatgtgactttttgtattagtgatagtcttttctaacgaaatacaagtgtgagatctcatattgatataccaggaaaaaaacaagaccatagtattagctagaaggctatgatcgggaaaggaaacaaaaataacagtcacaccacacacctgcgacaaaattaattctttgagaaacaaacgtgagcacaacgccccaactacaccagactgtctccgtccatgcctttgggtttgagagggagagaacgagagacaagatggatccattctcccccacgcagacccgccaacataggcatcttgtggcagtcagaagcaccactgcaagataaacaaaagtctgaagaagagattggcttgggaatggtccttcgaaaacgagcctctaggaaggtcgcgacatcaagaacgttcccgtcgcccactccggtaaaccaggatgtggttttcacctgaaggaaaacaccatgcgagagcaaggagccacaacaatgcccccaagaggtttacggtgcccaaaagcgtcgccgctgtcgacctcgatttaggccagtatttcgcctataaacatcctttccttgcatgtcgttttatccttgttgattctgtcaactgccaccaaatgaacaccttcagcgcatggttatcgtattggcgccccaccgcgagccaacccttgggaggatctatgacccacccgttgtctaactctggcgagtctttgacaagtcggccaccaggacctcacccgcacatcatcggagcaaaagacccatgagctctactgctgccaacccacaccactgccccgtgccatcccaccgtctccacgtcaccaccatctcacgccagtcgtcgttgtgaggctggatccaccgggtacagtctcctcgtcaaccttcatcgcacgcgcctcgctccaactgtcttcgtcgcctccactgttgccttccctcttccctattgtcaggccgccaccctcccttgctggcatgtgcccgccgtcgtcgcctcgccggatccgagcagtggcggtctggatctaggtggcacagagccaccaccacttgagacgccctggtgtcccactcacgccagccagcgtcttcgggtttctgatcgacggccgctggaggctggacgctagaggccgccggaccgagcgggcgcaccacggtagatctgatcgacggctagttaattactggtgtggcgtgcgtgcacgctccattcggtagtgatcagcggagaaaccgagtgagagagttgcgcgcgcgcggtggaaatcaatcaacgtcgtacgccaccggtgcgccgtgcagatgtagtagtagctagcccagcgtacgtactatataccagccacatacgtcgcacgacacggcaggaagcgcgcccgtgggccaggtgcggtgcctggggaatttagggggttaattggaggagcctacgcgtcgggcgcccgattggagaggggaaaaatcgggcgctaacatcagcatgacatatgcgtgcaaaaccactttaaactattttttctcttaaattatttatccaaatcatgatccgattgcatcattaaattcattgcaattaatctttaaaacaagaccacacatggatatattccgatgaattttttttagcttattcttgaattatttttaaatgttgcacaatgttttaacaagtataccggaattgtttcactaagtagatcgaaaatgtttcaatcgtttaaatcgggtgttatttcgccttatatcaaaacaatgtttcagcaaatagcgaaatgatatttcggttcactgcaacatttgatccatacatagtgaaacattataagtacactaggtgaaacatttttggtggaacaaaaaataaaacgaattcccttaatagagggtttccaaaatatgtggatgatttgttgcaaaaaaatgtttcaattcattgcaacattagatctatacatagtgaaacattgtgagtacactaggtaaaatatttttgatggaacaaataatgaaacggattttctttatagagggtttctaaaatatgtggatgatttgttgcataagaatgtttcaattcactgcaacattagatctatacatagtgaaacattatgagtacactagatgaaacattttttgtagaacaaggggagggatatgtgggtgggcccgggggtgcacgcgtgggagggaggggaagcgaccgattttctccctccccccagttgaccgattctaagcattatcggggttaattagttagggatgatcgatgcgggcatggcgcagccggggttggccgtgtacataccacggccgatgcatcacaggcgtacggacttttttgaggatttaattggtctctctggcagagttgcatggtggtgcgcggctatggtatcgatcgatcaatgatcaatctatatccccgattgacaggacacgatcacacgattggtcggaacgtacgtggctagctgttttagtttagtgtcctaccaaattaccaataatatactacctttgtattttaatatataacgttgtcgacgttcgatgtcgcgattccggtatttgcatagtatggggatcgttggtactagaatatacgcgagactgaggtaaaagagatgagacagtgatttttatacaggttcggacccctgaattgtcaggtaataaccctacatcctgttggctgaagccggtattgctcttattcaccataatcacaccagtacaatatttggggtagcctatctaactgttgtcgatatggcggtctgaagttctgactcgtagtcgacaacagggtagtcttcctcctcgagttcgtgcccggcgagatcaaagataacgctttcgtctctcctgacagtatccggagacaccgtaggggactagccgtgcttatccctaaagtcgatatccagcgtcttgtcttggcgtatgttggcttgtattggcttgtggcgtctatgttgtctgtgtcccctctcctcctagggggccttatatttatacccataggtgtccccttatctaagtagaactaggaaaaccaatatggatacaatccgagtagtacttgtcgtttctatgtagaactctggttgtctttccttatccggaactcctcctatatccgcaggttgttttcgtataggacatggtatgtggtgggtcctgccgagatttagtcaactactattaggtatgtggtatccataaccctgacaaacgtcgttgaatttttaataaatgtgtttgaccattcgtcttatttaattttattttgtaaatgtaaaaaaaattaagtcatgcttaaggaatatttgataataaatcaaatcacactaaaataaatggtaattacatttttttaataagatgaatggtcaaacgtattttaaaaaattaaccgcgtcatatattaaacaacggcgagaatacgtctttgataaattttaacactaccaatactcttaatcgtgtacgagcaaatgttttggttttggtaaatactattgtcaatccaaacatctagggtatatggtattttttaagttgttaaatatttatttagtaggtttattaggacatgttttgacataaaaaacagattaagacttaagttgattttttttaaggaatcgtctcctaagtagtacgagtatcttcctataaccaagcgaggaccgaacgacccggccatatatacattgatcagtttgtaataataaaagtgtatagtcatcgattgatgcacttgacccttatataaaacataggcaaaacgtatctgcagttctgtatacaagcgtacaattatatattcaaggaaattaatccaacttattgtcaaaggtgtgcgcatgcccgcgaaaggacccaggcgtttagttcacaccaaacttcccctaaactcttaactttccatcgtatcacatcacatctaaaatttttctactcacataaactcttaacttttttttcaaactaccaactttccccaaacttcttcccaatttcaaaaactaaacacagccctaattaattaagattaaatctgaagagtggacctagattaaaatagtacggctgctgcagattttaatatattggcacgcggttgcacgatcgatgtacttacttatgtacgttggctgttagccagctgcttagctgtcctgctagaaaatcattttccgaagataattttgcttatacggaacacatcctaggtgagaggcaagaaatactaacataacatgtggattcattgaatatagagtactcttgaatatataatgaatgctcatttttcagttgacaaatgcaaacctgcgacctgccgtattaggagagttgggttaacataagcaccttgtcagggcaatcactcgtcttatgctcacgtcatgctgatgtgtaagacccagctcgcgatcacctggccacttgattaacacactgcctgatggaatcaatcaggtggccataacccatgagctagcagagtatcatttggagaacatgtacagttcctaaggaatgtcaaatctattgcgaccatcgattgttcaattgttttaccgtatatatttcaaaatataaacaaacttttgtacgtgaatctaaacgtagtacatgtctaaatttatgtaaacgaatctatgaatatacaaaagttaagataaagcgaatacttagaccacatcgaatatgctttggattaagattaactacgagtatacaaaatgagaaacctattagtttatgattaattgaactttaattattttaaacttaaaaaaggttttatatgatattttagagcaacttctatataaaaagttttcgcacaaaatatatatatttagaaatttaaaaaatgtgctaacgaaaaccgaggtgaaatatgtatctcagcgaagaaagaacgggaccttatttatttaccattcgcttttgattgtttttttattttattttctaaccgatggccggataggagctccaaaactaattataagtcggcataccggatttacataactcatctgcttacataccggatcatactccaacctctcagccataaaaaatttagaacttttttagataatgaacttaaataaaaccccggcatctacattccaagagattcagaactaataagacatactgttgttaggccctcgcgtcaccctccccctcgggcgacacgggaggtgactaggccgccgtcgccggcctctccctccctcctccgcctcgctgccgcccgagcggccgcaaggacggcggtagcggggcttcgctctcaccacgcaagggcaggggggctactcggcgtttgggacggcggaaccgtccagatccgtgccgtccggccggatctagcggggaggatgtcggcggcatcggcgtggtagtgcggtgtggcggcgacgtttggcaaaggtggcaccggcgcttggaagtgatgacagtggtagaagtgaccaccagatccgcgcctggatctggcaggtaagtggccggtggcggggtcttctgctggcgacggacggtggcgcccggtggcgcggtggcgggtgaggtccgactctgcgacggctggatctggccggacgacgagcatccagccgtcgctattggcgacggaggcagtggctggcggcgacggtgcgacggcgcggaggctggtgaaggcacgtgcgatggtgcggaggccccggaaaccgtgacggtggcggaggggcaagaggccgcgctcgcagaggaggtggcaacatgcgcgggcgacggcgtgcggaggcgcagcaactggtggttgcggttggccggtgaggtcggctcggccggcagcccgcgacggcggaggtggtgtcggctcgctgaaggagttgcggccggcaactgtccaacgcgtgtaggcttggccggcgacgtcgaggacggccggtgcgtgatggctgcgcagcgagaggtgatgtcggtggaggcagagcccggtgaggtggctgcatgcggagactggccggcgggggcgccggtgcagtgtacccacacaccggcagaggttttgatggcggtggagcaatggagctgtggtagattggtaggtggtggacggtgggtgaaaacccaacccgaccccggccggaccgacaaccgatgaccgatgatgctcaagtgtcattcccctcctgagggtgttgtcgtgccgtcttaccccttaagggtggttgctgggcgaaagcttagtctcggctctcttgagaccttggcggacggcgacggtggtgtttccgtcgttctctccttggagacgttgtctagacatccccttatcaaaaccacctgaacttttggcgcaaacgtgctctagatttcttcctcttgtggcggcatcctagtttctacaagttggccatggcagatggcctaggggggagaggtgttccatcttctctctcaccctctctctctctctctaaatcctgaagacgtggatagagttgagctttgtgttgtttgtaagggtaaggttttgagcgatctcggttgtttccgttgttggcttagcggcagtcggtctcacttagcggcggccggtctggtgctagtcttctccaatacttgtggttgaacgctatcgatatgtgagtggtggtatatttatttttcctggtgtgtaatcttgttttttttcctgttctattaatagaatttcgcaccgagtcgttcaaaaaataagacagactggcaacacttgccggggagcaatgctgagagcttggctgctgggatggggccaagaggttggagacacatctagtgacgactgacgagtacaagcatctactagtactttatttgatccaagttgctaagctaatctgattgctaacttagcttatcgactgggggctgcagaaaaagagcaaatatgattaaagctcaagtggcaaggtgtcgatgccgacgaggattagttaatggtcagtgtgacagcgcattggcaggtgctactttaaatctaattaagggaaaaccgcacgtgattttgggagcagggacaggttcccctggagaaaacgccagtggcaagtggcagcacgcataaacaaaatttgttgccctttctccaaatcctgccaaggatagttcaggcgcggatctagcggccattgcatcactggcctttgtgaccaggacaaagtcatggcggctcaaaaaccaagacagctaacaaaaaagaaatatagtaatgctcacttcttccctttaaaaaaatattatacaaaatatataatctaatatgaaatgtgatacattctaacattataaatctgaacagattctaggactatgaatctaggtagacctcttatcaaattcgtaataataggatgtcacatcccgtattatatttattttttatgagacgaagggagttcttgatattcctttgtcttcaaatataacattgttactccctctgttttacggatgaaaatggagcggatacggacggataatgctcgtatcatattcgttttcatattttttgtcggatacggaaaagaatacggatagctcgaatacggaaacaaatatggactatctcgaatacgaataagaatcgaatatgatcggacacgaatacggaaacaaatttttctcggaacacgaaaaccagttcaacttctaatagaaacaaatatcaacatatataattagctcattttatataaaatatagtataatttataaatatttttaaaattttaaataatattaataatgtggactagtgttaagagatgaactactattaaaatctaaaaaggtacattgaaggtcatagagttataaagaaatagggtatgtcttgtggcttctgtgcatatccgaatagcactgttcaccggatatctgaattattatccgtatccgacggaaaccctgataccatattcgtattcatatccgagagaaaatatccgtattcgtatccatactatccgagaattatccgatccgaaaggtatccgtatttgtttttatccgaagcggacggaaactatccgctccgttttcatccctactctatttcaatataaacaaatccatacaagatttgtttattttaaatcggagtgagtagatattatgtttaattatttattttattttaaaacttaatataaatatatgtaaaaatacaagtcaggtttaaaataccttaagtaataaaataacaagaaatgatacttagtttgtttagtaagacgaatactcgaatgccatacatacgatacttagtttgtttagtattcactccatttatatccattttatattataagtcgttttgatttttttttaatcaaactttttttaagtttgatcaagctcatagaaatatttgccaacatttataactctattagttttattaaaactaatagttaatatattttaataatatatatttctatttttttctataaacttagtaaaactaaaaaaaaagttgactagaaaaaatcaaaatcaaggtgatttatagtatgatgaaacggagggagtaagacgaatgctcaaatttcatatctagaagttaaccgcatcatatattactttacaatactgctcataataaatgctgattgtggcaccataattttttttactgaagattaacaagtatggtaatcaggaatcttaaatcaaagagcgattttaggagtataagagaaaactaaatcaaaacgttgctgcatatatgcagctatgcttaaagcttactgcacataccctcctttatcattcatatggtatatatagtatattaaatttagctaaaaaaagagctgtgcatatatacactagatcgacatgtatattttctgcaaaagtggatataatatactttcttttatgaaaagctagaccaaaagcaaagaccctttttagtatgccaatgaattaattccactcaaccagtgtgcgtggattctttgagccaagccaaatccagaggctcgacccagtggggatccagtactgaatccagcatgaagtccagtgtcaggtcgtcggacgccggcaacaattcaggcgaaatcgcatagctgcagctgtaatggtcgcttctggccaccgccggcggcggcctgtttaccggcaaagcagcggcgctattattaccagctgattctgcaatgtgacagcctctgatgacggtgagcagcgaggagacgatcacatccttctcttctttcatcgccatgttgtagccgccgctgcagcgaggaggaggagaatgcatcaggcgaggtgtttccacctctgcctttctcagtctttccgccgcctgtgcctttctcaaggaggcgtcggcaatctgctggatttgcatggaggaagccatgtaatcggaggcagaattgctggtgccgcatgtgtgctcgttggtgtagatcacccggaacaaaggcgggtcctccgagttgtgctgctccacgtgcttgctcgctggacagccatggtcctgatggtacgtgcacctgtagtagcacctgcatttgcaagcaataatatatgatgcttaattagtattacagttgtttagtgctcacttttgcattccttgaaggaagaatgctaagaaaagagggccgtcgacatgcatgtggtagccagaactttgacacatgacaatatttggcattgtacaacacttatctcgtaattgtttaaccatgccgacatgcattattagccccaaaggagtattcccatgcaagcatgctttgggatagcacaatgtgggggatggtatccccaggtatgggatcgatacatacaccacatgcccccaacaccaaggggtctagtatatatcctcatcaaattgtatatatagtagttccagttaattaatgatggactatttacgtcttagtacatcatattatgaatcaaaacgtttagcctcaattagtgtatacaatataccgtggtctacattacataatcggcagggagcctgagacatgcaaatctagtttagttatcttgtcagacgggaaactgttttaacagttcgagtggacgtccacccgtttactgtatgtcatctaaatggctatgaaaaaattgaaaaaatatgaataagatagatcaatatgtaatatatcaattcacaaacatgcaagttaaaattcaacttctacaaattgtaacaaaaataacaaacaaaactcaaattactatatgtatatttacaattaaatttgttatttttgttacaacttgtagaagttaaatttgaacttgcatgtttgtggagtgatatattacatattgatctatcttgtcaatttttttgaaaatttttcgtaaccatctatttgacatgcaataaacgggtagatgtccactcgacctactagaatccatctcccaaaccgtgcagtttgcccttcattgcacaccgtgtagagcatacaatgctctagaaataaaaaaaactaaaaaagaatgagatttggaaggagagatgtccctccaaatattttttttaagaataaattgtgagcatgttagagattgaacacgaggctttagagttgaatcaacacaccccttgccactacactatcaagtgtatctctaaaataaaaaaaaactaataaaggaacaattattgtctgatggtaagtgcatagcgcgcctgtgaattgatatttgcgttgggagcattccttcatttctctcagttcaagaggtttcagttaaaattatattgaataatatccccaaatcaaaatgtgatttgaaatatcatgcaaaaagctgaattaatcccatgataaaacccaagtcttccccaaaaaaagatgaattaatcccatgcaaaaagtgacccctatcagaaattgcggcagggtgtaaacaaattaagctgcttcccataaatgagtaataggcatctattataaaggaaaagaaatttaaactaatattcagacaacatggtctacggggtaggcaccgttatccagtaacaacttgaggattattcggagcaagaaattatatataaatttgattgtgtcgggtttaaattaaaatcataatatgattttcgccaagattgaattacttaggttctgatcgtttgtgctaactacggaagcacagccgtagttcatttttttttagtgtggatatatactgttgctgcagctgtaacgcagccacaagtagaacaaacatgttccttatacaacattgcaggtacaatgaaaccttcaactatccctgaaaattcccatggcatatattgctagtacatggatgttgcaccaattccttgttcgattcataagtatggtacgttagaaaatctatcatagcaaacaaaacaaatcaaaagcttggtgtaatcaaaggcaagttgagttggatcatttaaatatctaatcctcagttcgtgcatgttaattattaggaaactaataggcatcttttggactactaaacaacccccagtggagcacaggagagcatgtaccatgacaattctgtcgacgtattatagttcttggttctatttttccctatttggattattgtgcttcttagaagttgctcccattcaagcatgtgatttttggatacacgacagcctaaaggcaaacaatacaatgtgatgcgagggtagctactgggaagatggacggcacaatttaataaactgcacatgaacaagatatctttttgcttgaaacacacttcccattaaactatatatatgaatgcaaccagaaagccagctttccggatagacacaattattaagttccttaagccttcaaacgggattaatcacatgcacttaactaatatggaaaccttgcaatgagatcaatccaatgaacttaactgataagggaagcaccctatttacatacagtgtgtgtttcaatattattttgtattggtatacatgtgggtatgagttcgatcagttaagagttaaacaacaacctttataataattaaacaccctcatcatgcttataattaaggagcttatattatgtgaaatcctgaaccagagtgtaaattaaggagcttatatattatgtgaaatcctgaaccagagtgtagcccagctgggtcatctacatggattagttctactgagcctacaaatatctttttactacatttcacctttcattcttgcaatatagagagttcagtacaagctggttttccaacccatttgaattccttgcaagtgcataagcttacaattcgtctttgccatcaagtctgacactgtataaattacactagtggcatctactaccccattatccaacattttgattgttcaaaatttggccaattattccccataacagacaaatgttgattaaagaactacaggtaattgagtagtgcatgtaccttgggaaggagttgccccggatcatcttttgcccgtattttctccactggtacccatcatgatatggtgcatatgtgtactcagttcttgttccgatgcaaacctttctatttgaggaaattaacgctaattacttaaacatttaaataaatgcaccaaaagatcgaagaggaatattacatgcaataggaactaactacaaacatcgtttgcagcaagcaccaacgaccagacgaattcattagctccatcaatcgcaactcaattacaatttcatcgaaatacgcaacaattaagaattaactcagtttaagcgcgtgcaaaaccagtgaaatgaatggctagctattgttatacatatatatatgcatggattaacttacttcatagcgttctcctggtcatagctcctactgtcctgcagaagccttttatgggctcctctagaacattcactggagctgtccatgttgtcgctcctcttaaccatggtggtctcttgcaaccttctgaaacaggtcgacgtgatatgcaagttggtgcttgcaagataccttgaagttgctgaacgtcgatcagtcggattcccacagtaagtgctgaactcctcgccggcctgaaattaatggggatgatgagtttattctccttgtctagtgctgcggagaagtgtgcgactgtgcgctcatataaatcctctgcacaacctggagtaggtgcgtgctttgcttccagaattttaaattttaactcacacaacgcggtatctgcacttgcaaacttcactgacctatgcaacgtgatacgcatggacaatgttcaagtctcctgaggtgacaaatccagtcaaagaaacgatagccctacctgtcagtgataccagtatcaaggtttagccatgttccggagattctgatatatatcggtttatatgtgcacacatatagggggaaagaacactatatgtgtttatatattggattgatggatttgatatccaaacagtaacctgtcagtctgctgcaaacttatatatgaaaatgcctccagattggtttgattcaaaatttcaatttcaggtttgagaacaaacaggacctgaaaggttgagatgcaattagattagagacatgaacaggatctaattctaactttatatccaaaatttatatgtaggagtactgcaaaatctaagtttaaccttctcggtttcttggttctcatcattgtttcgggaatatggttctcatcattgtggggacaacttattcttcctttttgcttttgaatagttaggtgtttgtttgtttaaaaaaaatagttaggtgtttgctttccttgtagggacacaaataatcaacacctatgtatatgtgtgcatatgaccatgtgaacacagggccccaaatagtgggaatgtttagttcaaaagtagttcattaatacggagggagcaaagcttcaggataaggaaaacaattggtgatctacacaacttcagtggagtagtagtattatgtctcggacaaatcaaggccgaatggttattattataagttcatagtccaatttattttaaaatata

SEQ ID NO: 3373 - DNA, 442 bp, Oryza sativa
cctgttccacctgacgatgatgtcgctgaagaagaagaagagaagctggctgaagaagagtaggaagagctgactgaagatgatggagaagaagagcagataactgaagagggcgagctggtggcacgcgaggaggatactcagactaaggaagatgacgcacagaagacacgtctagcaaggcccaagaagcccaacccaaagtaccatggcgcagagtgggtggcgtgacaactggcgtgcgtgagtcgtacccgtgagagagagttgcgtgtgggagttggcttgtatcgttaaatactgaaacgaatacgaagaacaacggctttggcaatttggaggcgaaggcggtggaggctcaattttgttgaaatggagcaatacaaccaatataattgccataatcctgtgctattttgagtgaattcgagagaacctaaca

SEQ ID NO: 3374 - DNA, 7472 bp, Oryza sativa
ccttaccatgaacttggtgtctccttaagggcaagttttatggtagaggtgactaccatatccaatttcatacatgacatacataattaaattaagaggtgatatgtataataggctatctctatcacataattcccaatatctctaacactctcacatgtttattgaagtttgtgtaggggctgccccttgcatgagaggtgactatttctctctcatccttcttctctcctccacctcactatttagtcttttgtgtcatcttgggatttatgtttgaatgtccatagtacttgccctaagttatctacagatactccgatacttcgatcagtttgatgagtaaaattttagcacgacacttcgaaaagttcatcaccgagaagttggctactctaaaaaaaagttagcatctggtacagtgagctcgaatctgaatcattttggagcgaccttgaccggagcgaatctgtgtggtacacttgcggttgtttttcggtcaatcccaatcccctgcatgcgcccttccctgcgcgcgtatgcatgtgatcgatcgatcatgagctctctgctctgtacatctggtacgtgtgcacgtgtgatcgtaatcttggttttactaaagaaggagatttaggcgttgatcattagtagaaaagatttagcgttgatctgttcctgccaacgacgacccggggggaatcgacgcccgtatcttattgaaaccaatcgaacaatctatctattaacttattaaagtaatagaaaaataagcatccacgttggcttttacggtctaaaaattattatattaatcggagaaaaataaaaacaaattccatataaaaatacaatttaaaaagtaaggaatattggaagaggagactagaagcctccacgctcgctctcccggcctagaaattctcatatttaaaaaataaaaacagagtccatatagaatacaatttagaaatagctaaaattcagaatttaaaaaataaacaatattagaagaggagactagaattcatgacgatatacaatttagaactaatgaaaattcgaaattaaacaataataaaattaaaattaagttagagtccatatagaaatataattaagaaataatagaaattcggaattagaaaacaacagatattagaagaagagtatagagtccatataagaatttagaatgaactaaaattcggaataaaaattaaaattaaagatagaatttagagtctatatagaaatacaatttataaataataaaatttgaaattaaaaaatttatggaagaagagtctagagtcaatatagaagtaactgaaattcaaaaataaaaaaaaagaatattgaaagatgggtttaaagtccacatagaaaaacaattagaaataatgaaaattcaaaattttaaaaaaaatattgaaaaaagagcctagagactatatagaaatacaaattacaaataacgagaattcagaactaaaaaaatgaggaatattggaagacaagtctgcagtccatatataagaatacaatttagaaataactaaaatttgatattaaaaataattaataactatcacgtatatacaatacagtatgagacagtggtagtttagtaaagttagtacaaaatttaaaattatgttatcattttaatatattttaataataaattgagaaaacatatatgtggccaccgtgctagttctgggctgtttagttggaaaaaaattttgctcctgtatatcacatcggatatacggacacatatttgaagtattaaacatagtctaataacaaaacaaattacagatttcgctagaaaactaagagacgaatttattaagcctaattaatccgtcattagcaaatatttactgtagcactatattgtcaaatcatggcgcaattaggcttgaaagatttgtctcgcaattttctgacgaactatgtaattgatttttttatctacatttaatactgtatgtatgtgtctaaatatttaaggtgacaacgtgaaaaattttgttttggactaagcaggccctcagttgatcagatgagagatccacatggaacacaggactctgaaccatgtgatgatgtaacgtggcgacgatcgaggacacataattaaaaacttggccgcgacacgtttttggcaacttctacgcgcggccgtcgtcgtgactctcgccatagttttatcatcatcatcagcgatcgatcgatcgagtagccgagtacagtgaccgagtagcactagtgtacagtgtggctcctcgctccatcgatgggtcgcgacaacgccataattggggacatcgacagagtagttacgtgtactgtagtagcggaaggggaatcacgttgcggccaggtgatcgagctgccgaagccgagtgaagtggcggggcggagatctcgttgtcgatcgcgcagcagcaaagcgggtgctcggtcgctgagcctgatttgctcccttgtcagtcgcgttggttggccttgggcccttgggcccgttgcgaccgcggcgttggttcgcgcgggcttccttcccaccccgcgttggtgggggcggggttctataaatacgggacgcgacgcgatgtgcggggtcacttcactgcacggcgtcgcggttttcccaagctgagagttgtcgtgcgagagtgaggagcatggcgatgctggggagctcgtcggcggtggtgctggagctgatgacgatggggtaccagtcggcggcgtacctcggcgagctgctccgggcggcgtccccggcgcaggcaggggatgagcagcaggagctcgccgcggagatcctccgctgctgcgaccgcgtcatcgccaagctgaaccggggaggagccactggtgctactaccggcaagaagcggaaggcggcggagtccgccgccgccgccgccgtgacctccccttctctccccgtcacgccgaccaaaagaaggtgaggttccccttattgttttttggcgcggctaccgcgagacatatcgtggtatcaaaaatcgaaaaaaccgtgtggtaaccgtaagatatatcgtggtattaaaaatcgaaaaggttaccgtgcatgataaccgcgataatcgtgtggtaacggtacggttttgtactctatcatgcaaggtagtaacaggtgatttcttggtttggcgcagggcgcgtggcgcggaggcggtgagggaggtgaggagcggcacgacgacggacgggttcatctggaggaagtacgggcagaaggagatcaatggctgcaagcacccgaggctctactaccgctgcgcgttcaggggccagggctgcctcgccacgcggcgggtgcagcagtcgcagtcgcaggacgacccggccgcggcgttcgtgatcgcctactacggcgagcacacctgcggaggcgacgccgccgccgccgccgcgtgccgggacggggaactaatgccacctgccgtcatcaactccggcgcgtcgagcttcgccgccgcttggaacatggcctcgcgtgagccggcgtcgtcgctcgccgtcgagcggaggagctgcgacggcgacgctcccagcgagacgtcgcaggggtggtctccctccttctcgtcggaggtggagctggacgtggtgggattcgacctcgccggagccgactcgtcggcgtcgccggtgtgggagttcttgaatggcagcttcgactgggaattcgtcatcaactccctctgaattttcgatgcttcgtgatcagtagcacaccagctgccccaagagtgcagtagtctttgcaaaacgcacaaaatttcgcgggaactatcgaatttcccgcgtttgcgcttaagttaatagcctcagtagttcgtcagataatcgcacgcactattttaattcaggaagggatttagattgacaaagtatattaggtgagagttaatatgggagaattcgtaatgaagagttgaatgtgttgacgttgacgtacaggggaaaaacacatgctaagaagaaaaatggcaggtgaaaggggcaagaaatggcaaagctgagcaacagagcaggtaataatagagaattgctactcctactacttgcaagcatatatgtccagaagagcagccaaagagaacacaagaccgtcagcttgacgcataactgacgcacttctgatggtaacaaaaaaccggccaccatgtcccatgtgaacgaatggattcattagttgtaataatggtaatagtagtgacactcaattgcaatatcatgcttggtacagggttaaggatcagatggttagtttaaccaccaatagcaacaagctgaaacgaatactggttttgctggatttcactggatgttgttgaatatcacaagcttagagcacaacaacgttgcatcaaataaacagaagaaacagaaaacagctaggtacatctatgacctttggaggtcaatttcttattgttgttcgaggcgaatgtgtatattacatggggagaacaaaggagcgcaactgcgaggacgagtatgcatgcaagtcgtcttctgaacccaaccgtcaaagtccacagccacttggggactaaagacaaactagggttgcttgagtttgatggggatggaaacggaaagcaaatgggccagtcaatcttcaaacccaagttcctgtgatcatctgattcatccagggtgatgtgtaacctagagaaatgccatgttgtgagttcaacgacaattggttttatcatttatgcgtaacatcatgtaactagttcagttatcatttatcaaagcacataggcagtgtttatagacctatttgtatactgtacatgcatgggaaaatagcatgaaagtaaaactgtcaagtgttaccattagttctctgcagtactctcggagcttggacctttgtgaccaccagtcataatacgatgagtgtaaaaggctgtcaccgccccactgcagaacaattcaaaactagtttaaaaaaataaaggttttcatacatacaacaaatgtatttcttctgtataagcttaaaatggccatagtggctaggaccccaataaaaaaaaactgtgatatgtgacacgcccctaaagaaataaaacacagcacgataaccactgaatgaacaacttcaaaatgaaacctagtaagtcattggagatttggaataatcatggccaaatatattgtttgccatcaactacttacaggtcactgcatttaaaggaacattgctcatgtttggtttgacaagtttagttttgaagcagcacacaacgtgccaacagttttattactccctccttccaaaagtctaagacctatttctttttgcaccaagaccaagaagcaattaattcattcactatgtatacaaccaataagtaatagaatgacttcttgggaatttaatttagcacatggtgactacaaataggacttggacttttggaaaaaccaaagaatgaaataggtcttagacttttggaaggagggagtataaaaaatggaactattaactgtggaaaaaagaaggcactcaggtgatattcagcgaaaagtagtatttgtgacagatgtaaaaaaaaaactgtcagactgtcacattggattgcagtctaggtgatagatacagtttggggaaatgtacagtaaataagaagaaatctataagaaaaaacacaggataacaggaacatcaaaggcatatgggtaagaaaattcttgtataatcaaggcaaattctgtacaaggaattgacgcttactagtcatagaaagaaactgtttttaagaaatctcatcgtaggaaccaaaaatatgcaaggatcaccacattacatgttaacacattgctagatgtctgttagtcaatatcagagcaagtacaaaaattaagcatgcactcacctgagaaggaccacgaaaatatttggaaaccacccatactacaccatataacaaataaaaaaaggttaaaactaaattatggtggtgagaacaagtatgaatattagaatttagcaatgcaattgaaggcaaagaaagaaatcatacgtggaagaaaattaataattccctgaagaagatgacacttgcaattgctgcatgaaagtcaaatatgtcaataaatttgcaatgtaaaaggacaacaatccaatgacttggttcagcaagctaaatcatgggttcatttttcaatgtaaaatgatgatgaattcttaatttccaattagataatagctagaagtctgaaatattcatacttgtcatccctgtttgatttaacttgaactaatatggatatatccagtaactagacatgtcacataaaaacagagaacatgagtatcaaggatcaacacaagagaccagctatgctactcttatgccacttaaattatgaaaagggcatacaaactgaagagaagaaaagacagaagaaatgaactaaccagcttgtcctttcagcagaagacgaggacgacggccacctgctctttgagatctcaaacttgagatgcccatagctaacagcgcaaagccaagaataataccaaaacgaattgcagatgtcctcccagtaagcatgaagttcaggaaacctcctacggtaagaaaggtacctacaaaaaacagggcaggtccatgaactaaagttgagaacctacataacaaggcagcattaaagtgcctacacaacgaatgacacactttctcggtttattacgtgtttgtcaattccccagtatcaaattaattatcaacggaaattctacaaagaaaaatatgtaatgcattttagttaccaaagggaatgcccacgtgataatcctcatactctgatatcttcaacttgccaagagaattgaatgtctcgataatatccttaattgagtctggcgagttttgagccgcgagttttagatactcctgtccctcctcaccaacctctgtggcaatcacgctgagatccttctgtgctttgtctgcgtggatcttcagcttctctgaggcctctaatagcacctcccttgccctctgggagtagacaccatacgcctgcaatgtcaggccgtgcattcgctgcgcctcatccttgaactgcttaagcatctccttccacacttcttgagcttcctcaggcttcatctcacccttccctttttccttgtcatcacccgattctgagcccacctgaattcaggcaaactcaaccacataagttgtgaactctagacaaatgttttaagcaccacaatttagcaacagaataaacaaggaatttgccacaagaactcagttcaaaaccctgacgaaacgcaccgacattagtcaaacatgggatttatttagcgcaatgaactgatcaagacatttggcatctcaaaaagcgcattaacattaggcaaaactgtttggtatgcattacgtatttac

SEQ ID NO: 3375 - DNA, 2957 bp, Oryza sativa
aagaagaagaatgaagagtattggtggggtttttcgtgtgagggggctttcggtttcggagctctcggaggtgtttgtgtaattgtgtttggtgggctggaattcgtttcgttttcagctgtttcaaccaggttttttaaagtggacgttctgtcaatcaaacctttggctttgtgctcgcggcaagaaaatatgcgccgtccattggtgtagtaacagtatttcactctcgaatcggatcctctacatcgagcaagaaaaatgcagtgaagctacagtatatttttttttggccgttcaatttatatcagtaaatagtccaggtgatatgcatataagcgcagggcacgagggccaaagcgagaattaacgtgggggcaaatggatggttgcttgaaaacacccaaagatcacaattagatgtatctcttttgctcataattatatgcactccatctctttgctcaaaggacaaaggtatactttaaggtgaccatgcccaatgctgattgcttcaacaagttaaaagatcacataagcataagctagcacacgtctcctacagtagagattgtcgactgtgtactgctgatgcagtggcaggcactgacgtgtgggggcagaccaaaacaaaaccgtaagaagccctgtggatgttatagctgttttttttccctgaatctgaaacactagaatacctaaccgattgaatctcaactatgagcccagcctgaactttctttttcagatacatacccagtttcatttcaaccacacagatttcaatcgattcctttattgattaccgcaatcaaagcttctccaggaggggcatttgccctcctcatggagcaatgtcagcacgatggatacaaagaaaaagactcaaatgacatacattgcttatgccaagctgttgcatgtgagacataagacggaaggcaggcaaaaagaactccacaagaaagaaatcgatactcatggcctcatgctaaccctcgaaagaagcaaggtattgctcctgagaacagctaccagcaattactttgattttgccgattagaattgcattgattaatttgaattaaatgtctaaatggtaaagagaaattgactcatcagaaatcctgcctgaaaacaaccgtgttcatgaaggattttgcatttggtgcaaggtaatacaaatgttcttcacattggctagtcaaaattttctattagatatcacagtagatggacgctacgctgacaacagttgatagggcatgtaataagatgcaagatgaaatagtacatccacctagcatgtgttatagcacaacaatgtttggaatctgttaaaataactgctcacttaatgctcgcattaggaacagaagatctacatggaccagcagatgtagtgaagggtacccctcggtatgttgcaattccatttccatcagtgtgaagatcctgggtgcatgataaaatttaattattggttgattcatgcagtatatatacaaatggatacacaacagccttcaagagcactcagcgcatagcaaacacgatttgtgaattgtctgtatttaattattgaatttgttaaggcaatgtaaaaaatgacacccagatgtgcaaaagaaatgacaactgatttaattcacccagattgtgctggaagggcagactaatcatgtgattgctaaaagggaaaaataacttagagcatcatgcaaaaatagcgcattggtaaaagcataccggtgtgatcttgtcgagctgtttcttcttcggattaagaacatcttctggcttcccatcaaacctatatgtgaaggataagtaatttaactgaactgaaaggtggacagttataaacattttttttcttcacaaacggtgcaggacaccaaacacaatcaaataatttctacagcacaagacactactaataacaaccgaaatgctaactacgctaaaatattattttccttgaaagacgacagaaagatcatcacacaacatgggtccatcctgtttggacttcccttacgaccaacatattaggggacaacttgtataacaatctaaaagacagtaattgcatataagcttgtgcaagctgactttaaagccatgaatgcaaataggtcaaattgaacagaacatgctccccagaactgcacaaacacgttttttaaaattttaatgcagatatcacatctatacaacataattcttaccctgcaaatgaaatacgctctccaggcttagctccttctggaggaatcaatggctctacaactgtatgatcttgatttgaagcacacaagacctggcaatatgttcaatgtgaaaacaacatttggaaattaggacttcctaacttaaagtttatattcctaccatttctaagactggagaaagaacacaaatgactaaataagtgataccaagcacatggtgaggcttcacttctaaaatagttcattgtttcatcagtgagaagtgttacattgcctattttagatgtactacagtagacttcaagagcatacacatgacctaatgatttggggtctacagcaatgcctatttaaagctagtattccatcataggctcatggatcttttgtcacatgttggatgtagtttataaatcaactgcttgacacatatcaagatgctttgcctgtacacgagcataaatataatttatggaatagaacataccaatccggcagacattacgtctcgcagcttcccaggcttcacattcgtgattaatacaacatgccgattctgtgaaggaaaaggcagttgtttattacagaaaacagaatcttggatgaaacaatttcatggcaagaaaaatgaacaggaataattcaagtccattgttgctgttaaatactcacaacaagttcctctgggctgaagaacttggcaagcccactaacaacttgatg

SEQ ID NO: 3376 - DNA, 1310 bp, Oryza sativa
atttgccttattctcaggagctttattctgattcaaccaacaaaggaactaatcaactaacttgaaaggggaaaaaaatagcttccacaacagatatctgtacatcataaagcattttaatactttatgtgctgattaaagagctttattggacataaagtccacagagttttgttctgcatttgcacatgagaccctacatgaattgcagctagagaagagttgaaaatgcaataatatcaattccagccaaatcttcaaagtaacatgaattaccaatacctctctgagataatatcatactaatccagaactgcaaagtactagtgataattggcataattgcataatgaactacctctggtgcagctttcttggaatcaacatttgcatccgatttgcccacattcttctgtcctgaaacaactttctttgaacttggatcagtgtcacctttatctgccttctttggatgctgtcacacagaaataggaaattgtacaattactcctcaacaaatttgtttattcaaatagcatactgaacaggaaatactgtatgattattttacaaaaattgttgatatttatatttcttcccagcactatggcacttccacagattatgtcagtagttcttacaaaggttttatatcaaccagatcctaaacataaactgatatgaacatgtacaggtattttcagaccaagcacaaaattgtatttaaacacagtaggttgcattaagttgacagagttaattttcttcaactctgtctcttataacatctgaaagtatacaacaaaggaattcaagaatatgtgtacccccaaaatgtaatacttctagcccacattgggaaaggatctttacttacagaaggtggatcgaagacagatttggtcaagttaaccttttgtactgttgtgccaaaatcaacgatgttctgcgtcaatcagtaagtactcacataagatgtaaaaataaaatggtaatatgggtctgattattaaggtataaagtatgaacaaactggtaataagaccaggcaacaaacaaggaaaaaaaacatggtatgtgcattcacctcagtgctggtataccacagaaagcaacataggggactgtcaagagaaacggtaaaaaaactatatgcgtttggttattttatccagaatgaagggcacatgtacttcatgttgacaacatatagcaacaaactactacttccattccaaaatataagcaaatctaggttttctagcaaagactaaggttaagcagaaaagactatgatgcccctcataaat

SEQ ID NO: 3377 - DNA, 714 bp, Oryza sativa
atgacagtagcccctgacttcaatgcaaatgaacaagttcatgttctcgactgctgaccatggagtaactgttatcgagctcaagtgaccgttctcggtgagttcagagataacgttagacttcctttattagcctcgtgcgggcacctaaagggtttgtctgagtcaatctccgacgacaaccaagaaagtacatagcgtacgactaagtctcttgtcttgccgtaatcgagaatttggattgaaatcaagaaattttatctcggcgggtacaccatctcttcactccgtattccttgtcgagatccagcaaccgttctcgagcgatcgagaaggcgtagagtctgcgacggagccttgtcaacatttgtcgtactcgccttagtcgatcttggtgtagaaccacagagacatggagtcttcaacaatgtcgaatagaattttcctgaaatcaatactcagaaaaaatattaaatagaaatagcccccgagcgaacgctcaaagggtaacatgttataatataacagactagtgaattgaatgtacagactaatgttttgttatatgagcgtcttctctcttaccgactccaatcagtcagtttgtagagtcatacactctccctagcccctagccttgtcgtcggagaatcgttctcggatgataaggctcttggacctttgacctgcctcggttgaacaagcactgatcct

SEQ ID NO: 3378 - DNA, 9728 bp, Oryza sativa
cgaggaccaggcagtagtcgtaactcgaccactagaagcaaatgtacgagagatcactacgatcaactggttgagaaccagtgagaaggtgtctctcgatcatttggagtcgtggcacgaggactgctacgctaccggtcgaagaccagtcgtagctgttcctcaaccatctgaagtcatggtgcgaggaccgctacgccgccgtagtcatacctcgaccatctgaagttaaggcgcgagagattgctatgtaccggttcgagaaccagcgagcgagtagaattatctctcgaacaccaatggaagttgcggtgcgagagattgctacgtcctggtgcgagaaccagcgagcgagtagaattatctctcgagcgccaatggaagttgtagtgtgagagattgctacgtcctggtgcgagaaccagcgagcgagtagaattatctctcaagcaccaatggaagtgctagagttggtttattacatgtgcgtctcatgtggccagcatgactcacacacccaactcgtagcatatccggatgtccattcgcaatcatgtcgggtgatcaagccgacggcgtttacgaggaattatccgttaacaaccttttctcgagtagtccagcgatggccggtgctatgagataggtcgtcggtcttcgttggcaggttgggtgcgataactccgcatttgtcgagaatgttctcgataatggagtgtacttgaccataacctacccgagtacttaattgtttctgaaaaatattttctagaaggcaagatatatagcagataatgtcgagtatatactcaaaaaactgcatggatcttctagtattatcaggacataactgcagatgtaattatcaggcattatgtaaaccgtaaacaagcataatttatacagaagagaacggagcgagcccccagcgttagaccgtagttggcctgacatcggaagcactcgcacaatagatattgtataaaaaacatgctctaggtaaacataataaattattgatctgacaatgctgtatgatctgaataggtacgataaattgcatataaaatattacgtacctttgtagatacatgccggatgtatctacgaaattagtagatcaatttgaaaaaccaatctaccaattaccttattgcgtactcgttcgacatcatatgatctgacatcttctggtacgccgcgtatcttaaggcttgggtgatctcgatagaccaagttgtcgatgacaatggtggttccgatctcgtcggaagacatgctccggtcaggttagatctccacagccgaagtcatcgagtagcttgttgtcggagaatccatctcttaaaccaatctcgtcgaaatcctagagcaccaaagtcccctacctggcgcgccactgtcgacgtttgatgtcgcaattctggtatttgcatagtatggggatcgtcggtgctaggatatacgcgagactgaggtaaaagagatggagacgaggatttttatacaggttcgggcccctgaattgttaggtaataaccctacatcctgttggccggagccggtattgctcttattcaccataatcacaccagtacaatatgtggggtagcctatctagctgttgtcgacatggcggtctgaaggtctgactcgtagtcgacaacaaggtagcctttctcctcaagctcgcgcccgacgaaatcagagatagcgctagatccctacggccggcttctgtaggtaccagatagggccgatccaggcatatctctgatgtcgatatccggcggcttgtcttggcgtatgtaggcttgtatgttgtggcttctggtgggtgtatgttgattgtgttggttctccctctggtccttctagagggtcttgtatttatacccataggtgtccccttgtccaagtagaactaggaaaaccaatatggatacaatccgaatagtccttgtcgtttccatgtagaactctggttgtctttccttatcggaactcctcctatatccgcaggttgtttccgtataggacatgtatgtggtgggtcctgccgagatttagtcaactactattaggtatgtggtatccataaccatgacactttcctatccgacaaagctgttgaaagttgccgtagctttacctttaaaaaaaaggttgtcatgtataggtgagatcagcagtgaacacatgactaaattttagtgggtgctatgtttggaactccaagttctaaactccattgcttcgttttccgcacgcacgcttttcaaacggttaaacagttcgtttttttaaaaaaggtttctgtacaaaagttgcttaaaaaaatcgtattaatctatttttttaaaagaatagcaaatacttaattaatcacatactaatgaaccgctccgttttccgtatgtactgtttaggatgagaactggcatatgcgaacacaaccataggcaaaatacatgccaagctgattaaatataaaacaaatctaaaattcatacataaatagattatgtgtcatacataaaatttgtacataaataatggcctgatacttatttatctttttcttccctctagcaatttttttatctaatagaattggatagtacatatagtgggtttggccaacagtaggagggactcaagctagcccaccttgcccccctttgggatcgtcattgggtgagatctctctctatgtctccttaggatctgtttgagttaagagaaaaagataatattgagaagatacgtaaaacgagataagtcattagtgcatgattaattgattattatttttaaacttaaaaaataaattaccatgaatttttaaagcaatttttctatagaaaattagaatatctccatgagcctctctaaattttgctctccatttgctcatttagctaactaggcaaaaaaaacgttgctctccatattttttatctactcttttcttaagaacattttctacatactcctacatcctctctatttaccctctccattttgacaatgaaagccacacgtcaatctctctctccttccgatccccttctctgcacaacccgtcccttccccagtccccacccaccaccacgagaggccaacgttggccactcgcgctagcagggtggctacaccggaggaggaggcgattgatagcggtgatggaggcgagacggacagcactgccacctcgtccacggtggcgtactgtgcggcgaagagaagggaggaagaggcggcaacgtggtggaagacggatgcaacggtactcatgcgggcaatttatttatttatttaaaaattcatatattaaccaaatattaagacagagttcagggggatgtgatccccggtacatcaccatagctgatagaacttacagagcacaccatcctttcggaggccaactgaactaagaaaactagcatccaaataaaactaaacagcaatagaggatgatgtcgcgtacatagcataactgactgactactgccttcatcctatgaagttttaacggaaattaagactgaggtgaaaattaaataatagaagtttatgattgattaagacgagaggtaggtgaagaagttgattttagacattaaaatatgctatatgtgggagggaactacatcttttatagttgaacattttttttatgcgcgagggcaaaagaaaaaagagttacaacctcttggagaaagaaaaaaaaatgttagtttggtagacaaaaatgtcctattctaatctttattttgagctgaaacgaaaacagtcttaaaccctcttacgaaggcatctacgacgtgttcaaattggagccattttaaatcatacatttttcaaaaaaaatgacagatatatggatatatttagtttgttatcaaacataggtaatgcatatagaattttaacaacaatacatttagcctatctgatagacttggtaatgttagcaatttaccgaaattttggtattgctaaatttagtcattttgaaaatgtttatttcaacactaataacctagcatcaaccatccatccacccaccaggccacaggccagcacatacatgatacatcacggtaatagcatgtacaatagcatgtacaatagcagactataagctagctataaacacatatcgagaagataaataagaagagataagagcagcagactatatatttgtagccagttgcagcacagactataagacgcaatgtgtgtataataggtgggaccatatattacttgtgtaatatatgtttatatgtaaaagtatgattagattattaaattgattatagataatttagagctaatactgattggctatactattagagcaagttcaatagtatagccaactactagctccaattatctatagtcaatctaatagcttattcatacaatatttacatactacactattaatacctggtcccatctatcatacgcacacggcgtcttggagtccgtgctgcagctagctacaaatctgtagcctgctgcccttctctctcctcatttatctccttaaaatatgtttgcagctgacttatagtctactattcctcctcttaaacttgctctaacgccagagaataattttcgcgtcagccagccagccaaccaaccgtcgaccgcaagcccaggcacgtatacaccggtccacgtagtacgacgagcccacgagcgcgcgtgcaacgcacgcaaacgtaaccgcgcgtccgcgacccgtcgtttccccacccgacctgcgcccggctgcctctgctgcatctatggatcggggacgcgtacgagcgcgtgcgcgtgcggcgtgcggtgcgatgcgggccgcgcgcggctgatcaccccggggtgccagtttgtccggacgcctcgtccgatcgccaccaaacggccaaacagctagtagtagagcgggcgcgccgcgcgttttcatacgtttgcctttggagttttttgcagcctcgcttgtccggagtcgtcgagcgggcgcgccgcgcgcgcgggcgcatgcgtgcgtgcccggtgggggtggagcacatcgccttcccaactaattaatcagagcaaaactaataatacaaccgatctaataatacaaccgatctgttaagtataagattttttttagccttctctcagcatgtttatataatagttagctctttataattaatacatgacccacttatctctctcaaagagtttattggttcttatgtgttcaaaccagctataagtttatagcccacttctcctctctctctcctctatcctctcctccacctcagcatttagtcggcttatagcatactattatacttgctctcaagtgcgcctccgcgaccgacgaccgggttcgcacttcgatcgcgcagttggtttggttggaaggtgtagtacgtggaacgagagatttttttttcaagtacagctgtggataatttgctaaactttttcagcggggcctaattcttttcaggttttaagggctactggactttcgtgggcacgtcttgtaagacgctaaaattttccatatacgggtatatatacgttcgaataattgtatcaccttgatgcaattgacttagtttaataaaagcttccattatctaaaaaaaatgtcgttacgtgctagatagactagaagggatattggatcagatggttatgcaagcggagtggacgtttcagggcatccgcaatatactctaaaaatggtccataagcaatataatatttgattcagctacttagcaatattgtggaactagtccataggaaagaaataacaaaagctacccataagcatatgggctacccatagagaataaaatatattatttgtctctatctcttctctcctactaatactactccgtatttgctatccatatatattgtgaaggttataatagttagggcctgttcactttgataccatttcaattttgttaaagttacaaaaaaaagtggctacatttagtttgctgccaaattttggtaactatataagaaatcctgccaaaatttggcaagttgccaaaatttggtaatgttttttttttttgcaacaaagtgaacaggcccttaaagctcatatatgtggtttccatctctatggattacttttgccatatacattattgttacccttatagtattagataaaatgtatatctttttttaaaagaatcaaataaataattatttttaaatctgataagcccatacctcactgtaaaatggacctaaccgtaggcacatacggagtacggtttaacgtgatatcatattaatatattaacacgattaaattcaaatttaaactgtcgtgcgcaacaattttagaattatagagagcctcagtttttttttgtgtgtagtgtttgcttgtattgttgactgtgttttgctagagttaggctgtttcaggtaataaaaagaacttttgaatttgaatatactaaggctatgtttttcggtgcatgtccgactctacttccttatttttttaagcacgctttttaaactactaaacggtatgtgcacaacattatatagaaaatttgttttaaaaaattatactaaactattttctaaaaaataattaatacataattaattatgtgctaatgaattactccgtttagaattatttctcttccgtctgagagcaaaaacagcttggaaagctatctatcccctctcttcctccacttgttttctggattcacgtactggttggctgtgttcggatgcctcttttcccaacctctctcccttgttttctacgcacatatttttcccaacccctctcccttgttttccacgcacatgtttttcaaactgctaaacggtgtattttttacaaaaagtttctatacagaagttgtttaaaaaaaattaaattaatctatttttttaaaaaataacaaatacttaattaatcacgcgctaatggatcgctccgttttccgtgatcaccgttccggatgggaacttgttatagcaaccacagcctaatataaaatagtgagataccaattgaaaggaggagacggatttttccctttcgggcggtgaaaatcctgttagtgctcttgcttgactctctcgaaacaatccctttttaagcgcacgcttaaatgtgcatgtgttctttacaacactttctttacttctaatatttattttctatatgttttcttaaacaaaaattttagaggaagttacttttagaaaatcatattaatttatatttcaagttttatctatcaattaattaatcgtgcactaatcttatatagtgaaagcagcaagctttcttgcacgaggatgtgccacattatcaaaaatatattagccgtcggataaaaagttcggataaataatggtcattagatcaaaaaagtgcatgtattaagaaaagaatcaaatttccggaggtttctggtatatcctctaaacatatgatataaagagaaagtgaacaaagagaagaaagatggggcttttaatgattcctcttataaacatatactccctccgtttcacaatgtaaatcattctagcattttccacattcatattgatattaatgaatctagacatatatatctatttagattcattaacatcaacacactagtacagatccttctatctgtgacgggctctatatgcttagaaataccgggccgtcacaaggaagtcatctcaatcgggccgaaaagtgcccaattgagatatggtcgcacagacatgttagatgggtataaaacttaagcccgtcacggatgacacctatcagtgacgggccacaactttaggcccgattgagataaaattctatatctcaaacgggcctgaccatcatctgtgacgtgcacctcatctgtgacgtgcaccaacttgaggcccgtttgagataacaactagacccgtcacagatgactcatcagtgacgggctatatacttaatctctatcgggcattaactaaagcctgtcaccgatgactatttttccatttttcatatgaaatgtttatatttgtaagttgactatagcaaaataattttacgggtagaaatgatttcaaatggaaaaaatgtcaacaacaaagttgtataacttatcaatatttacaacttttagtttggtcatttttcaatataacattttttttgaacagtttgaatttgaatttaaaaatatgaaaacttcaaataacattttcaaatactaaatgatttcaattgaaaaagtcatcaacaacaaagttgaataactcatcaagatctaaaacttttatttttgttatttcttcatctgacgaaatgttagtaatattattcacaaattttacatatatgtgttatagtttataaaaaaccagataagagatatgtcaattttgtgaacaatgttactatcactttgtcgtatgaagaaatgaccaaaataaaagttttagatcttgatgagttattcaactttgttgttgatgactttttcagttgatatcatttagtatttgaaaatgttgtttgaagttgtcatattttcaaatttaaattcaaacggttcaaaaaatgttatatagaaaaatgaccaaaataaaagttatagattttgatgagttatacaactttgttgttgatgactttttcagttgaagtcgttcactgatctaaaattctatttgaactttttaaactttgaatttcaaatttcaaattgtttaaatagagtcagatggagaaatgaccaaaataaaaattttgcacctcgatgagttctacaactttggttttggtgacttttctatttgaaatcatttagtaacccaaatttgacatcctggcttagggcataataagattaatagaatactcataccaacatgttacaattacttttccggaagccaatctctaaagaactttccgcgtgggtgcacacgagtgagggctagccaaaaaataaaatttatttatttttggaatatactcatctgtgacgggaattaactctagcataagttaatgcccgtcacagatgactcatctatgacgggctataattaatgcccgtcacagatgactcatctgtgacgggctatagttaatgcccgtcacagataagagtcatctgtggcgggcgctagttgtgacccgattaagataggtcatctgtgacgggctatagtttgactggttgtctgggtcaaagctatcggtgacgggctttacttagggcccgattgagatagaatcatccgtgacggccgtttgcccgattgagatagctctttacatcagtgacttctagcctgtgacggacgccatgcccgattgagatgagagtatccgttctagtgacatgaacgtgggaattgctagaataacttatattctgaaacggagtaagtagtactacttggactagaacaatatatacttcgtaaacaaattaacttatatcaaaaccttcttaaaagttaaggtaaactaataaggcatatacaaaagttcttaaatagaattaacagtcgcgcatcgcgcgactatgtggctagtatatgttgttttgtttaagttgtgagaatatcccttaaaaaagcactgcgtaagaaaacaacactcattcgtcactagcttcaccaacactaaagataaa

SEQ ID NO: 3379 - DNA, 4426 bp, Oryza sativa
catttatcgataaattttctattaaaaatttatcaaatgtaaatacaatataattatactgtgattacactgtaactacagaataattacactgtaacttacgtgtaattacactgtaactatagtataactacactgtaactataataattacactgtaatttagtataactatactataactataatataatataaaacttgcatgtaagtgagatgtaactttagaaaacttatgtttggcactgcccacgtgaaagagggattacggactcgcaatgtctgtttgtacaatgcgtgcggaggccatcatccatgcatatgcatgttcggctataccctgctgctttatctctgcccttcgtctgtcatctacgcgggcatgagccacgcctgaggtcggcggccggcggacgtcgaaagaaacaaattaaagcgtcgacacaaaagcacgaatcccaaggttcatcaagcggttcaaaaatcgataaattccaaggaagaaatttgtcagcagatttatagcaaaaccgttatataaattgtggtctaatccaaaggttaattatataagcaattcctcaatacaaaatgtcattaaaatagtggtatatatgaaattgtataaattcttcatgaaaaaatgcgccgccaacagctagcccctcatccacgactccacctcagctcctcgctgccctcgcccccatgctactgccctagctagatgcgccgatgacagcaccggatcaagtcatggggataccggatccagcctcagcggttttggttctatccattgatgcaagcccttccagtccgttctaaaatataaaatacaattatacttttcaccgttctaaaatatataaggatttttagtgtttcctaaaatatatatggaggttttgtgtatttctgaaaaaaatgcatcggaacgtcgagaaaaattttggaaatcacgtaataatccttatattttgtacaagaggccaagagggagtagtttctagagatagaaggaattaccagagttgtccatccaaacaaatttagtttcaaataaacgacaatcatatttcggctagttttagtgttatgatgagaaaatttctgatcacgcacagcattcatcttgactttgaaaaataaaatactttttttttgtttttttgggggcaaatacatttttttttgttgaagagagtataaaagcatatattccttgtgaactttcgatcaatacacatattgttgcttcgctcaaggttgatcgatttatccattaattttaatattggtcgctgtcgaccagctagctaagcgtatacgttcaacaataccagatcactctgctagtacttgatttctctctctagataatctctaaataatgagtcatttggctggtttgttcatatattccattgtattgattgaacaaactaaccagaacattttatactatggtatgcatgtgtggtgtgtcctaccgtgtttctttaataatcgggtttagcacgtccgagatcacaggctcacaactactggacgaaaagaagttttaaaaaaacaaactcttcgtgcacccttgatgttagacttgccaacaagacatggaatatgtgtacacgtattatatattttttattactgttatgtggtctagaatatatgttatgtgttctagaacaaataatattaatatatacatttggatggcccaaaattatttggggtctatcatcactccatgctccgtatgtaaaagtggcaattttttttctctgttttgtattatctcggaacttggtatagcactctgtatttagattgatcagtttgcgcaaaactatttgaagttcaatttttctgctggtccagggtttgaagatctaagaatgggcatggcaaatatatataaagtaggtaggatgtagaaaaaaacagagaatcaattaagggaagcaccaggtttatggtatatcgagtgaaatcatcacatcttaggtgcccacatatatttacatgagtgaaatatatataaggtctctaaatttgtgtaggtatgtcatctagattactggatctttgtgtgatccgaggaaccacatgagcgaggacctacacgtttttaacagaaagttggggggttttgatgcaacattctgattgcatggcgtcgctagtccgtgactttctcagcatgcgtacgtacggtgtttagagaggtaatgttagagattttgtcgctgacctcatcgagcattcacaattgcgggttgcgggtttgaggggtgtgaacgcggacattttttttccatgtgggtctcgtatatgtaacttaaaaaaaaataagcgagagaacaagtaaaaatatcaaaaaataaaactaattaatgccgctcggtcctatttaacacaacactaaattctatatccatattgaatttaaagtttgtatgctaaaatataatggtttaaaattttatatttcatttaaaatagaaaccaaataactcattctaacgctatcaacatatataacataacagtaaactcagattggtaggtttgtgaaggtatatcaatacccaaccttaaaaatcttatatatgtggttatgccaagtaacatcccaatgatcccatatatcggggaggtcgaagctagggagggaggccgaggagcggcgatttgtagtggcttaattaggctgtgttcgggttgtgaggtgggaactaatccatcgtttatataaaacgaagtaacccattaatgcataattaattaagtattagttactttttttaaaaaatagatgaaaataattttttaaagtaactttcatatatatatatatatatatatatatatatatatatatatatatatattaaaaaacataccgtttagcagtttgaaacacgtgggctagaaatgggttggaaaagttggctgccgaacaccgccaagctcttttgtggcgcggtgctctcgcgtcgcttgccctgtagttcatcctctggccgtgtggccagattgatcgatccggcgaaacaaaatactgagcatgtaccacttcagtgcctctagtggtagcagtagaaaagaaccgagatcgtgtcccatgtggccgtattggtggcaggcagccacacaggctgcatccatgcagatgaggatggagctctatagctagctcagctagcgtgtggtgatcccgattcgatcggaaatgttaattttatctcctcggtcataaactaatactcctaatgatgcttacagagactaattaatcaagtgattagaagcgttgagttactcctaattaaaagtcctaggttaccactacatgacagtggaccacagcatatgttctactccctccgtcccataatataagaaattttgagtttttcatgctgattgaccactcatcttattcaaaaaaatttggaattattatttattttttttgacttactttattacccaaaatactttaagcacaacttttcgttttttatatttgcataaattttttgaataagatgagtggtcaaacaatgcaaataaaaactcaaaatcccttatattatgggacggagggagtacttaattaattaccttagtcatactcccttcgtttaaccacttttaaatttgaatctgaacatagttgagaaattgtttgtagcactcgggtggacgaccacttatttcttacatgttgactaaattgttatgtaaaaatttcacaaaaattgacaagatagagtattatattatatatcactccatagacatgtaagtcaaatttaaattctacaagttttaacaaaaataataaatttaactgtgaatatgcgtatactagttagagtttaatttattgttttttacaacttgtagaaaatcaaatttgaatttgcatgtttacggagtaatatattacatattaattatcttgttaatttattttaatttttataaccatttattcgacgtgtaagaaacgagtggacgtccacctgaaagattggaatctatcaacgaacatatttacgtccgcttcaaatccagaagtgggtcttttttgggtgaagggagtacagatcggagaacagtaaaaaaaatataggggtagttcacgaaagagggagagctgtaaacaaattaaagaataatctagctgttcgatcccactgtactcctgttatttgcaactgctctcgacgggatgagaacgaaatcgaccgaccggccgaccgggcggccgttgcgttggacggaatccgatgcgaggcgaatcatcatcacccgtccttgcttgtctcctcatctacttctccactcccatccagctcaccgtgcgtggagaagccatatcatgcagattctaactacacttgcttccata

SEQ ID NO: 3380 - DNA, 3211 bp, Oryza sativa
tagagtgtttttttgcgcttttttttgacttttttctcatgcgtttttttgaaccgtttttattttctcatgcattttctctttttaaatagttagattagattagagatagagaagagatatataccgattagaaatcagactttgtttcacccattctatttttttctcgcatgcattttttaattcatacgaagcagatttttattttttacgaaccatttttttccactttcttaggaaatcggatgaaattttttagatgttttttttcagattttttttgcctttattggaatcagactttttttttcgtttttaaaggaattggatctagctttttttcaccaccttttgtttgccttttataggaataggattttttttttgttcggatctatgtttttttggccacataggggaaacagacttttgttgttgttgttgtttttcttttttcctttattttttttgcggcttttctttttctttttatgcacctttctgtctttgttatctcccttttattattattattttttaaaaaagacctcaaataccttgttgcaagattatacggacttaaatgtaaatataaaaattatagggattcaaatgcaaaagtacacacccaaaaattaaaatcatataaaaatagaatgctctcgatatgtaggttccttttttgcaaacatatccccaatcaggcacatcaatttttttcatcaagatgtatgggatatcatggcatagattaaaaatgaggggagtggtgcctgggatctcggactcaagcctagaggagaggtgccttttatttttcgtttttaaggggaatcggatctagagttggatttttttcgtcagagatagagaatcggacatattttttttttatttttttcgtccttctttttacccggagtcggacagatccaatttttttgtccggattttttttctgtaatggacagatccgattttttcctttaatgaacagatccgacttttttcctttttcgcctttttttttatcagacgggtttaggttttttttttcacccggttttttctggattggatagatttggttttttcgcccggtttttcgttttttcgcccttttttatcggacaagtttgttttttttcctttttttcgtccagttttttttacggacagatttggttttttggtctggtttttttttacgaacgatggaagcacctcttatttttttttaagtagtagagatagagaattgttgagttcattttgattgtgtttttttaccatactccatttttcagaattattttctaccagtggtggagtcagaaaattttttaagccctgataaacttcaatataactagctataaaaattccatcattaattaaccctttattattaaagtttagtggactttttgccagcgagcccaggcggctgcccggctagccaggcggtggatccgccactgttttctaagttgctaagaagtaagaatacataaaaaaaaaactcccaaattactttttaccgttaatgtgttatgttggcttacaactgctggcatggactgatgtcggcaggcagatggacatagctaatcacaattgacaaagataaaggtagtttaattctcttgtgagttgtgaaacgtgaagctagcgaaggatcctgacagggatgttctcctgtggccctgtgggtagcagccgatcagtggagttagagaggttttggtacattttgatgtatatgtttttccatagattttgccattgccttttgcaaagtgttgggctaatttagcatcacacggtcctgcgagagtcagcctgtccgattagatcaggtcgttttcgtgtggttcggtgtgtgtcctactagcttttctgattgatgctagctttgttgtcacctgtacttgaacacagctatatagctctcacttttccttaacgaaatcaaggcatcgttttaatggacgtgggccttaattcagcctatatgtacatgtttatgggccagaattttcgtactataaacttttatgcaaacaaaggagtaaattgcactcacggtgcatcaacttggtaggtgggtgtaatttggtgcaagaacttgagatataagtgttctagtgcaacaacttggcaggtaggtgcaatttagtataaggcctttataagtgatcatataaatgcaacaacttaaaggtaggtacgattttgatacaaagttatgcggacttaattatttggagctagattcaatttttaagtacttattttgacactatactagcatgtatttgtataagaatatttatatttttatcctaataactaataattgaaagtcaattaaattggatgtagaaattattatatttcggttgatatttgagaaggtgaagaaaacaaaaaattcttaaaaggtaattagatgcaaattgtatgtgcagtataattcttaaagattaaatttactatgtaatggcatattgacatcgtgaaaaaaattcacccactatacaagttgatgcaccaaaatactaaattgcgaagttcttgtagtaaaacacacttacttgtcaagttgttgcattcggacgttcaatttttaagttcttactctatatcgcacccacctgttaagttgttataccatgggtgcaatttactccaaacaaaagtgtcagggttatggataccacatacctaatagtagtcgactaaatctcggcatgacccaccacataccatattctatacggaaacaacctgtggatataggaggagttccggataaggaaagacaaccagagttctacatggaaacgacatggactactcggattgtatccatattggtttccctagttctacttgaacaagggacacctatgggtataaatacaagactccctaggaggagaggagagagaacatagacacacccaccacaatctacggaacaatatatcaagacacaagatcaatgtacaagccaacatacgccaagacaagacgccggatatcgacttcagagataggcacggctagtcccctacggtatctccggatactgataggagagacattgtgctgtctctgatctcgccgggcacgaactcgaggaggaagactaccctgttgttgactacgagtcagatcttcagaccgccatgtcgaacaacag

SEQ ID NO: 3381 - DNA, 2381 bp, Oryza sativa
tgtccctttacgccgtcttgacaaagcctctgaggaacctaagggaacttcggctggggacgcccagagcggataaggctttgtcagatccttcagagacgaaagaccatgtaagatctggtcatgtaagagatctcgccgtgcgtattaaccaagtcgtgtaatcggaaatggattttccaacttcacagctgggggctaggatcagtgcttattcaactaaagcaagtcaaaggtccaagagccttatcctccgagaacgattctccgacgacaaggttgggggatagggagagtgtataactcaacaaactgactgatcgaagtcggtaaaagagtagatgctcatatacaaaacattggtctgtaagtttaattcattttcggttttccatacatattataacatgtcaccctttgagcattcgctcgggggctatttttatctaatattcttttttgagtactgattttaggaaaattctattcgacattatcgaaggctccatgtctctatggttctacaccaagatcgactaagacgagtacgataaatgtcgacaaggctccgtcgcagactctacgccagctcgattactcgagaacggttggtggatctcgacaaggaatacggaatgaaaagatggtgtacccgccgagataaaatttcttgacttcaatccaaattcttgattacagcaagacgggagacttagtcgtatgctctgtactttcttggttgacatcggagattgactcagacaaaccctttaggtgtccgcacgaggctgataaaggaagtctaacgttatctctgaattcaccgagaatggtcatatgagcacaataacagttactccaaggtctgtgcgcggttgagaatatgaattcgttcatttgcatcgaagtcgggggctactgtcagggttatggataccacatacctaatagtagtcgactaaatctcggcaggacccaccacataccatgtcctatacggaaacaacctgcggatataggaggagttccgataaggaaagacaaccagagttctacatggaaacgacaaggactactcggattgtatccatattggttttcctagttctacttgtacaaggggacacctatgggtataaatacaagaccccctaggaggaccagagggagaaccaacacaatcaacatacacccaccagaagccacaacatacaagcctacatacgccaagacaagccgccggatatcgacatcagagatatgcctggattggccctatccggtacctacagaagtcggccgtaggaatctagcgctatcgctgatttcgacgggcgcgagctcgaggaggaaggctaccctgttgtcgactacgagtcagaccttcagaccgccatgtcgacaacagttagataggctaccccacatattgtactggtgtgattatggtgaataagagcaataccggctccggccaacaggatgtagggttattacctaacaattcaggggcccgaacctgtataaaaatcctcgtctccatctcttttacctcagtctcgcgtgtattctagcaccgacgatccccatactatacaaataccagaattgcgacatcaaacgtctactgaaagaaaattattgatccatgatcgatcatgatctagttgtcgatgctaaaccatctaaccatagtacaataccatacccttcgtcgtccatatcatcttttcgtattagctagctgaagaacgccgatagatgtgtgtttcaaaagcacaagtcgatcatttgacttcaaaaaaacgaatcaccactaacaagtacaattaatagtctcaccgtacaccatccaacatattcagatatgcttgcagcttgcgaaagtacaaagttattaccaactgacacagtgacacacgtacccccacaagttctgcagcctctggaggtggtttgttgcacgggtgcaccgcacgggtgaagaacactttggcctgtttggacggttaacattctaataagcagctggttggtagccaaattctgaaaatctgaaaaaactgacttctagttaatttttttattctataactacagcttctcagaatttagactaaaagctagactgtttgacggagcttctaattatagaagaagctgcagctgcaggaacctccccagacagcctctatacaccgtccgttgaattaacggcagagacccaccccagtgttgctttcttaagcgtgctctcaaaagagatcgtgttgagacttgagagtcaaaaggaagagcagtaaacttgattttcaccgccaaaacgagaaaatccgtcctcctgatcttttgatctgtacctgacgattttgccttttgta

SEQ ID NO: 3382 - DNA, 7289 bp, Oryza sativa
caggccaagacgacggacgggaaaggcgctgtgcccaatggatcggagaaggcggctggttagtttagttgggacttgttcttcgctcgggttttgtgaattgtgatggttgattgatgtttgcgtttactgaatttggatggaatcgcagggcgagccgtggagaagaaggtgaattcagcccggacgcctgccgcaagccgctccttggtaaaactcatgagtttgagtgatcttccgcgagtaacaatcttgtcaatttttagttgcaatgcagtaaaaattaattacagatttctgtgacgtagcctgttaaatctggatcggtggacgcgcctccaaatgatgcttctcctgaaacccaagagtgagtgtcaattctgtcaccaaccaacaattttggccgtccttttctttcttctggattgcaatttcagttgttgtttagtagttagcaccatgcaattaatgtgcatccaagttgtgatgcttgccagaaaaaaattatatggtactgccactgataattcataatagtgctgtttggggtttgcttggcctgaaatggttgatcttttatatcaggtcaaacgagaacaccacaaatgctttggaacagactctgccagagaaaatggaggatgatgtgcactccaccacatcgtaaagcatttttattttcttgatagctgctctttttttatgccctgtgtttttattaacatgaaacatgctcatttattcatgcaggagtaccaatactccccgagcagctgctcaacgcaagaatgctgctgctgctgctggttttagtttcaggctgcaggagcgtgctgagaagaggaaggaggtatattatacccataaaggcattgcgctaatccatatgttcatttacattctcttttccccccttatgctgaccaggtttagtgctgtcttactttcagttctaccaaaaacttgaagagaagatccatgcaaaggagcttgaacaaacaaatttgcaggcaaaatctaaagtgagaacctttttgatatcattaatataaaacttttgaatatttgtaccacttggatctgaaaattaatctattactcaggagagccaagaggctgagatcaaattacttaggaagagcctgacatttaaagcgacacccatgccaagcttttacaaggagcaacctcctaaagttgagttgaaaaaggtactaagataaacttgatcttgcaaagttgctgatatctgttggcaaaaaaaaatccacattattcaagacttctagagttctagactgcaatatcctcaccaccaaacatgccttgacaagtttgcatggacatttcaaatactctgttcactgtatgatataaattgaaaaataatcatttgtttctagtttctgttattagaatgttaaaataagcattacatgatgtcaatctgtagcttaatataccaggaattaataccagaacttgtttattagcaacatgcttggaggtattaggggcgaagacgtcttaagaaaaaaaaacatgcttattatctgtttgtgctatctttttgataagtcgcgttttgataacaccttagttgtaacccttctaggagtgctgcctcatgtttctgctcactggcatcttttggtgtcaatttcattcttgctcgtttccaattttagcacaatataaacgtgtaaactaacaagagtactcaactaacaattagcagatctgatcctaaatcatcattggttgacaaaatgatcctacattgaagtttgaattttggtcccgttgagtgctgatagatatatgtgataagtcatcattttgatctagtatgaaagaaagcaggaatacctaggaggaactagcatattttttaatgaagaagataataggcaccaaattcaagtccaagagggcttgtacgtagatggtgggagtttataagcacacctcccaccaactgagctgggtccagttcctagagaaagaggcctacctatggaggggaaacttaactaggcctagctgtgcataattttgtatgctttgctagatcttctggcatgatattacttatgttctactggatcttcataatagtattgaggattgaagtagctgtacaaatttcaggcttgtactgtaatgattgagtatgccaagcatttttcttgcaaatcttggtgctagggctatacaatggcaggttccaccttgtcagtttatacctttctgtatttagttttcatggttttgaatccctgaactgcctaatgtattcaaatcatccatcataatatgtctatatgttttgacggagtaatcaccaagatttgtagtttgtaaggtaatttaatcggagtactgacaaatacttggtcttctccatccaagctgtatgctagcagaaccagctttgccattttacagtaagctagactattcatagttcagaacatgataaacaacttctctgtggtttcttatgttttttttgggtgttcagtttccttatacatatgctatcttttgtatggcactaagaacctgttcccattcatatttataaagaaataatgaaatcaactcatgtgactatttgcagatcccaccaacacgcgctaggtcaccaaagcttggccggcacaagccaaccaattctgctgctgctgcttctgttgatggttctgtatcatgtgagagtcctcggagcataactaatttggccaaattgaccgaaagcacagaaaataacaaacctcatgctactgccagaaagcctgctcaaagatcagtcacaaaaattccttcccaagcatctgccactgcaaagaccgagacaaaaccccttgtgacaaagcagaaaacctcaaacacaaaaccaaaagctccaagagccaaggtagagcaattgcaagacaactcggttgaaatccctcctgctgaaccttctggcccagaggggctcactgttgaacatggtgttgaggatgcaacagggccagaccgggccaccactttggttgcttcgaatgaagttccagtccaaggttgattcgattgcacatttggttatttaatcccttcttgcagtcttgtgaatagtgaggtgtgtgcttcatggaaagttgattcgctcaaagtaccgtggatttgtcatttccggagtagacatcccctttttttcagcttgtcattaagcattccattgtatattgcttgaaaatttgttcatgttaaaattttatttcttgtgtatattggagttatatgtcaatgggcaggctaggactgttgcagaacatcaatgcaacttgtgaattattttgtgttataagttgattctccttggtccttgcccagtatatccttcttcacctgttgcaggcttgcagcagttggtttccaaatgtccaatgctgtctgtttaaattgggagttaaaagatacatgaatcattagtctagaatttgccttcagattctgcttgccttgtatggttgtaggggattgctatgttgagtatgttctgaaattctactgaataccaaatctgagactaccatagatccgatagagcgaaatggctagaaaagaatctgagactaccatagatccgatagagcggaatggctagaaaagaagtggagtttatatttagtttccaacttgtaagtttagcttcaagagctaggtaagagctaggtctgaagtaaagttgtaggtctgaagtaaagttgtagagtaatctaaacctaactccatctttcaagtttattttataagaacacttcagctagctccattcctattttgcttgtccaattctcctcacctggtttctctcgaattctcaatctaagtactagctccattcctattttgcttgtccaattctcctcacctggtttctctcgaattctcaatctaagtactagctccattcctattttgtttgtccaattctcctcacctggtttctctcgaattctcaatctaagtagtgtaattatattgtaacttgtatataacttttaataattgttgaattgttaaatttgtttcaagatttatacgagcaagaaatgaaaaaatcatagcgttcgtataggtgagagaagatccaaatgaaaactcaaaggtatgtataggatgaagtaaaatttaggggtatagaagaaattgtgaaacttttcaagggtatgtagagaattttctctataatataagttatgagtacaatgtaattagttgcattacaattgtattattttttttaaaaaataacaacaatatatagcttatcacacacctttgaattggagatgcgctaatctagcgatggcgtaaaccaaataggaggcggggaattatcttgccatggatggtggagtggccacatgtcccgcagcttcgtcaacctcccgcggtagttgctcccgccgaactcccacagagcaaggtccagccgcttccacgacggcgggttcgcgtggtcgccgtcgccgtcgctttcgtcggtgaggtaggcgcagttgccgcgaaacatggggtagtcctccacgcggaggcaggcggcgccggcgtggccgacgaacagcgcgaggtcgccccccacgccgccgggcaggctcacctgctcgtagaagtagaggtcgagaggcctgagcatgacgacgtacatctccgtcgtgctcgcgtcgtcgtcgctccccgacctgcgccacctccgctccacgacgaggaattcgaggccgccggcgacgtgctgcgggtgctgcggcgtgatggcgaggtacctgcacatggtcttcttgaggtggtggttgcacggacgcggcggcgtcgcgaacatgagcatcgtggccaccggggaggacggcggcggcggcggcgcggtgaggtcgagggagtgcaccacggtgtcgccgccggggctggagtcctgcagcacgtacaataggccgtcgccggggttgtggacggcgtcgaggaaggaggtgccgtggctggcccagacgccgccgtcgacgagcggcgtccagcgctcgtcgcccggcctggcgaaggacagctcccgctccggcatgtgcaggagcaggacgacgcagccggtggcggcggaagggctcgccgacatcgccacccggcggtacatccaccgcctcgcccgccgcgccatgacctgcctgacgtcgggggagccgcccggccgccggccgaagtcgacgtcgtacgcgacgccccggcggccgccgtcgccgggggagaagacgaacctcctgcccctgacgcgcccgagcgccgtggccggcgggagcgcggcgcgggcgccggtgagcgggttgaggaggtaagggttggcgtccctgtcgcttgtgaacagccacccgtgcgccgaaccgacgacgccgctggccgcctcctcgtcgaggaggggcacgcggaagtgggcgccggtggacgacggcgagtagaggcggacggcattgtcggcggcggcggcggcggcgtacagcaggcagggcgggtgcggcggcgaccggaggccgaggcggcggaacgtggcgaacgccgagtgccacgatctgcagacggcgccggagtggactaggtcggggagttgcatcgcctccatggcggtgagcaggaggtcctccggcagcccggaccaatcccggaagtcgtcgccggcggcggtggacgccatcgtaagttcgtgaccggcggcgagtcgcgtcgcatgcataaaactcggcgtcgtgtttacttcaaaactcaactggggctatgcgcgttggattcggatccaaatagaaaggggaaagttcaactagactccctcaaatataggtcgaatttgattcatacccctcaaccgcaaaatcaggtataacaacgcctccaacagtttaaaccgtacaaaacgactcctaaaccggtttttatatatggtggttttctatgacatgacacatcgaccctggtctttggcatctatataggcgccggcgaggctgagcaggcaggaggagagacgagggaggtggtaatgccaagtcacaagcccagcatagcgttgcacgcctatgtcttcatgacgttctacactggcttcgacgtcgtgcaacaccgtcggtcttggtgggtgccaatattgaagaatgtcggaatggtgttgcttgcttcgtctttttcttcttcattatcattccctctcgtctctctccccctatctcctctctctcattacagtgagcccttaccgttcgaatttgggattgtgctagattgcatcaagcagagatgaacaaaacctgttctaagtccaaaggatttttctttgacttcttcctggatcaaaagatgcaatcaacaacggcaattgtcgtagcaatgccatcatggtctcatggatgctagagacaggagacgtcattctgcttccgtcctcactgggagttgacgcctggaacggtgagcggaagattggggggaggatggtgtcaaggcggcactagaaggagaaaggagatgggacagctacaagaagaagagaagggtagctgacggagcgtggggctcctcaccgggagaccgcgcaggcccccctttgccggttcggccgggggccctgggtgaggttctaagctcttggtctgtggaaagttcgcgagagtgaaatcacacaagacacgggcgatgtatacaggttcgggccgctgagaagcataataccctactcctgtgttttggtggatctgtgtatgaagaagctacaaagcgcgagccagcccccgatcgttctgggattgtttttccccccttcaatcccctttctaagtgggcaaggtcctccttttatacctcaaggggataccacatgcaccatctctctcttttttgtggggacttatcctattttattcataaacagacggagacttgtatggttgccgtccgaatgaccttctgacgggaccgcccatacctacctccacttccgccggaagcaggcgcgacgtgggaacatggctgtctgtcgcgcccagaagttcttttccctagcaaaaattcaattaataaatggttggaagaaattatttctttagaggcaagagagaaaccctaaattaataaatgcaaataataatcggaatcggcatgtggaatttttcttggattctacatgtcaaaatatgctaacaggatttttagtggaattttcagagcattggaaataattttaaccaattaaaataagcaaagtg

SEQ ID NO: 3383 - DNA, 15935 bp, Oryza sativa
tcagccctgggatgaattattgcgcaataaattgattaagggtttttcttttatagtaataaacacatataatcttctaaaaatcataactaattcaccctaaccaacgacaaatgggagaagatcaccttccgttccccagcgtcgcagaagtccgtagcgagtctgaatcaggctgctattgagggtcagacagaaacagtggagaaaagtcccaggaagttggaggatattcctatagtacaagaatatcctgaggtatttcctaaagacctcactacaatgccaccgaagagagaaatcgagttccgaattgatctggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgtgttgattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcaccactcggtatgggttgtttgagtgcacggttatgtcctttggactcaccaatgcaccgactttcttcatgaacttgatgaacaaagtgtttatggagtttcttgacaagtttgtcgtggtattcattgacgacatacttatttattcaaaatcagaagaggaacatgagcatcatcttcgtctggtactcgagaaattgaaggagcaccagttatatgccaagtttagcaagtgtgacttctggttatcggaggtcaaatttctgggtcacgtcatttctgctcaaggcgtggcagtggatccatcaaatgtggaatcagttacaaagtggaccccaccaaagacagtttcttagatccggagttttcttggacttgcgggctattaccgtcggttcatcgaaaatttctccaagattgccaggcccatgacacagttgctaaagaaagatgaaaaattcaagtggtcagctgagtgcaaccaaagttttgaagaactcaagaagaggttagtctctgcaccagttctaattttgccagatcagacaaaagacttccaagtctactgtgatgcatctcgccaagggttgggatgtgtgttgatgcaagaaggcagagtggtcgcatacgcttcgcgacagttgcgtccacacgagaccaattatcccactcatgaccttgagttagcagcagtggttcatgctctgaaaatctggcggcactatcttattggcaaccgctgtgaagtatacactgatcacaagagtctgaagtacatcttcactcagcctgacttgaatctccgacagcgaagatggctagagttaattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcacggcctacgctcgtggatcaagtcagagcagctcaagtaaatgatcctgaaatagctgagctgaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgaggagagaaatagctgaattcgtcgcactctgcgatgtttgccaacgggtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacgtatacgggcaaaaggttggcggagctctacctctcgagaatcatgtgtctacatggggtacccaaaaagattgtatctgatcgagggagtcagttcacttcaaaattttggcagaaactgcaagaagaattggggactcgtttgaatttcagcacggcttatcatccgcaaacagatggtcagaccgagcgagtaaatcaaatcttggaagatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgaacgtcaactgttcggaacagaagtgttaaccgaagcagaggagaaagtcaggaccgtcagggaaagactgcgaatcgcccagtctcggcaaaagagttatgctgataaccgccgaagagagcttacttttgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagctagagcttccacctaatatggttggtatccacgatgtgtttcatgtgtctcaactgaagaagtgtttgagggtacctgaggaacaagctagctcagagcacattgacatccaagaagatttgacctacgtggagatgccaattcgtatcctggaaaccagcgagagaaggaccagaaacaaagtaatcagattttgcaaagttcagtggagccaccactaagaggaagaggccacctgggaaagagaaaatgaattaaaggccgcccatccgcacctcttcgccagctcttccgaatctcggggtcgagattccgtttaaggggggtaggtttgtcgcgcccagaagttcttttccctagcaaaaattcaattaataaatggttggaagaaattatttctttagaggcaagagagaaaccctaaattaataaatgcaaataataatcggaatcggcatgtggaatttttcttggattctacatgtcaaaatatgctaacaggatttttagtggaattttcagagcattggaaataattttaaccaattaaaataagcaaagtgcaatattaaatccctgggaaaatcctttttccttttatcttttcttttccctcctttttccttttcttgggccgccggcccatttcctcccgcgccggcccgctcctccctcccactcccgaagttcacccggcctccctctccctctcgggcgctgacaggtggggcccacctgtcagccctttccctaacctccggccgcccacgcccgcgccaaccgccgtcgaaaccaccgcccacgccgccgcgtatcccgctgctcccgcgcccactccgcccgtaccgcacgcccacgtcgccgcccactttccccgctcctcccgccagctcgcgcgcccgcaaacggcgggggatttgaaatttcccccactctctctctcctcctccacctcctccactactccggggaaattgcgccgttcccggccacgactcgccgccccccctcctatttaagcacgcccgcaccttcctctctctttttcctttctcggccgagccctcccgagctctccatcgctcccgcgcctctcatcccgccttccgccgctcgccgccacgctccggccgcactccgccaccgctagagccgtcgccgcaccgcgccgatgacgccgccgggttcgccagcttgtgcgccaccccgtccgccgtttccccggtcaatcccgccgccggagcttgcttctcctcgcgcgtcggtgagtaccccatggccgccgccttcgaccggcgaatccgctcgctgttaaccacccctctccctctaatacctcccatcttgttccctaggaggtctcggagctcgtccgcctatcgtcgccgttccccggtcgctcgccgtcgccgttcgccgtcgtctttccccccccacgccggccaactcgcggtgaggcgcccctccccctcttttccccttcctctccctcctagcgccgtgccgggccgagccgccgcttcggctgtgtgccgccgcctttgcgccgccgtcatccgccgtcgcttcccgcgcctccggttgccgtcgccggcgaccgtgcgtgcgcggcaccgccctcgccataaccggtcggccggtttgaagccgagccggaccgaccgggcgcctcgccgctttccccccccccttgtgacgctgcccggtgggtcccgcttgccagccgccccctctccctctctcctgtgcctctgacccgcgggtcccgcgtgtcggcgccacccctccttgtgctgacgtcagccctgggatgaattattgcgcaataaattgattaagggtttttcttttatagtaataaacacatataatcttctaaaaatcataactaattcatccgagctccgattaaatccattcaagtctcagtaaattcataaaaatgtgtagaatccattaaaaatggttttgtttcctgttacagtagtcttatagcatgttttgcttgtgtgctttgtttgtcgcgtagatttcggccgtttcgtcgattcgtggtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaagcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagagggttatgcgaagggtcctgacacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgttttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagccttcaggcttagctcgcttttatctttttccgttgcatttgtaatcttttatatttttgtaagacgtggatctgtatgtcaacaattgtcgtttgtgtaccctggctggtcctggacaggggtttaatacacattcagcttagaaattctggttcgtgaatttctgggcgtgacactgtctgctgacgacatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaggagctaacatgccggttccggctagggacgagtgcttggaggctctcgtcctgacgggatggggcgaggcgtgcgtcagaccgcctgtcgccacctaacccacgatctgaccggtctgtgaccggtcacagaccggataaacgagcgcgctgcactgcgttacatgcggcgtgacgcgctcgtccaaaccgcaataaatgtggttaagtgagccccgctatgctcacctaccccatatacgcggcgcaaaacccacaaggggtcggggcacctcggccctcggggccgaggcggtagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcactgacagtagcccccggcgttatgccaaggcgatcgctctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctcaactgccacagccgcatatccacttcatgcaccgcaaacgggcgaatgggattagtggaagcgtgggcgcgagaaacgagggagcgagatagtggacgcgagaagcgaggagccgggcgcagcgttggcaagggtataaagacgccgaggaagagatttgcttccttcctctcgccattattccccttgtcttcgccgcttgcgccctaactccttgtttcctgtgccctaccttcgccacacgcgctcgctcttaaacttctcttcctccggcgtcatggcacggggctccgctttgcttgatggtagcgtgctgccgccttcccgcatcgtgagtgagaggcaggccgggctgccgcgccgcttcatgccggaatctgccaccggccgggagatagttacgctgggcgagggacgcccggcgccatgctacccggggcggtccgtcttcttcctcccttttgcaatggcagggctggttccgccattttcttctttcttcatggatgttctggagttttacgatctccagatggcgcacctcaccctcaacgcggtaatgacattggccatcttcgcgcacctgtgcgagatgttcatcggggtgcgcccaccccttcggctgttccggtggttcttcactgtacagccggtgtcgccgccgtcggtggttggtggttgctacttccagccgcggggccggtgttgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgtctggcgggcctgcgatccctggggctcataggggccatggtgtacggcgactaccttcgtcgccggattgcgccgctccagcggcgcgtccggggcgcctgggagtacaccggatccgaagactacatgaggacccaccagggagtcagatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggcatcggaggagcgggctcctcgaggccacgatggcgcgggcgggagccgcaggggggaacgatctaccccgggagggggtcgtgcttctgggccccgcgacgggggcccggggagcggccgccctgccgacgcccgggggaagaggaagcaggaaggaacccctcccccatctcctccccgagggggcggggcggcgcgtaccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgtccccctcgcaggttcgtcccacgcccatcgtggccgtattcattccctcaacgcgagttttcactcatccatcttgtttgtcttctggtctttcttctgtttcagcgagatctcgtcgcgtccctcctgccattccaagtccggccagtctgaggccgaggacccggcgaccacagaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcggcgacgacttccgaggcagctcgcgacgaggccgcgggcgcatcgcttgggcccattccctcgggcgacgctcaggacaagccaggtctgggggacatccctgagtccggcacgttcatcggcgggccgagccgcgcggcatcctcaccgaggcggctcttccccacgccttccgttgctccactgagcgcagaaccccttctgcaggccttggccgtcgcaaacaccacggtgttggacgggttaagtgcccaggtggagaccctgcaagcagagcgggcggagcttgacgccgcatgggcgcgtgtcgaagaggggcgacgctcggtggaggccatggtggaggtgggccgcaaggcacaccgccggcacgtctcaaagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaaaaagctcgacaccgcccggggggtccttgacgctgccgctgcccaagaacggcgggcggcggagaccgaggcggcgtctcggcggcgcgaagaggccctcgaggctcgtgccatggcgctggaagagcgcgccggcgtcgtggagagggacctggcggaccgcgaggccgccgttgccatccgggaggtaacgctggcggcgcacgaggccgcctgcgccgaggaggagtgcgcactccgcctccgcgaggacgcgctcaccgatcgggagcgagctcttgaggaggccgaggccacggcgcaacggctggcggagagcgcgtccctccgtgaggctgtgctagaggaacaagcgcgccgcaatttggaaggtgcccgcgccgagaaggccgcactgaaccagcgggccgctgaactcgaggcgcaggcaaaggagctggacgcgagggcgcgcagcggcggggcggccacgggcgaaagcgacttagccgcccgcctcgcagctgccgaacacaccattgccgatctgcagggcgcgctagactcgtccgccggggaggtcgaggccctccgtttggcaggcgaggtagggcccggcatgcttcgggacgccgtctcccgtctagatcacgccggccggcaggcaggcctctggggcgggcggactgtgaagtacgccgccaaccaggggggcctcgctcagcgcctctcggagatggtcgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggatggcgcgcgcgcgcaggtccgggacgccgccgaccatatcgtccacagcttcgagggttcggcccctcggctcgcgttcgccctcaactccgacgaggagggcgatgacggcggtgtgggcgacagtggcgacgaggctggcgacccgggtggatcggagtgagcccccaggcccccgccaatctttaaatagtttcttcttttcttcttccgaggccttcgggcctccttcttgtatagactaatttaatctgcaatcaaataaagaggaaattttttgtgtcaattctatttgttgtgtgtatgaggcgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgacggcaggattgaacacaagtgacctatttcaagtcaaaatccttcaaaaggaaacaacagcacagatacagcctttaggaaatcgaaaatgcttttattgaaatacagatataagagaaataagaatatgcatatgtggtagcccccggccaaccctgcacacccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgctttcgctcttccaagtagtcgaggtcatctctgcgaagctgatcttgatcagcctcgcagtacatggtggcccgaggagacctcagggtgagctcggatgggagaaccgcttccgcgccgtagacgaggaagaaaggcgtttccccggttgctcggcttggcgtggttcggttcgcctagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtaatcgccaaaaagttcactagtgaattgggtgccgttatccgtaataatacggttaggcactccaaaccgggctatgatgcccttaatgaatttaagtgcggagtggttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcgccttcatggatatcggcaagaagctcgacgccttgttcccgaggaatgctcttcaggaggattccgttagccgcgcgccgatagagggtcccttctaccagcacgtagcgtttggagatgcgctggacgcattcactcccttcgcggtcctcgggtagagtcttatctgtgaggtatgcttggatctcagcgatccaagcaatcaatctaagggagctaggagcgctcccctcgggtcccgaggcctggactccgacgggcatcgggggcctgtcaggcgcgtccgtctcccctaaggggtcgggtcgcgccgacggctgggcaagcctttcttcaaaggcgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagaattggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggcggtgtgaggcagctgcgagggacccgagctggcctcggggactgagacgggctcgggagctggggtccactctgccacaaaatcggcgagggcctggctcttgatagcgtggcgtggttcaaagtgcaaatcaaactcagaaagttcgactgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctaggcctgagggtatcgggtcttggcgtcccggagggcctcactaacaaagtagacgggccgctgcacctttcggtggggccgatcctcttcgctaggggccacatcccttgggcgctctttgtccaagcggcctcgcggggcgcacttgtcttctgtgccgacgacctcggggtcggaggacaacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcaggcagaggaccagctccggtcgtcaggggccttgggccaccgttcggctcgggggcctctcctccctgctctctcccgagccaagccagcacagggtgggggtgcgcggaatgaggattgtcctcatcgcgctccacaaccaacaccgcactaaccacttgtggggtcgccgctaagtagagtagcaagggttcatttggctccgggacgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactttcaaaagtttccgctagattcgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacattccggggcctggcgtcgcactttctgccggactggccttgcgcccggccgcacggcgagacgatgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcgtcgcatgtgactatccgctgcctcggggcggcgggggcggaggtgccaagcatctcgtcgccaccctcgggcttggacgcggcggcgaggtggtccgcgcgctgctccatacaagcaagcgcgactttgaggttgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacctgctccgtgcggaagttggcggatccaccgaaggtgaccgggaggtcgatatgacctagcggccaagtgtgacccggcgtcacaccgataatcggctgggacggccggagcaccatccccggggccttgatggcgtaaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgtgcccggcgcgtcgcctcatgagtaggggccgcggccagaaactctcgcttcatggccttgaggctccggcgagaaacgtgagcacacgctccctcatcgacagtggcaatggtggccccaggctcttggaaacctaggtcatcatcgccgtcatcgatgtcctcggcggggtccttctgcttggcctcacttcgccggttgccggaaggaaccgccggggacttgccctctcggcgctcctgcctcctctcctcctcccacttcctcgtccgctcagccaaacttttgactgcgcggcagtccgcgaggtcgtgaagggaagtgttgtggacgatgcaccacttgccggttgggcgctccctgctgggagcgccggcctccttctttttgtcgcccgcaggcctcccctttcgggtggcccgcgaagcg

SEQ ID NO: 3384 - DNA, 2565 bp, Oryza sativa
agacttgtatggttgcagtccgaatgaccttctgacggggccgcccatacctacctccacttcccccgaaagcaggcgcaacgtgggaacatggctgtctgctgacgacatgaccagtgtcagtccggtcacaaatcggtcattcttgtccgccccgcgtcagtttatcaatctgcatgttcgcccttcttcatacaatatcttgcctgtaatggttaggatgaagcctggcatatatctgaccggaaccaacgtgccatctccaggagctaacacgccggttccggctagggacgagtgcttggaggctctcgtcctgacgggatggggcgaggcgtgcgtcagaccgcctgtcgccacctaacccacgatctgaccggtctgtgaccggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccatatcaccctcgggcccgacccccccgagggggttaggccacgtgggtgatcgtgtctgcctcaagtctctaagtcatgatactcccggtcccatgtcaccgacagtagctattacatatatggtcttattgtattttttttacagggatgccatattaaaaaaaccattatcactagtgatatgctcgtactaatgctactacgctatttagtaatgtaaaacaaacaaccaaatgtgacgatatatgttttaagaagcttctcacaaaaacttaaaaattgttactcactccatattcaaacaagaccgtatcaatcaaaaaaggcacatcataaagaaaaagaaaattaaataatctatgctacgagcctttaccattgatatcgcccctaagaactaaattacctacatactatctattgcattgcgctgatggatcatgcatgtcttccatattggaaaaacaaacattatgttctacagcagcatggattggttgttgggattccaaattgttatgctcctgaagctccctgttggtaacggtaggcacaaactggcacaaagtaaatcatgatcaattaaacaaaactcactaaaaacagtggtactagttcaaggaaattaaatggcatcataatttaaaagtatgctcaaggaaaattaaacaaccatgttatcaactattacaattcggactcatatttcattgtgaacttaataaccataccatgcttataagtcatagtagggtaataccatagccaaacttaacgcgtgacactgacctgaaggaggctaatacaggaaagaaaggcatccaaacaccataaaaattaaaaaagaattaacacaactactaaatggatatatatggtcaaaagttcatacacgagtacttatcccttataagagaaaccacaacttaaaataagagtttatccgactaacaaaagagaacaaaggattaaacttctagcctccttctataattccaaccatacttagaaaaaggaactctggaactctcttctcccttatacttcttcacctcgattgccttatcttcttaagtaccaaagactaaagtcatacccggtatgttactttagatataacctgcattaaaaaccacatcatttctatttaactgtatcgtcgaaaataacactgtaatattaacaaagattcggtttatgggcttaggatgaacacctttagccaactaccaaaaggttataaacattagtgggggtttcaatgccaaaagtaaagaaaattgctacatgtaaacattagttttattgaaaagttgattgcacatattttttaaggtttctatagtatttcttttactctttacaacaaaaggttaacattgttcttaaatttgctacttgcacgagcattacgtttgaagtctaaaccacattttttcttatcttacatcgaaaactcatttcagcatccaattaactccaaatacaaatacagccgttcaaattaacatttcaattcaatgattttgcccatatatagtatatccaaactctgttaccctcatccaaattttcttttatccctatacgatatgactttctttcatagacacatcaatcacacacgttgagagaacctaactcccttcgtcacataaaaagatgaatctaggataagatgtaatacatttttagtactatgaaactaaacagatgatatatgtttagattcatggtagtaagatttgtcacattcgatatatgtatagatttatcgtactataatatgtcaaatttaattctagatttatttttttaatagaatgaagggagtatgttggatttttacttgagagagagagaggacattgctacgagcaagagcaccaagccacaaaccccatcaaagcgaaaccaatgaatgtttgtgtcacgcacgctccaccgatccatccatccagcc

SEQ ID NO: 3385 - DNA, 1273 bp, Oryza sativa
tgtgccctttgagttcttcctgctgtacatgtcccttttgttgaggaatttctatgtaatctgttgtatggtgaattggcttagcagatcaattattgctaacaatagacaattttatgtaacctgggagtttcttgtggccaatagtctcaccatatgatgatgatatcatgtgcctgttcatactcctcctgctgattaaatctgggcattattttgtgcaaatgtttgatgatatccctggcatttacaaactacaaagaatgtacaatggtggatttagtttttggcgtagaatatgtaggcgataaaagtgatgaattatcttcagtatgtcatgttccattgcgcatcatgaatctaatacaataacgtgtaacagggtactctgctctgatcctaggtttattgtactgctgcattagcctctgttagtttggctacaaacttactgcagtctgcaaattatacactgcttccattaccttaattgtttgatacatcatggtttcctgctgttgagtaatttaattactggatcatccaggcggcttgtgatcaagattgttcagctagaaggaagactagcaagtactttgcatccaaaacagaaaaggaggaagacaccagtgcaggaaaaggtaccgggagaggtttgcctaaaagaaaacttcagaaagtcagtgatgagcttgaggatgacatgaagcctttgccagcaaaggaagtccataaagaagaagaagatgatgatgacgacgactttgtggcaccttcaaaaaggaaaactccggtgaagccaccaccatcaaagaagttgaagggtgcatctactgctgaagctcatggaaagactggtcttgatgatgataacgaggacaagatggatgaagacgctaagaccccttccaaggcatctggaagtggaaggggaaggggaagggggagagggaggggaggaagaggagcaggagcagcccatggaaagacaattggtcttgatgacgacggtgaggaggataagatggatgaagatgccaagaccccttccaaagcagctggaaggggaaggggaggagcctctgggggaagagggagaggagggggtgggagaggcttcatgaactttggtgaaaggaaggatcctcctcacaaaggggagaaggtagcttattccttcttgttataatttgccagaaaactcaatcctaaacttgttattcgtgttctgtaggaagtcccggagggtgcccctgactgtttaactggtttg

SEQ ID NO: 3386 - DNA, 1084 bp, Oryza sativa
ttccaggtccatgcctcctccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcgtcatcccttcgctgtactgcgtgcaggtccgcttcttcacctgggcgcggatatgtgccttgaaagttcatggtgaactgttggcacaaatcctcccaggagtggaccgacgcgggtggcaagttcattagccaaccccgcgcctgtcccttcacggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgagacactccggacgaggaggcgccctccgttgcgtgggcagcacgtcggccattacgccggcgctcgatatcgatgcaggcatccggccccccacgcagatcttcctgggtcggaggcgctgacgaaggagtggcggccgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcggcgcccttctccatcacccgtggatgtcgaagtcgcggatccttcgaccctctcgagcacctcctccc

SEQ ID NO: 3387 - DNA, 711 bp, Oryza sativa
ttcctgcagcccacgactgctcgcgcaccgcgagagggaaccatgcaatcaagcctacaacgatggtggatttggcatccttgcatgacgctcgtaccgagggtgacggcacggggaagacctgacatgcggggcctcctatggctgatccaccctagagacactgggtaaaccatgaggaggccactatgcatggatactacgtccgcttaaacgaaaggtacaacgagtctacacccatacaaaagacacgggaggccggccgacagaggatgctgggatacgtgggttggggcttaatagacggccgacggcgctgaccgtttccggataccacccaaatcctttgtccgccccaaactaaaatagatgctttaaaaatatttctctgttcacaaatcatgtaatcaatatcatggaaatgtggcgctgatgtatacacatgccccatctctattaccttaccaaaggtaattgaccaagcataaagcattttgataaatatgagtatgcatgattctagaatatcatatctaaacaataggcataattgactgaggactcatacgtaaacatggttacgacggaatatcgggtaaacaatgatcaaggcatgctataatcacaagttggatgttcatcattgcatgcatttctatttgcatacaaaacaatctcgcaactgagatcagcatgttcaacgaatagtga

SEQ ID NO: 3388 - DNA, 650 bp, Oryza sativa
tgctagtttcattcattgataaacaaaagagaaagcttgtagatatacttggtaacttctccatatatttgtttattttaatggattttttttgacctggctttcagaggggctaaaaaagtaatttcttactctatactcatattttatttacctggaagttgtagctattttggctcttttgaactgttaatgttcatgctgtctaccgatttttatctgaatgatgtgttttgctcaagtgcatacgctctgctattgaaccagctgtttctggatctataatttgtggatttttggatgactttataatttgcaatgcaagagttgggttgtatttttcccgctactttaaattcataatagatattgattcaactttcaggctgtttggttttaatggtgggagactacggatggatgagagaattgatttgagcatgagcgatcctgatttagtccctctgattatccaggtaggggacactgatggtgcaaatctgtttttgtttatttttctgtagaattcttgtgggtcctgtgtcctgagatattttctgctatgaattgtttcccgatactttttgtattaaaagtagctcatcaggcttgcaacttggtttttccttcatttttgaatgagcatcaca

SEQ ID NO: 3389 - DNA, 11711 bp, Oryza sativa
gtgagataagaagcattaaatttaagtatggaatagtagtgtttacattggaagaggagtgtctagtactagtttcttaatgatgtggagtttgtgaaaaccatgtctagtgtttttggttgggaatggcctcaacgatggtaacctaaacagtttgttttcccaaagccgtacttcataggatctctgatcacataacttcaattaggttaccggctgtgggtaactcaagactatacagtgacacccactatagatgattttgaaaaggaaagtgaaaggaacaaagaagaaggggatgagaaggatggtgagtgggcccgactagaaccaatggcgttagacaacaggagtggtgatctgcctacttttggggggcatttaaccatttgccatttttagcatgtacaaacatcaatgtggagcaaaccatttagaatttctctagcagattgagtaaattttacaaaatcctaggtattagggcatccattacataaaaccctagttattgtgatttgtttcacgaaatcacatgttttgagtcaaaatgtttcaagaaacctcatattcatatagactacttatattttattattacataagattgtttttttcatcaattcacattagttggctaaaaggacatactcttctcgtctactttatttttttctcaattttgcgccgaaaaagcttaacataataccggctgattataatataataataggttaagtatacacataaatgatcaaaacatgattaacaacacttgttaaaaagcaactaacgttatatatgtactaaaaagtatctcatacattctttttacaattattatagataaatatattagtcaaataaacgatgtaaatttatacctggggttttataaaacattttactctaaaacctggggtttcatgaaacaaattacaaaacccagggttttgtgttacagaagccgtaaaatacaaggttttgtgaaatttactcgaaaataacaacctacctgggtctcccttttcacacaaggaaactaagaaaaaatgactttgtacctctccttgaaaagattttctctagaataccaggttggaaaggttggtttctgctgcacatgaaactctggtcaagtcactcctatcttcaattccatcctaccagatgacaaccttgctaatccctcaatgggtcatcaagaaaattgacaggaacagaagagcctttctatggaaaggaactgaacctgataatactcacccaggaacaagccttgtgaactggcaaacaagcaaatgcactaggggttgggagcttccggatctggatcgagaggcagtgtgacgaaagagctggtcagacagatggaattcgatgagtccaaactacgtactaagatcgaccaagtatggttattggggcggtaggactcgtcaagcaccagacgatagaagcttcaattcagatcccccacatgtcagtttgtagtaatgcagaggaccctcactctagaagcttagtctttccgtttttccgtttttctttttttttatttggttgttactctattataaaacccagaatctaagtatttctgtaaccatcagctgtgtatatccactcatggatgatataagtgcctaatttctatccaatatgtgaaaaaagagagactaagggaggaaacattttttattttgttgtttcttagttacgaaacctagaatcttaaccttcggctatgtatccttagctagctatggatacaaatgcaaaatttttatccattatgtaaaagaataggagagccaaagtgaggaaacattttttttattttgttgttttctagttatgagacctagaatctaagtatgtaactttcggctacgtacgtatatggatataaatgccaaatttctatccattatgtaaagaagaagagagacaaagggacaaaatacacaagcatggagcatagcaagtcgacctcagcgggggacggcactaggctgggtggctagggaatcccttaagccctagccaacacaggatcttatcggccaccgttgcaaaggaagccctttctaacacgatgatctcacgagcgacaacactacgaccccccgctcacactccgtgctgcaggctgaggtctatcacattctccatgcttcccctccaatttcgagaggatctccgtaatccgttgcacctgcgctgcttcttgccatatagaacaattactcttccagcatccccaccctcacctaccataggggttctaaactcttgaggggatatttcctgattgcttacatgttatttaaatagttatttttttaaaaaaaatcaacaagatagattaatatatgataaatcactccacaaacatgcaaagccaaatttaacttctactagttgcaatagaaaaacaaattaaactatagctagctaatatatattcacagttaaatttgtttttttcattgcgacttatagaagttaaattttaagttatatgtttgtgaagtgatctatccactactacagaaaacacaaataggtgccggttttcccaatcggcaccacggaggcagcactaatatgaaaagaaataggtgccggtttaagaacaaacacctttgaggttccctgaataaaaaaaaatctggctcgatgacgagccgatgcattgagccgagcagtccctcctcccacatccatccacaccacagcaagaacgagcatatcatcatctatccatcacatatccaatccacagatggactcatccacatatcaatccattcatccacaacacaaattttgacacttaaattcatcctggatcttggcaataaaaaaaaatccatagatggattcatccacatatcaatctattcatccacaacacaaattttgatactcaaaattcatcccagatcttggcaataaaaaaaaagaatccacctctctgtcgttgtcccgccatcgttgtcgtcgcatggtcgcgtagccgccgccgtagtcgtcatcttcgagtcatcacgccgcctcccctcggcgagcccaccacctgcatccgcgagccccgccgcccctgtcgcagcctcccctcccgccggatctagcagaggggagggctcctccacctgccgctgccgcctcccctcccgccagatctggcgaaagggagggctcctccaactgccgccgccgcctcccctcctgccagatctggcaaaagggagggctcctccaactgctatcgccgtcgcgtctcctccgcgagcccgacgcctaccgtggcctaccaccgcagagccggtgggaggatgagaagaagagataagggaggaggagaataagatataagggagagagacagtgggagagagccggtgggaggaggagaagaagaaaagataagggagagagattcacaatatcgagagagataaaaagacgcccacccggccggcttgtctccacctggctcggctcgttttaagatgtgtcggttttctaaagaaaccagcagtgcggcacctttaataaattaaaggttttttttcaaaaaaccagcatctatagtataggtgtcggtttttctttagaaccgatgcctatagttatataaaaatgccggccttttttgtgtttttagcccatagaggagggaaaaggcctataggtgctggttttagtatttccagtacctatagtgatggcatctatatgatgttcatatactaatctatcttgttgattttttttattttttccataactatttggatgagatacaaagtttagaatccactcccctatgatgccctcaagccatgccaatggcatcgtagatgacctcctatccctagatcgacgcttccaactgtgaccaagcagatggaacaccgccactgcaactagctaccagatctcaaccaaggtctccaagtctcaaggtacggatgtaagtgcgctgtcgcactacccatataaaaacccgtgttttagtttatttaatataaaatttaaaagaaaaaacggaaaagaaagcccactcgccccagctgcgcttgcatacctacctcgaggcgtccctcgcgtccaggtcaagtcccccttccatgccctcgtctaaggagtggacgacggacgtcacgaaacggcatgtgtgccagtcgtttttggttgatcggatcacgcggacggacgaaacagcgtgacattacatttttttctctcttgtttttcggcggctgccgcgtcttcttcttgctcctctggtaaggtgtactacctcacatgcctaatgagaggaaaatatagaagagcgcgttgacaccgttgactttggattttccgtctccttcctccgaagtgcagagaagaaaaggaggagctgagctgagctgattgcttgattcctcgctcgttcaatctactctaatctatctctataggaagggaaacccaaaccataatgcaaagccgtctcgcagaggagttgcgagcgctgaagttcgaccgtgtttggcggccaagtcctcatcgctcggaatcggatggcggcagctgcagctaccgcaactcgatccagcgggtcgtcaccgcgtccgttgccgccgcgtccaccagcagcaccaccctcgtcttcccgtcgagtggctcggtcacgagctcgtcttcggcatcctttacctcctccgctcccggctcggaggcgcacggtactccaagctccgggcccgagagctacaggttgctgcgcggggaggcgttccggggcctcagcgagatcgcgagtcatatggtcagcgacaggtacaccgagaggctaataacggagttctcccggccgcggctggggagcggcagcggcggcggcggcggcggcgacgagatactgcagacctggttctccgaccttggcgttgactgggttctcagagtcgacgagatgaacctgcaggagaagccatggagcggcgtggaggagatgatcaaggggtggctcgccgcgctcaccgtcatggcggaagccctccgtctgacgaaggccaccctcagcagcggcgatggcgactccggcggtgtcattccggtgcttccgatcgagaagtacaggccacagatatctgcaccggcgtggatcgacgacgaccacgccggtgttacattacatgatgtaagtcctggctctggctcgtcgaatctcgaccaagaaagctcagatccggctccaaacacgagcaggagcaggagcattgccattgctacggtcaagcaagctataacagcgtattcccaagcggcgtcatcgaggtcctacaggtacgaccagcacggagctgcagggcctgaattccaattcgcgctcttcgccaaggcaagcctggtgaagatgatgtgcttcccggacgctatcgccgcgctgagcagatcgccggagaagatcctccgcgtgatcgacatgtacgcggtggtctcgggcgtctccccgagcctcctggcgctgctccccggagcgaccaaatggttggtttccgagaggatcacggccgtgctcaagacgctgagcggcatgatgaggggcatactccatgatctggagagtctgatccgagaggaggattcgtggcggacgacggcgcaggggaacgacatccacccggtcaatcagtacgtgctcaactacatcaacctgctgcttgagaatcgcgacgtgctgaacccggtgctgcagaatcgcgacgtgctggtccaggagggcgaggacgacgacggcgacgacgagctgttctccatcggggagctataccagctcgcggaggagaaatcgtcgctgacgagcaccgtcgccaggctgatcaactcggtggacgccatgatcgaggacaggtccaagatgtacgcagccgccggcgggcggatgcacatcttcctgctcaacaacgaccacttcatactgcagcaggcggagccttcgttgcagtcgttcatgggcgcctactggtacgcaaagcggaagcagcgggtcgatcggcgcatcaaggagtacctcgatctgtcctggggaaatgtcgtctcgtgcctggggtacgcagggcagagccgcaggaggtcgtcgcttttccgtagtgtctcggcgctggtggagttcaactccttgttgcagataacctaccacacggagaagctctggaagatcaatagccctcagctgcgaaccgtgctgcgcaattcggtgtgcgggaaggtaatctctgcttaccgagcctacctggagactcagggacagggcggccagttaggaacatcagccacgtatacccccgaggatctggaagatatgttgcaaaatctattcgaagggtgaacctttcttttccatatatatggagttttgatgatgtttttcttcggcgagtgcatgatgtgcgcggaacccatgacccaaagccaacacggacatgatagtactccctccgttttaaaatatttgacaccgttgactttttagtacgtgtttgaccattcgtcttattaaaaaaatttaagtaattatttattcttttcatatcatttgattcattgttaaatatactttcatgtatacatataattttacatattttataattttttttaataagacgaatggtcaaacatgtgttaaaaattcaacggtgtcaaacattttaaaagtatcttcgcgttgttttgctactttacttgttttaatcaatcatttaaatgttcttctcaaccttactacaacgcaccaccgttttctgtcttcattgaggacggttttgtgccacgctggcacgcagacgaggcgttatcactgactcatcacaagataggcagtaaattaaccgcccggccgtgtccccttctccgtttgactggtcaatgcattctgtacctccccacttccgatccgtaaccttaaagcaagtttaattttatagccaacctctagctctaaaaattaacacatcgtttatagctaatctaataagttacccatacaacggatgaaagtgggctatttgggtatgcgtgccgtcagctcatctaaagcaaataaagatagcaccaacagaggttgacagcgacggcacactagaggcggcggccactagacgacttctactcaccaaatctaaccgttcagaagagtacgtatattgagaagcagaggtgtgccgacatcatttatttttcttttctttttggttgagtgttctcctccttgtcgagatgtgagtttaagtgctttttttttttctgtatatattcttcgtgtacataggggccggattaatgaaagcccactgtctaaaaaaaattatactcgctagtgcgtagtattgtagtactccatctgtttcaaaatatttgacaccgttgattttttagcacatgtttgaccgttcgtcttattaaaaaagttgtgaaatatgtaaaactacatgtgtacatgaaagtatatttaacaatgaatcaaatgatatgaaaagaataaataattacttaaattttttaaataagatgaatggtcaaacacatactaaaaagtcaatggtgtcaaatattttgaaacggaggaatactattttagctgggattatggtctggttggagttagattcccttggatatgctgtagtaattgattactctaaagtcacctttaatatatatattagcctcgggagtgattattattcgagtggttttgcgattatgagtttttttttatgtgcaagttgactaccttttgtgcatacagatcagtagatggatccatccactggacaagatgggtgttcggtttcatttcatgggagatttttttatgatggaaagaaggtgtattacccttagtgggttatatgtgtatgatgtggagaaactaataacaccaccatatgtgactgagtgaagggtattagaatctaagaacaaaaatgtgtcgcaatgatgcaatggttatggtaacaggtgttccagttttggtgaaaagaaagaaccaaatttttccaagacttcataagaatttctctaattggtttgctttactccttattggttttgctatttattgttttattttatgcaagtattatttttaagttcaaatgtcgtgagatgataaataatgacattgttacaccttaggtgtcaacttttaaaaaaaaatcaatcaccttttatgtaagcagccaagatagatatattttctcgttgtttattaatggatagattgggcgtgggacgtaaggctacgctaaattcaatggtctcttagagtcccattgttttacagagtgtgagtaacacccatttgggatcgattgaagcagcccagcagagcacaaatggctaaatataactaaagatgcatcattacttatgggatgtaatttttataatgcttccctaattcattcgtcttgcttttattatttgagcatattttcttaggaaaatcatgaaccaattgtattgtttggtctacctaaagacattggatttttttttatgttatggtttgtgctattcatatttgagttagttctttattttccacatggtgaaccctgcaccctggtgtaagcaaaacacaaaatctaagtgcacctgtcctggaaccaacggtgaaactatatatacatatttgaagaatgatgtataataacacaatatatgttgttaatattttaagtatttaatttatttagatggcatgcaaacttgtaaaatgcacggtctataccacaatgacatattgcttatatatagcaaaacattggatctaaaattgtcaatttaattataaataaagcaacattttagatagaatataaattagatatgtacatttaaaattatggtcagcttaattctaaaattttagttttctctttttaatttgataacataaagaattaggaagagaaagagatggagatgtaaaagaataggaagaggaagagatagggatagggagagcgtacctacgttcttttttttttccggcccacacttatacgaagtcatacgtacataagtttttttctttttatggcccacggcagaggaagggattattttcttaaataatagatctaatctaatggtctaaaataccgggtccatcaatttaaatgaaaatcgatagttagattagatagtgttatgtggcggtctaggagtgtttgtaagagtgacatgttgcgtcttgagagcgtttgtagaaagtttaatggatttatagtatataataaataagatatgaaatatgttttatcgagatgaaaccagcgtgtactatttctaattaatatagcttagctgttgcatgtattgcattgcatgcctatacaataacaaaaataaaataatacattgtatggattgtttcaaccgtcaaataaatgtcttattgtttagtatatggtacctttggaattgtaaaaaatggcatttcccattaaaagtggccttgagccacctaaaagccactgtgatgtatggatggaagttcgttgcactggtcgttccttgtaaagtgatggagtaatgatggcctaagagcaagtttcttgtaaagtgatggagtaatgatggcctaagagcaagtttaatagtatagccaactactaactctaaatcatttatagtcaatctaatagcaattaatacaatagttaactacaaatatatactacatcattaataattggtctcacatgtcatatacacataacgttttagagttcgtgttacagctggctacaaatctatagctcacttctcttctctctcatctcttatctcctccacatgtgcttatagctgacttataatctattattgtactccctcgtttcaggtcataagatgttatgactttggtcaaagttaaactgcttcaagtttaactaagtttatagaaaaaaatagtgatattttttatataagataaatttattataaaaatatatttaattattaatgtaataaaactaatttggtaatgtaaatgttactatatttgcctataaacttagttaaccttgaagaagtttgactttaaccaaagtcaaaacacttaaaacctaaaacggagggagtacctgctaagagtattgattattaatgacaactcataccattcagcatgccaacgtggcacaaaaccaccctcaaatgggcgcgatggggtattgtgtagacggagtgccttctttattttgtttcataaggacaaaaaatagacaactcaatattgagcgacataaagtaaacttatcccaaagtaaatgaatataaagtcaaaaaaaattgagttagaactttattatatttaagttgaaagttttatttaatttgagttaaaagcttcactaaatttgaataaagcacttgtagtagaatttaatttcaattgaagatgtcaacatcaaaactactctattcgtccaaaaaaaatcaacataggcaatgatggaacataacctatgacaacgaatctggacatgctcatgtacagattcgttatcctagttaatatcccatccttattcaggttagcgttttttggggacttagtcttctagatcagttctctataccagaatttcatcattacttgtcagcttccgactgaatccttcatcccctattggatttgaacattttgaaggtcattctaaaggacaaatatttagacaaggccctgttagaaagcaatgcttcaaattttctctctcacccatctctagtctatcagtacatgtcccattgttagtctagacttgccgaaaagctgaagagcgttgtcagtctagacttgccgaaaagcttaagagcgcaggcatgctaccagcaatgttctcctaacagtcctagtccgtagctagttccctctccagaaatctatatctttaccgttgcccactattcagttaaatatgtcctgaacttccatgataggtttccaccctgccatcatccgacatccccttctgttcagtccgattgaattctaactttaacctaatagctttctcaaacatggctaaatccttaatacccaaacaactgttctcgcttggcatacaaattattcttcaagcaaccagtcagtgaccattgttgacttctaccactcgaatataaatctgcatgctctctttcggtgcgatgtatgtaccttatatagaaatgctcattgcaacatatattgcacttttattagtgctgacagactattttatggaccaattggtccatagtgtgcataaaaatacatgcgcaaatttgagtcaacttattatctaattagttggcttttttactaagtaaccaacaaacaattctaaaatagtttttggcaatgatgatatttctttttccaatatttttcataattactttgcaaatgtggtgaccataaaattgttgccaaggaacatgcaaaacatcgacatatgggtgaacgtattgagaatggaagagaatagattatagggattgtggattgtagtggagtgtggagctagtgcatgcttatatatgcttccttctcgtgcatggttatatgatgtttccttctctttggttgattgcgatgtgcatgtttctcctcctagtcggtagccagttccctctccagaaatcta

SEQ ID NO: 3390 - DNA, 2740 bp, Oryza sativa
tatatccaaacgtctgagttttgcaaaaatatctccagtgtgcagcttctggcatatgatcctatcaacgaaataaccatggaggtatgctttctcaacatgctgaacattccacattgaatgaatgctgtcaagcacaatagtcttttgtcttgtgtaaataccaagttcaaacaggtttgtttgtctttcaggattgatacaagaattttcagaagatacatgagtctcatacccatcttcatggttataaatgacaatagagagggaccgtattggtaaggttgtcttactaatcccttgaaacgaggtttctgaacgaacagtaattccaagggactgcaatttatccatacgcacaagctcattaattggcgcctcataggatgagcactgcagtaaattaaatgagcaaacatccagcacctccaaattctggagttttggtagtataccatttggaataactagatttggattattccgaagatgcaagtgcctcagtctggtaagacagcctaactccactggtaccgtttttattctgttatttgacaaattcagatatcttaggttgacctgcatgcaaatctctacaggtatattggacaatttattaaaagagagatctaggtactgcagtgaaagcaacgaggggaagttcccgaaagaaccgtcttccaaataattgtgctggagtatcaagacttcaagggttttttgattgctaggaatacgaggcagttctgtaattttaagccccactaatagaacttgctctgccaatccccaattctctttggtttggattctccatttgttcttgtcctcgccttgactgtgtacaacccataaggcaaaatcacggattgtagattgcatttgcactgcctctccatcttctgctggctctaaaaggcaaaattcttgcaaggtggtaatatgagagaaaccttcgttgtaagacgcttcaatgtcatccccttgtattaatcctgaccctatccagaagtctactaatttccgttgattaaatatatggccctctggccataaagaacacaacttaaagcaatctttcagaattcctgtcaagctgtcatacgcaagttttaatctgaaaaatgttgcctcttcactacctgaccattgagtgtcacgaaggcatgattcagtcagataatgaagggcattttgccaatatattgcatccttcttattgtgcatggcctttccaattgttaccagctccaaaggtgaaccaagcaattccgcggaaatatttcttggcaggtacacatgcttatggcccaagtaatcaagatcagcattctgcttgaaaatttcccatgattctgtatgatcaagacagtgaacctcaattctgttctccacttccacattcatttgatcacagacatggctagagcatgccgtgaaaaccactcttcggttgtagcagcttccaaccaagtcaagtgatggaatcccaacttcttctagatccagtctctgccatacacagtcaagcaataaaaggaaatttctctccttcaagaagtcgaaaattcttgctctatgttgcatgccgtcacagttagccaacatgagtttcttggcaatttcactttgaacctgaaagtggccaagagttacatgctagaaatgcatcttatgatggatatggaatgaaagggccaaattgtttatatctgtccatgcaatggttgtcaacaacatatccagtgcaaagtatcatacatttgctaaaaaaaattatatatttgtagatgtgctatttctcttcattttgtaaatacctcaactgaatatcctacctctcaaaaaaaaaactgaatatcctagtgttatactactcgcaataaatcagtatgcatgtatagatagtaccttggctacggaggaatctctcggagaggcgattcgcagcacgagatcgaaggtgtcatctcgggagaagtactcctcaacgagcttgagtaggtaagtcttccccaagccggcgcggccccagatcgcgacgatgccgttgggttggatcgtcctcaccctctcgatcgcggcccggagggtacgatccctgctcgcgaaccccgtggagatctccatcggttggggcagcttgctcctgcgcacgatccttcccccttcttcgcacagcctcttcacctgcggcatcatcagcgacgcgaccttgctgacgcggtagcagccgagcagatcccagaagatgagcctggggatccggccgtgcgcgctccgcagctcgccgaaccggaggaggtagatctccgcctcctctgtccaggctgccgccgtcgccagcctcctgccccgccgcgccgccacgcgggccctcgtgcgcacgcagtccctgacgtgcgccaggtgctcgcacgcgccacggaggacgtggaatcgagcgccggcgaaataatcccggttcctcaccattgctatcagtggagctagctcgagctccgtgctccatatgatcgtcgcggcgtcagatggagtcgccatggagaggcctccttcgtggtttctccaaagtcaaaccacggaaccgccagctctccacttttaatttccggtgtatgcccaactggggattcctatttagcgcgcgctagcgcttgatgggtaactcgcgcaggcgcgcacgtaccatcggcgccgtttttcttttctttatagagaaaggtagggctgcaggaat

SEQ ID NO: 3391 - DNA, 2927 bp, Oryza sativa
aatgtcatgaatcagctcaacattgccacgtagacaccacgttagtgaaatagtcctctaaaactgtcaagggagtcaaatttgatcgattttaatagttgagggaggggccgatatatagttaaggaagtcaaagtgggcttattccttagggccaaccgtgtaacttagggccacatcccactagcccactagacatgaaccttacccaacaaaaatattaggggcaatttcattcttgctcctgctcctgttttgatatatacaatattgattttgctcctattttttaggatttcatttttgcccttgtttttttaaacaaatccaaagtttatccctattttgggtggacatgttgacggtgttaaatctttggcaaaaaagacatccatgcccttacatgctattgcacatttgacactattttttttatcatttgtgtatttgcttccatttgtacaagtagcaattttgataaacttccacaagcgtggcaattttgacatactatggataaattttgatttaaaatttgacataattttgctagaaattttgacacattttgacaaaaaaaaaagaaagataaaatggcacaaattagacacattctttacacaacatatagcaagcataagaaactcaagaaaatccaaaccaaagtcaagcaaatccaatctcgcaaacatggtatcgcggccgttgccgctgctgccgtcacttcctccccatgctgcgtcgcgccgtcttccaccttggggacagccgatctggactcgggggctgtttggttgtttgccacactttactacgccacactttagttatgccacaatttcttacgtatgtgtttggttcgctacggcaattgtgtcatgccacactttcatagccttgggacccacatatcacactctcaaatttgaagctaagcttgccacacttgtggccaactatttttaagccacactttgtgccaccatgcctcaactagcctaaacttagttacggcaaggttaggcatcaaccaaacatccccttggtcccctcaatctgcagggtcgctgttaccatcgtcgtctcctgctcacatcccaacaccaacacaaatcctccccacagctcctcccctaccgccgccaagccccttccctgccaccaccttcaagcccccattctgctgccgccttcaaaccccttgcccgtcgccgcctagccccctcccagccgccaccaagtcccctcaacgccgtcgcctagccccctccctgccgccgcctagcccgcgcaaagtgccggtgggaggggtctgttcctgactgacgcacgctcgccgccacttgccgcgccgccggatggggtttctttcgggagtgaacccgtgcacacgagaggctggaaggtttcccctacttggatatttcctaagggtaaaaaggtcaataacaaattaaaaaaaatattttctttttttctctatttctttactgccataaacccggtcccactcaattccgtctaaaccttacccttttggttaaaaaagtggggataaaaacaaaaaccctaaaaaaggtaaaatcaatattagacatggcagaaatgaaattatcccaaaatattatcagctgatagttaaatatttctacttttgagataggattgaatgtgttcatgagccaagtcctgtctttgtatcccactggtctctggcggcttccctagagcctctggttaatggatttgttgatcctatgtcaaaaagaaaatttctgcttttcagatactccctctatcctataagacatggtcaaatttgacatggtctccaaaactaatatttgtcttataatttctcatatattatagggaaaattggaaccatgccattataattttgcaaaatttgagatatgccatcctgaccatatgaaagtaaattcaaatgtgaatccaatgatatattttttagcaattaaatttaattcatattgtacttgaatgttggtcaaaatattttaaaggtagaatctggaaatgtgtggacaccttatattatgggatgggggagtaggatctaaatcaaaatcgaattctcctagattaattcaatagcatcccatttggccatttgcaaaaacttgtactagtacagttgaagccaattttgacatactattttctcttttatggattgtagtatcaaattaaagcaaactgatcatgtttgatgaaccatcattagttcaaattcaaatactcctagcattatgtttcaaatgattagtcccatttaggcccgttcgaatcctctataaatgaaggataaactttgattttcgtggtacgcttttcaaacggttaaacggtgtgtttcgtgcgaaaactttctatataaaagttgttctaaaatatcagattaatccatttttcaagtttgtaataattaaaaattaattaatcacacattattactacctcgttttacgtgaaacacttgatattcatctttatgggtctgtttggttcacagcccaaaccagccatcaagttgtggcgtcgccagagattgtggcgagagaaataatcgccacagctgtggcggaaataagcatgcaaatgaactagcaaaaagtgtggctgccacaactcacgtattaatcaaacatcagtcaaactgttgtggcagccgcatgtttggcgaggcaatgtgtggcggggatccaaacaccccctatatcttcagaaattcaaacaccaccttataagcaactttgagtgtaaaaacaaagaaaataaaaggagagctttaaccccctcctctctgccttttcccacgagtggagtgaagcggaggagaaggaagcatcgcatccgcctccgatccggcgatggcgagggcgccgccgccgctgtcgtcgttg

SEQ ID NO: 3392 - DNA, 1883 bp, Oryza sativa
  unsure (1)..(1883): unsure at all n locations
ccatgcatggtgtctttgcaatcagtcaatcgtgggatcacattattcatcaaattgctggttcttatttgttacgtttagttcttgtttgttatgcatgaatttggtcggagaaaggatgcgatttataggacaccattccataatgaacaatgaggcaatctgcaaaatggtcatctagaatctatgtgaaactcagtttcagttttagaccttctcaagtattataagttacagatttgcagcattttcctttgatcagcagtagaagtttcatttacatgttctttactctcttgcttcttttctagcttgcttctgaaatctcaactttatttaggcaagaaggggacttggcctcacagcagatattattgatcattgcaagctagtccttagatttcctaaaggaaccaacagcacttgggtaagtattccctgtcatgttcacatgcagttacttctgttaacggatttgtgtccttcaacaaaggtccactcaagatatcacttctcttgacttatgcagtacaacactcagttcaaatattttgaaccactagaatacaactatgatgtctgtgaaactatccttctgtgggaacaggttagtacatggtttatgaattatgaaatagcgtgtttattagaatatatacttatgtgttaatgctaatatgatgccagtaccgtaacatgacgactgtgttgacaagggagtacttagatgtgcgacctgatgggtggttggattatgcagccaaaaggattgcacagctgtaagtttgatacttgttgcacatttgcactattcttcgtaacgaagtgatattaatccgcatactggttaatgtgctttaaaaaatatgcagcggtgctgacaaatgctacaatcgtactttgtgcgaagagcttcttagtgttttactccctgctaagcctccttttcatcctcgccagtttgcaacatgtgctgttgttggtaactcaggggatctcttgaaaacagagtttggacaagagattgatgcacatgatgctgtgttccgagataatgaagcacctgttaataaggtaatctcattgagttcttcatatgtatctaagctaacacttcatatgtatctaagctaacttatgtgaatggcctattttagtgtgttcttgttgaccccgtaggcagctaagctcctcctgttaagttattactccattctctcttcttaatgcctaccctgaaccccttgccatcttattagcttcttgttattttaggtgtcttctatcctaactccggacatctaaaaattatattttcttctaaagttggcacagattgacactcgtttactaattttgctcttattttatctttggcctgcagaagtatgcaaaatatgttgggttgaaaagggactttcgactggttgtcaggggtgctgctcgaaacatggcgccaatactaaagggctcctgtaatgctgtaatcctggtttcttccagataacttcaatcctgatagtgttttaatttactttttcataaatgagagaaaatataatattcgtattggtgttctctattatcctcgaactattagaaagcacatggcaatgtcgttcatttctggttttcgcaacttggaagatgccttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3393 - DNA, 1658 bp, Oryza sativa
cccaaatattgtacttgtgtgatccagatgaataagagcaataccggctttggccaacaggatgtagggttattacctgacaattcaggggcccgaacctgtataaaaatcctcgtctccatctcttttacctcagtctcgcgtatatcctagtaccaacgatccccatactatgcaaataccggaatcgcgacatcaaacgtcgacagtggcacgccaggtaggggcattttggtgcttcaggatttcgacgagatgggttcaagagatggattctccaacaaaaagctactcgacgacttcggctatggggagatccaacctgtccaagtacatcttccgactagatcggaaccatcatcgtcatcgacaacttggtctatcgagatcatccaagcctcaagatacgcggcgtaccaaaggatgtcagatcatatgatgtcgaacgagtacgcaataggtaattggtagattggttttccaaattgatctactaatttcgtagatacatccggcatgtagctacaaaggtatgcaatattttatatgcaatttatcgtatctattcagatcatacaacattgtcaaatcaataatttattatgtttacccagagcatgtgttttaacaatatctgttgcatgggtgtccccgatgttaaatcgactacgatctaacgctgggggctcgctctgtcttgttctgtataaatcatgcttgtttacagtctacataatgtctgacattttctgctcgttatatcctgataatgctagaagatccatgcagttttttgagcacatactcgatattctatgctatatgcttgccttctagaaaatatttttcaggaacaattgagcactcgagtaggttgtggtcaagtacattgcattatcgagaacggtctcgacaaatgcagagtcgtcgcgcccaacctaccaacgaagaccgacgacctatctcatagcaccggccatggctggactactcgagaaaaggtcgttaacggacaattctcgcgaacgtcgtcggcttgatctcccgacatgattgcgaacggacatccggatatgctataagttgggtgcgtgagtcatgttggccacatgagacgcacatgtaataaaccaactctagcacccccattggtgttcgagagataattctaaacgttcattcgctggtcctcgaaccagtacgtagccatctctcacaccgcaacttccattggtgttcgaagagctcgctggttctcgaaccagtacgtagcaatctctcacaccgcaacttccattggtgttcgaagagatgtttctactcgctcgctggttctcgaaccagtacgtagcaatctgccgcaccgcaaactccattggtgttcgagagatgattctactcactcgctggttctcgaaccagtacgtagcaatctcccgcaccgcaacctccattggtgatcgagagatgattctactcgctcgctggttctcgaaccagtacgtagcaatctcccccaccacaacttccattggtgatcgagagatgattctactcgcttgctggttctcgaaccagtacgtagcaatctcccgcaccgcaacctccattggtgttcgagagattattctactcgctcgctggttctcgaaccagaa

SEQ ID NO: 3394 - DNA, 2214 bp, Oryza sativa
aggaaatacaaccagagttctacatggaaacgacaaggactactcggattgtatccatattgtttccctagttctacttggacaaagggacacctatgggtataaatacaagactccctatgaggagaggagagagaacatagacacacccaccacaatctacggaacaatagatcaagacacatgatcaacatacaagccaacatacgccaagacaagacgccggatatcgacttcagagataggcacggctagtcccctacgatatctccggatactgataggagagacatcgcgctgtctctgatctcgccaggcacgaactcgaggaggaagactaccctggtatcgactacgagtcagatcttcagaccgccatgtcgacaacagttagataggctaccccaaatattgtacttgtgtgatccagatgaataagagtaataccggcttcggccaacaggatgtagggttattacctgacaattcaggggcccgaacctgtataaaaatcctcatctccatctcttttacctcagtctcgtgtatatcctagtaccaatgatccccatactatgcaaataccggaatcgcgacatcaaacgtcaacaaaaaggcatagaagaatacgcttatttttgtgcaaggaaaatatgcatgttagagcaagctagaaccacatatcaagaatattaaagaagagagaaaaaaacgaactgtagatttgttgccagtggcaatacagacttgaagacgttgtgtgtatatgagaggtgtgaccgggtattaatagattagtatatttttattcgtaactattatataaataggttattagattagttatactccctctgtttcacaatgtaagtcattcgagcatttctcatatttatattgatattaatgaatctagacatatatatctagattcattaacatcaatatgaatgtggaaaatgttagaatgacttacactgtgaaacggaggaagtagatgatttatagatatcatttggctatactattaaacttgctcttacctttaatcttgatttttggccggaacagcacagggacgcttatcgattttattagatttaggaggaataacttaatctcgtctcaaagcaaaatatttgttttatcccataggtaaatatcaaaaggaaatatgggtctaggatttgacatgctacttattagtattacgacatgactatgccccattattttatcacgcaaatatagggttctcaatggctgtatttagttcaccaaaattaaaagtttggttgaaattgaaacgatgtgacgaaaaagttagaagtttgtgtgtgtaggaaatttttgacgtgatgaaaatgttggaagtttgtttaaaaactttggaactaaacacggcaaatatatcctaagtgaaatatactaaagtgtagaacaggaagacaacatgatccatgattgtgtagaccacgaaatactcccccatctcacaataagatcaatttttactaagtcagtttgtccaaaaagaaaattatttttaaacaattattgaatcggagttaatgaaattggaaagtaaatgcattagaagcgtgttcagtgaaaaataattacattaggatttgataaagtggggtattgtagtcttattgattttgtattattttggagtaactaaaatttttaggacggcgaaggtagctagtatcactgaattaatgataattccagtgctcttccgtcctactcatattaagagctcatttgaatcaaaagatttatataggaatttcataggattcaaattctatagaaaatttttctatttggccctttgattcaaatgattgaagctttccaaatcctatgaaattcctatggaatgacatattacatatggtaaaagcttcaacctccaggcacggggttaaaataatagaaatgactataggacatggagaaagtggtgaaatgactgagtactgtggttacattaaagaaataatagaaatcagctttgatggcaccaaacctctcacacttgtgctcttcaattgccattggtttgacccaagccaagtctggtactcgcaagatatggccttgtcgaagttgctcatgcatcaatccttctcaagtttgagccatttgttatagctcatcaagcgacacaagtgtattacatgccatacccatgcaaatctg

SEQ ID NO: 3395 - DNA, 2963 bp, Oryza sativa
tgcagccaattggtagattagaagtacccactgatcaagattatgattttgtccccaacactgatgttgtccactatttccaagaagatggtctgctcggcagttttgtaattgatcttggtctgaactttgataataattctgaagaggttgcctccagtagggatctgaagatatttgcaatggcaaggacttggagcttctcaatggatcatctattcaagatgtcaacgacgatgatgacgagtcttattgtactgactcatccaatgaagatgatgaatatcccaccaatagggatatcttatttgatgaatatttctaaggtaaagacctcaatctgagttggaggccaatctgccaatttgttatatcctacatctgtaaatacatatttatttttatcaaattgcccacaatcgagctttcataaactaatgtgtactgtaatattatttgacagctaacttattttttcatacttacaggcatataatgatatggcaaaggactagagtttatttttaccatcaatccggttaagacaaccactagtgtctattgccttcctaggagaggtgtaagaacttagactgtagtttctatggcatcatgtgtacctagttgttggatgtattcatattgtgttcttctatcatgttccttttagcactgagaatctgcagctaattgtcgatttctaggatcgacaacatattttatagggtgcgctagatcaaagaaagaaatggtgacacaaatgttatactggttcaggccctcgacgtgaggtaataccctagttcagttgtatatggattggatctgtgtccggtatgaagagtggataatgacgcaaggtgcagccatcatccgggttgtcgagagtcatccctcgtctcgggaccccttcccctcttatataggatgaggggggagggttacaaggaaagtatctagttgattgcaactagatccctctattccatctataaaagatatgtaggatcctcgggatttatactttatcccgggtttgtctatttccttatttacaaggcagccatatgggcctatggcccttggcccaccgtatgtcgcagggcccgaatgcctctccttgggtacccgggtaccgtgtaacccacagaagccagctgggagagacaagactggctgagtacttgtagacccccgattttggaaattggaaatcttctgtgtttatccgtaccaatccctggatcagtagttggtacacacatacatagttggatcacaacatatcacgaatgaatttaggctaaaagagttaaatacttacattagggccaggtaggctaacaactatcagagaacaacagcaaaagacaaaataatataagggcctggttaacatgccacaggcagtcgaccggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccacaacaacaatgcatatgatagagggtattcaaggaatggtttcaggttcttttgcataaagctgcgttttgcaaatattttcacaagcctaagacctatcatagactgatcaaattttagttccagtgttcacattaaacaacgacggttctgtctaccatccattgtgatcccaaggatagcttcccgccattgagtcgtcatggttttttgaggacgtccacgttccctcctctcaggaaatggctccatcagcataaaaatcaccatgcaatatcccatcctacacaagttaagaatttagagtctagccaagtgtaatacatgtcccggtgctcattaaccgcgagcacggctattcgaatagatttggtttactcacactgcagtggatgtacactttacccgcactccgcgactgcccaacacatgagcctcgtcccaacacatgagacgcgtcacgacaaagcttttcgataacctcgcattggcagtacccgctccgtgaactttacatcctcatgcactctaggcgcacacggtttctagcagtgagaggagttctggcgcacccgggagggaaagacttacacatgcattaagttataattatgtttaaattctcacatgacagtcctaccaatggcgacaccactgtagacacccgcctcgcggttctacctatggctgccccaccgtagagcccctgcctcacacatcaagaaaccactatgcatggatactgcctccgctcagccatctactccgccaggtctatacccatacgagaagcgcggttgtacgggggtcgtttcatgcttaacttcatggctcggtccttaattgaccagggacggcactagccttttccggataccacccaaatcctctgtccgccccagtcgaaaatagttgttttagttttatttctcttttcacaaatcatgtcatcaatatcatggcaatgtggcgctcatgtctccacatgccgcatctcaattaccttcccaaaggtaattgcccaagcataaagcattttgataaatatgagtatgcatgattctagaatagcatttctaagcaattgtcatagttgactagggactcatacgtaaacatggttacgaaggaataaggggtaaacaataatcaaggcatggcataatcacaagtaggatgttcatcattgcatgcaattttatttgtatacaaaacaatttcgcaattgggatcaacatgttcaaggaatagtgatgacttgccttgctcaggatagtccttattcttgatataattcttgatcaaccttcacctcctggaagttgctgacgttgcctcacgactatccgatacacaaagtctataatacgcgagaaaaaccaatattcaagcaacaatcaaatat

SEQ ID NO: 3396 - DNA, 2002 bp, Oryza sativa
taatggctatggaaggattatggctacacatgcatctatctaaataaaatggtcgtatactagaggttctgttgtcggatggatttaggatcaatcaaataatacagtgaatcatttgtattatttattttattgatggaagctttactttaattatgaacatattttacttgtcacaataaattataaaaggttaataattatccatgctttgtatgttagagttgtttaggttaatcatattatggttacagattatcccatcacataattttacaatgaataatactaatttacagttgaactataattataattatatgaggtcaagatttataactagtatttatctaatatacatgtttgtcatacactccctcttaatttcatatatgcaacacgcaaattaatactataccgtaccactataatgggatgtatagtatatgtgtaagcaacaatatcttattattggatcatatatttgagtagtttctttttactgtaagctatacaatacatgttgattttaagatggctctatttggttaactaatggatatcaaccgactatatatatatatatatatatattctacttcacatgacatggtatcaactaattttttttaagtggtccaaatacaactagctctgtgattactctcctaaacaagttaaagattcatctatatgtgtttatagtttagttacaaaatatgaggctaaactttatgtaaataatttataagtcatggaattagttatatttggacataggctagtaaatggcactaatattttcctttacatccattaatttgaaggattgattataattaatttatttggttgctacagtgacaagatatattaaagataattatgctactgtacaatatccatttttttatttattggcacactatttaggttaactattatctaatcatttgatattaattaatttataattataaatatattttattgaatagtgaattatatattattggaaagcttatgaatttagatgaatttaggttcaagtttcactcaaatccgagttaaaatgaataagttatgctagtgtaaagattcaaatttgaattaatccgagaaattgcgaaaagctactgttcataaacgatttatttttaatccaagacatatccattgacaagtgggaccccgggtttatcctttttcctaccgaattattttctaaagggaaataggaagagctaatgacaagtggggcccacatgtcataaactcgagaccaaaaaaacttctataattagatttttaaccacccggacccacatgtaatagattcaactaataaagattaagaaggggtttactattcactaaacacgtggggcccactctaatctctcctctcctttctctctctcttttcttttcttttcctttttctctctcttttcttttcttttcttctcctttctctctctctcttttcttttcctttctctctctctcctttccggtttctctcctccttccctcttctttctctccctcggcttctcccttcctctctctttctcggctccctctctacccggcggcacggcgacaaataggggggcagcggctcaccgacggcggcggtggcgacgacggcggcggcgacgacggcgcacggcgcggcacactgaggcggcggcgcggcggtcacgaatgcggcggcacgacagcacgagggcggcggcgcggcggctcgaaggcggcgacgcggcggcgcgtggagagggggaagagggagaggagggggaagatggagtgaggagaggggagaacggtggctcttataggggagagagggaataaggggaagagggaagagaagggagggggtgacgcgacggcggcgcggggctcggggcggcgcggggcttggcgcgcggtgagggcgacgggcgacgcgacgatgacggcggagcgtcgacgggacggcgacggggctgcagga

SEQ ID NO: 3397 - DNA, 9197 bp, Oryza sativa
agagagggggaaagaggaggggctgggttaggggaccacgtcgaacacctggcggccgatgaatagtgtcttttcctatttaatccccattttagcctatttcttgtgtaaatttgattctataaatcctagattttgtataaatgaagtttacccaatatttgtgtcattccaaccaatggatttattctagattaatattattcatattttatttatataatttatttgaatttttaattagggttaattcttattattattatatatttttcaaagttttcctatttttcttcttttagggttttggttgatttataaattgagaaaagttgcaaattaaatttgtatttactcctaagcatttaggtgaccgtattaagtgttcaaatgtgaatttgcccaaaatttaatattgtccaatatttaaggtttattaaagattctataattttctaatgagaccgttattaacacaataccacattagctcaatttatttatatgttagtttattttatatggaggggtttaatatatcaaatttcaatccctaaatgcaattaggaacttggtgcaaaatcgatctacatatcgaattaaatactcccgtaattctattatatatatagagagctcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccgtaaatcatatctattgcttaaatgtagttcttttctttactttcttggtgatcatttacggtttggcaagcaatagcaatcataacaaccagcatgatgcaaaagttttaaaaagttcgaaattttcgtgattttcattgtcttgaattttaaggatgttacagtactcatccccagcgttgccgagtgatacttgttgtagccgagtccttgtccaactgactagccaaataatcatcttgttgaagaagtgtcgtttctgacgtagaggcgaaaccagtcttctcggagatgaaagccttcaggcggcgacgaagtaaccgtcctgcgcggagacgacgtcgcccgacggcggtgtaggtagccggcgtggtggtgtaggccctcaggtggcgacgaagtagtcgtcctgcacggagacagcgtcacccgacagcgacgtaggtggccggcatggaggcgcaagccttcaggcggcgatgaagtagccatcttgcacagagaggacgtcacctggcagcggcgtaggtggccggcgtggaggtgcaagccaccgggaggcgatgatgtagccgtctagcacggggacgaggtcacccggcggcggcgaaggtggccggcgtggtggtgtaggcctctaggcggtgacgaagtagccgtctagcatggggacggcgtcacccgacagcggtgtaggtggccgtcgtggaggtgcgagcctccaggaggcgatgaagtagccgtcctgcacatagacgacgtcatccgacggcggcgtaggtggccggcgtggaggtgcaagccaccgggcggcgacgaagtagctgtccagcatggggacgacatcacccggtggcggtgaaggtagccagcatggtggtataggcctccaggcagtgacgaagtagctgccctgcgccaagatgacgtcacccggcggcggtgtaggtggccagcgtggaggtgcaagccaccgggcagtgacgtagtagccgtccagcacaggggtgacatcactgggcagcggcaaaggtggccggcgtggtggtgtaggcctccaggcggtggcaaagtagccttccagcacggggacggcgtcacccgacagcatcctaggtggctagcgtggaggtgcaagcctccaggcggcgatgaagtagccgtcctgcacatagacgacgtcatccggcggcggcatgggtggccggcgtggaggtgtaggcctccaggcggcgacgaactagccgtccagcacagggacgacatcacccggagaaggccataggtaaccggcgtggaggtgtaagcctcccggcgacgaagtggtggccaagtaaggctaccctccagggcacatctcccgagtacgcccacccagacctgggtctcatgcccgatcttcagcaaatgcaagtcagtagctatacctagtaggcccctgactccatgtcgcaatgactggggtcatcgcggagtggagttgtcttgacgaacttgaagcgaagccgggtagcatcctgactccgtaccggggtgactggggttgtcgcggggcagagttgacttgaagaactcaaagcgaagccgggtagcgtcccgactccatgccgggacgatgtaacgccccgattttcgttcgggattaaaaatcattaaatactacattttctagaaattaaataaaaattaaagcaatttaatcaagtgaattatcgagggaattaaaatttcctttaaaaatcatggtcggaaataatttgaatattctctgtgccctaatgtactctctgaaatttcccgtgaattttcggagctcaagaaataattttaaaagcataaaattcatttaatcaattaaaataaaaagagaacaaaataaacttcccttcctccccttgggcccttttttcagcccaagccctcctttccctcctccctctctcggccggcctcccctctcctctcttgggccgtctactcattttccctctccttcagcccgccctcgtgaaaatctactttgccctcctcccggtctcccctctctctctagccgacatgtgggacccgaggccccacatgtcagctcctcctccttccttcagccaccccgcaagcaaccgccatggctgccaaatccacccacgtcgtcgctttcatcgcatggttccctctcccgtgcgtgcgtgggcgtggtcgccgcccatttccgcaccgtttcctctactctcctcgcaaaatcctgccatgccaccgcctccctcatctctctgtctccccccacatcgccggcagttgccgccctctaccgcctcgcccgaccacgatcccaatcccccgagcccataaaaacgatccccggagctccctctctcatttccgctcctctccctctccaacaacgcgccaccgccgctcccgccgtcgccgcatcctgccgctggcgccaccggcttcgccatgccgctccgcaccccagcacccactccacttctaccttccacccacgaaacaccatctccactgtgaatccccagtgccgctgccgttctgcacttcggtcggccaccaccgccgctcctagccacctcaagtcgcgccgtcactgccgtttgcttcacctcatcgaggagtgccttggccgcccttctgttttgccccaaccgctccggagtggttgcctcctcgcgaaaggtgagctccatcattccctcctcttctggccggcgattgacgccgcctccccctcctctaacccttcccccttgttccctaggttccgccggttctcggccacgcctccgccgcggttgggagtcaatggagcgtcgtccccgactccaacccgcaagcaccactgccgtctctcatcgttgagctccccgcgtcgcttccttgcctcgggcacttggtgagcacccctctctcatccccgccgccatcttgcgccgccggtggccgagcgccgccgtcgcgccatggctcagccgggccagctttgagccgcgcctgtgccctggccgcgccactctatggccgcccgatcggttttggccgatttgggccgtcggttcccgtggaccggcggtggaccacctcgtggttctggtccacggtggaccgctccccttgacccactgacgtgtgaggcccgcctgtctgcgccggcccctttgatgacgtcagcaacagccttttctttgagaaaatatttaataattgcatcataaatcgatgttaattctagaaaatcattcaaatggctcaatacttctaaaatttatatctaattcatacgaactccaaattgggccatttaacttgcaaaattcatctaaaattgagatctacatgtttgtttactttttatatactgtctacttggtttttattagagtttttcctcgttttgcgtgccagactgtagttttcgccgtttcggaacatcgcggttgcaaggataagagttcagaagattgttttgaagaagcaaggcaagtgacacattcctcttgagcatattgagcctactttataaatattttatcatttgcaaatgaaattgcatgtcttgttaattatgtgggatcagggtattacctatctgctcgcttgtgccatgtttacttgatatccttcctttgctaaatttgggtgataatttgactagttcgtgttacttatgtgacatagctagaactataggcttagccatgcttaattaccactagctcagttgatgggataattacattattatacatcttagtactcagatgagctgcgtgctcgagacatccgaccatgtttcattggtcgtaattatccaacaaaaatgcgacttaatggtgggctatgggtgcatggttttgctagtcgcacccatggcaattaaggaccggttcgcgggaaaccctggaagaattcatcacgcttaccacaagccagtgtgggcaacgactgggcttgtagtgtagcttttctctagctgacgtacccaggctagggtgggcgtgatggagttgggtcggtcggggtgttcggttgatcggctttcggatccactgtggcacgatgggggctgcccgttgcctactagggatgggggcgaaaccggaggtgtggtgcgattggttagagggggttatgcgaagggtccagtcacggcgtctttctggtatgtcgtggtggcatgtcggcgctcgaaaacgtgtcgtgggctgtgtcttgtgggtacagttgtacacctctgatcagagtaaaactattcgaatagccgtgcccgcggttatgggcggtcgaccagattcaccgtgattagtctcacccttaataaatcaactcaatgcacttagtttgagtgggatggttgggcctattcaacgtggtgtaccgttgatcaatggagatttaatgttaccttaattacttaactattttactgttttgctcaataaaatattttacaaccgcatttatacaaatagccacaagccatccttgtatccccttgcacgtctgcatcgttagtatggcttgatgagtacggttgttatactcagccttgctattgttcccctttttagaagtaatagcgcttctgagctgaagacgaagttagaagactaaggctcagaccccagttgagttttgcctgtggagtggagttgaagccccgctaggatcgccttttctgctgctgtcgttctctttcggtctgaggactaagtgcctcttctgtaagtattttatgctttatttacgtttggaactgtttattacttgtcgttttgtgtaccctagctgattcctagacagcgatttaatacacaaaatagtctaaaaatttgggctaaatttctgggtgtgacaaatgactgggttcatcgcggggcggagttgacttgacgaactcgaagcaaagccaggtagcctctcgactccatgccgggatgactggggtcgtcgcgggttggagttgacttgatgaactcgaagcgaagcccggtagcctcccaactccatgccgggatggctggggtcgtgctggggtcgagagtgagtgatgtaaggacctgtgccaggctcctagatgcgcacccagcacctgcggagccgggctctgaggcaggagatcacaagcctcctacgtggcaataccaaggaaacaaggaccgtgaagcccatgaacccgaggtcttcgctcaactcctagagggctctgaccagggtcgggtgatggcctaagggtagtgggcccccgggtgtggccgtacttcatgtgacgggggccgtcggacctgaagcctttgctcaacccctaggtggttaccggccacctgcggggccgatggtataaggaacacctagcttagccgggaggggcatggccagggcctggcggttgccgggagatttcgagccttcgggcgtggcagaatttcttgtggtcaggcccggcagcgtgtgatcttcacctcgtgccttgacggttgcggtccgctggttggcgagggagacgctcctgacccgataggaagggtgagtgaaggtgtgacctatggcactcggtttagcctctaggcttttggtgtttgcgcggcggtcgttcgtgctgtctgggtgagggcggagctcccatcgtgcggcatagcccccgggcgtagtagtcatgcccagggcggagtcgagccagccaggtgaaggtggagcccccagcgtagtagtcggtgaagctcctcgtggcagcgtcgtgccgaccaggtgaggatgtagcccctagcgtgcggcgaagcccccgggcgtagtaatcgtgcctagagcggattcatgccggcagggtgaaggtggagcccccagcgtgacgcgtagctctcgggcgtagtagtcggtgaagcccccggggcggagtcgtgctggccaagtgagggcgcaacccctgcgtgaggcgaagcccctgagcatagtaatcgtgcccagggcggagtcgtgccagtcgggtgaaggcggagcccccgggcatagttgtcatgcccagggtggagtcgtgccggccgggtgaaggcggagctctctgcgtgcggcgtagcccccgggcctagtagtcatgcccagggcggagttgtgccggatgggtgaaggcggagcccccgggtgtagtagtcgtgctcagggtagagttgtgatggccgggtgaaggcggagctcccaggcgtgcggcgtgcggtgtagagcccaggcgacgagagaggtgaagccccccgagcctgtagggaggttggtgaagcgtgccagctgggtgaaggacgaagcctcccagcgtgcggcgtagcgctcaggcggagaggtaggtgaagcccccgagcccatggaaaggtcggcaaagcgtgctagccgggtgagtgacgaagcccccggcgtgcggtgtagcgcccaggcggagaggtaggtgaagccctcgagcccgtggcgaggtcggcgaagtgtgctagccgggtgagtgacgaagcccccggcgtgtggcgtagcgcccaggcggagagggtggtgcccgtggcgaggtcggcgaagcgtgcttgccgggtgagtgacgaagatacccggcgtgcggcgtagtagatgacagagcctcctgtttgtattggtggagccgtggggcgtccaagtggtgccgatggagaataatacatcgttgatgtggtccgtcgatcgtgttttcttctgagttgtcttgcatacaagcttctatacggatgatgatgatgtcaggctgatgtggcctcgtctcattggttggccatgttgccatgcatgctcctgttgactgtacgtgcaaatttcaaaatatataatatttttctcgattttgtatatatatacatgtttctaaaaattttacgaaaatatacctttcccgctgataggtgatgcggcaccgtacctttggcgcacctcagaaacacgggaccggctgtaggggggcggtcccgcggcgccaatatgcgctgtggaagaatctaatatgttgtattattgtgttttcttatattttctgatatattacatctaccctctcatgaggtatatataggagtacataggggatagagacttggagtacaatacaagtaagagtagatttatctctaggattctatctctaggactctatcttatctctaggattctatctctagaatatatcttatctctataatttgtatttgactcttatctctaattaacatattatacttctaacattccccctcagtcgtaacgggagcgaagcaaacgattgcgactggatttgaaatcttctatttcttcatctctctgagtcatcatcatcgattgcatctctgatggtcggtcctccacctggtggctgcgtccccttctgtgtcgtcccttgactatcctctattccctcccgcagtcatagcgggagtgtcatggacgatagcgatgacacggacgctttgactggagttgtcgtagatgattcttgttgtagacgttcgtcgatgtagccaatcatgtggtagtcgtggtcatggtagtcatggtagttgatgtagccgcaaatagccgaaggcggaaaaaaaaattcacgccatggtgtgaagacaaaaactgcaattgttagcatcttgcatcttatagatgtcagaggatgagagaatgccattggggacgtcttgcatatgtcagaggacgtcgttggcgatgaggccaccacttcagttggtccttctgcgccgtgaagcggtcatcacaataatgatgccgagttgatgcagtcgttgtcgttgtagatgacgtgatcgatgccgtcatcggtgacgcggtcgttgccgtcgtagaggacgcggtcgatgtcgtcgatgaagcgtcttgcagattaatctgtcagaggacgcgaggtgtccatctatgtggacgagtcggcggcggcgcgcttgttcctatgttgatgaagaccatcggcgatgttgtgtcggagaagacaaatgtatggctgatgtagaggaggaagcagttgtggcttgcgtcgcggccgttcataggagcttggcgaagatgatcgatgcggattgcttggtgtcttgacgcttgattctcctgtcacctgtgcaccatgtgcttctctcaattgagtagatggatgcaacagtagatggctcgatgacgtttggtgttcccgtcgctcgggcttcacggcgacttggacggtggtgctgtacgccacggcctcgccttctgcttgatgatgctattgagcgacggcttgcgacgaaatcgtcgtcgtgttggctcctagagatcgtagggttcgatgtggcaaaaaaataaattgatctaattctaatattggtaaaatctaatctatggat

SEQ ID NO: 3398 - DNA, 1468 bp, Oryza sativa
attcctgcagccccagaatggtcgagcgacaccacgcctaatgcaaacgatcatgtacataatcaaataaacttattcctaatgcccatagcattagctaattagtatgtgctgtgtatatgcatgtgtatggccactttgatatactaatcattaatcattgtacactactacatgatagatcattaatcattgtacactactacatgatagattttcctgaataatcaaataaacttattcctaatgcccatagcattagttaattgggaaaattggaaccatgccattataattttgtaaaatttgagatatgtcatcctgacctacatgtcattgactcatgtgggtcctacgtgtcattgagataccgatgacatatcttaaactttacaaaattataatggcatggttccacttttcccagtaattggtgtgtgctgtgctatatatgcatgtgtatatgtgtatggccactttgctacgtgtgtggcggtggcgcagattggtcacgcggcatcgccggcggtgccgcctgccagttctgcgcgactggctgggctgccagctgaggagcaggccgacgcgttaccgcgctgccccggtgcgggaccgtgacggtcgcgcgtgttggcgccgcggaaccgtcctctctaatcggtctcgcatctttgatctgcgcctacggtgcggtgccgcgaccccaatttacgggagaggtatatttgtgtaaaatttttagaagcatgtatatatatataaaatcaaggaaaataatatatatttcaaaatttaattcgctaggcttcgtccttgatcgtaggagcagaggatgttggcgaacttggcgtcgagtggcagcaacttgctgcgttcttggggagaaggatgtggtttcttttctgcattttaattctccgccggtgcagatgcggcgcggtcgtcttgtacatggcgttggcttagcttgcacgtagaggaatggcttcacgtgattggttggccatattggccatgcatggcttgcatgcatgagcctgtcatcaggcttgagcagcaggttgtcgatggcgtcggagacgatatatgtcgtaagggaaccggcggcagctgtcgtccgagccgcaccgcgaaggtgtattcactggtggagaaaccatctttcgtcggtcggccgaattccacaatagttccggttgcaataaaaaccgggactaaagatcaagtcccggttaaaaaaggtaatgggcatatttgatctttagtcctggttggtaacaccaaccgggacatctttagtctcggttcaaatgctgtcagggcttgtcaggcccttcgagatctttagtcctagtttgtaacaccaaccgggactaaagattgtaaatgtagtcccggttggtgttaccaaccgggactaaagatctcgaagggcctgacacgccctgactgcattcgaaccgagact

SEQ ID NO: 3399 - DNA, 2537 bp, Oryza sativa
  unsure (1)..(2537): unsure at all n locations
catgccaaaatttctagtgaatttattttggtgattatatacaaatcggaggtgcgtaaaaggttagcaacttcatcctccaatgttttttttttcatattacatttggagctatgttttgcacacttttttgtctccaaaattttgttgtgtgatgagagagaaaatttgtgtggggaagaaagaatatatagaaatttagtgaaattattcttaaaacaaactaaaatgaaaactaaaagaagtacaacacattaatattagtttaaaactttagaaatagtaaataagaattatttggtgtaatattttataatttttgtatgaataatgatatgtcattactgtacgagtgttgaaagagtttgtaattattttatcattattgtataactatcattattgtacgaataattatttgtgtacgattttttttcatttcatgtagatggatcggcaatggatgtacgctgaccggtggttcaaagagtttattgacggcgtgcattattttttgagagtgggcgaagctaacaggcataaaggttttatttgttgtccatgcaataagtgtaagaatcagtaggaatattctgcatccaggactattcatttccacttgtttgagtcggggttcatgccaagctataactgctggacatcccacggagagcaaggggttgaaatggaagaagatgaagtggaagacgacaatattccggactttactcagtacgctggatttgaaggaaatcaaacgagcgaggacgaaagggatgctgatggtaacgatgttgcggatgatcttagtcagatgttgcaggacgtcaaggaggactgcgaaagtgaaaagggggcccataaattggacaagatgttagaggaccacagaacgtcattgtacccaggttgcgagtaggggcacaaaaagttggataccactctagagttcttgcaatggaaggtaaaaattggtgttagtgacaaggcatttggtgatttattgaaactcgtcaagaaaattcttccggagggaaacaaattgcccgagactacgtacgaggttaagaagatagtttgccctctaggactggaagttcagaagattcacgcatgtccaaatgattgtatcctatatcgtggtgaggagtacgagaacctagaatcatgccctgtatgaaaagcactacgatacaagattagacgagatgatacaggagaagttgacgggcagctaacgaagaacagaattcctgctaaggtgatgtggtatttcgttataataccacgtataaggcgtttgttcaggaacaaggggaatgctagaatgatgcattggcacgctgaagagcgtcaacacgacgggatgctgaggcacctcgccaatggttcgcaggggcgaaacatcgacagaaaatttaaagacttttggaaaggacgcacgaaacatacggtttggtttaagtacggatggcatgaatccttttggagagatgagcaacggccatagcacttggcccgtaacgatgtgtatctacaacctccccccttggctatgcatgaagaggaagtacataatgatgctgattattattcaaggccccaagcaacctagtaacgacatcgatatgtacctaagaccactggtcgaagatcttaaactgttgtggaagaaggaaggtgtccccgtgtgggacgaggacaaacaggaggagtttaatgtacgagcgctgctgttcgtaaccatcaacgattggcctgcacaaaagcaaatgttctatgaaagttaaggtgtttgcttggcttctcctaattgacagattaaacacttatgatatgctgcagagaaggcactaccctcctgaaaattctgatctagcatgtgtcctttgtccagctcaagcaagggaaacatctttccaccttttctttcaatgtcaattcagctcagattgttgggcgcagctgggaattgtctggaacctttctctcaattttgatgatatgctgctgcaggcaaagatctcatatagatccactcattttgttgaaaaaattctctatgctgcatggaacatttggaagcaacgaaatgctctcatttttcagaatgtaccaccttcggttgtttcctggaaagctctctttaagattgatctttcccttttagtctttagattaaaagtttatgagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcaggaa

SEQ ID NO: 3400 - DNA, 710 bp, Oryza sativa
tatttcaccaaagagtaataaaggaagtgcctccattgacaaccaaaaggtcaacattgttgaccgtggttctttgcaatggactgaaaagtatcggcccaaagttccaaatgacatagttgggaaccaatcaatggttagtgcttctgctttcggttaagctggtcacatacatctatgcacaattacttagtatgaacttatacatgcaggttaaacagcttcatgattggttgagaagttgggaggaccaattccttcattctggccagaagggtaagggaaagaagcaggctgatagtggagctaaaaaggctgtgttgttgagtggacctccaggtattggtaagaccacaactgctaaagttgtcagtcagatgcttggattgcaggctattgaggtaattctgctgttttgcatactttgcaaccttccaggcaactctttgtttcttactcaactattgaggcataaatgcaatgactaatgttcataacaggttaatgcaagtgatagccgtggtaaggcagactctaagattgagaaaggtgttgggggcagtacatcaaattctatcaaagagcttattagtaatgcaactctgaattatagtaacaaccggtcagtattacatgaagtttcatcaacctttttggacctttggttttatcttgtatataaatttggcaagaattttgacagattaaaa

SEQ ID NO: 3401 - DNA, 4301 bp, Oryza sativa
  unsure (1)..(4301): unsure at all n locations
ctacaaatttatcctttctggcattccatggattctgtttttactcttcacacgtatgatgcatcgtgtatcaggttgtaaagcaaggtgattgattgttttcttctcttgttttattctgtcacaagcggcatcttaaatatctgactaactatataaatttgccaaacaaacccaagcttttttttttagtttggtaaggatttgaatattgttacatctttgggttgatatgatcttaatcttccattgtgcttataaatctgaatggatttaggccagttcatggtttcaaatagattttcatgttattatctgaataaaatgttttgtgtattagtcctaaatcgtaattccaaaccctaaggataatcagctcatcagtgaatcggctaattagtttagcacttggaagttagaacttaatcaaataacatggaattccagcatgatataccttgatacctccatctatgctcaagaagacaggcactaaatttccattaatttctttcaatggctggcaacatattaattgatggacatgtcatgcttgtttcctgatgttactatgtttgaaaatcatggttttcttaacagtgagcaaattaaacaagccttacttttcttaacttgcctgaatcagtcaataagccaaggaaaatcaccattggtttttgaactttgttttagcaacattgaataaaaacccatgccttttcaagatgttgtggtccacatgagtacaatctgatctttaagatgattttcgatggtttatcatgagataatccaatcttatattgttgagaactgcagggagtcattgaggctggattacctcactcttctcttgagacaattgactgatccactgaagacaatgcccaaggtatatgtagatgtgatctattaattaactccttgttttgttctatggcattatacttgaatgtttcatgatgaggataatgacctggacactggcattttagaaatttatcttgatacctctaaatgcattagtgtactagccatcttctggagtattctgaagtaaggagtctctttaatttcatttgctgaaaaaaaaaatctgcaggagagcgtccataccttgacttgtgtacacggctcatcaattctgagttttaacatactgttatcttgcctttatgtaatagtattaccagtcttcttacaataattccctgttaagaatctttacctgagctatctgctggttatcttatatttgtaaaatcacaggatgaagctgtgcaaaaagtggtggagtttatggatacctactctttaagccaggaagactttgacacaattgttgaattatcaaaatttaaggttggtagttattctaatagaagccctatgtttgtgccatctattttatgttcattattaatctctttgaatggttttatacttattacaatatgtaatgtgctactgctaggtttgcccccttgtgtttgaaaatacttactctagatggtaggttctaggttgcatgcaaagttgcaaactgtatatttcactacactaatgatggcatttcaattgatttcgggaatgcaaaagctcatttgctataagttcttattgtgcaatgcaattttttgagaaccaaattgaaatttataaacatgtgatcgtgtagatatgaaatcagagaacaaacattttccaaagtactgaaagggagtgtttgcctgtgaatctttagtgccacaatggttgcatctcttgactgtttgtctatactcaactccctgcttgatatattttttctagaagcattaatgcatgaatcttttagctgagtaaacttgctgacttggttgtcatgattagtaatgccttgtcattatacttccaatggtgtttctgaatacatattttgttctgtagggtcatccaaatcctatggatggtattcaaccagctgttaaaagtgccttaacaaaagcatacaaacaaggaagtagttctcgtgttgttcgagcagcagatctagtaaatatcccaggcatgaaaaagccattaaagaaacgagtggcagcaatccttgagccagtgggagagagtttgcctgaagaaaatggagtagcgtcatctgaaggcgatgaagaggattcctctgatgctgaaaataatggtaagtttttctttttcagcaaatgaaatgactatcacataggaggctatagctgtgttttgcaaaaattgaaataatggagtactttctccgttttacaatgtaagtcattccagcattttccacattcatatcgatgttaatgaatctagacatatgtatctatctagattcattaacatcaacatgaatatgggaaatgctagaatgacttacattgtgaaacggagggaatacatcggatgaggacatgcgtgaaacgaagggaaacagaagttgataagtgagcatttgtaaatctggactagttttgtttcatactgggaaaactgtggtacagtaacatgtcatactgccatatcatcttcatatacatttgtgcttttattctcaatctttagttatgcaacttaggcctatgtttgtcagctgttgtgctagtagtgtttggcataacaatgccatgtcatgtcaattatattagcttcagcccaattttcattaggacatttaaatcgataatttgtattcagtgtatgttttgtttgaccaacctgctttgtttatttctttcagatgaactggtgcctggtgacacaaaaccaaaactggacctgcagagtgataagaagaaaggttctcgtactttgactagttggattctccaccagtcttaccttctgctatttacggtcgggcctgactctttggtaattttggttttatatccagggatccaagtgcagctcgacctgaagagcaatggcaatggcttgaactcgaagaagatgccggctggtagatcaaaagcttctggctctgctgggaaggctgctggaggctcaggtgggaagaggaagaggtaaacgtccgccggccgccgtcatttagtcggtggtgaatctacatgaacatcctctgatattctggggcagaatgcggttcanattttcttgcttgtacataagtcccaatcatctttgtaggcagtagtaggcaattggtatctgctccagatattttgtttcctcccacttgtatgagcttcatttcgctctactggcatttggccagttttcagctttgcaagacaacgtccattattgttgacttccgttcaatgaaattgtgtcatgtttgttgtccttttgatatcttgttgcattcatctcccaaatctgccgtagggtgacacattaaaactgcatgattctataaacctgtaattccatcttttcgttaatactagtaaactaggtgttacttttcttttttttagaaaataatgggcttacggaaaaatattatactcttgtcttaaaatataaggacttagtactagatgtaacattaacttagcactatgaatttggataacctgcctatctaatttgtactagaaatgtcgtattcaatcatacgttcttatattttgggatgaagggagtagtattttcaacacaacataaatatattattaaaatatattcaatgctaggtttaataaaattaatttaatattttagatgttgctaaatttttatataaactagaaaaatgttgcgttgcaacaggtgaatgctattttaatattattattgttatatggtttagttatggtaaatttattgtgggaatttgcttggatttttcttttggaaaattagcgagtccgacattcattcaagttagcatgcggagtttgttaaaagagatttcttatatgaattcttttgtgtttacaaaagcaaatgagcttaaaatccaactcaaacacaaatatgtattttcaaaaacgaatatccttaaaaaccgactcaaacacggatgacgtatcaaaatattggtaaaaatatctttaatttttataataagtagagatttgatcaaactcggaaaaaaaatcaaatgacttatatgatataaaacagataaaatatttattagtcccacgaaccgaacgaattcgatgccaggcaacaaagagttcctggccggcctacataaactctgtattaggtctttccgagctgataagtgatttttttataaaaagatatataggaaaattactttaaaaaacagtattcattctactttttaagtttatttaagctaatagtta

SEQ ID NO: 3402 - DNA, 925 bp, Oryza sativa
ataaaatatgccagataatcacgatgcatataatctgaatttcagttaattcatcaagcacgtgggaattgatttgtttaatataaaccagattagttaacagtatggtaaataaacctcatgtttctacttcgtttggagcatttcgtatttgacataacacaaaacatatttttaagcgccacaaagagtcagctaccaggtatcgaactgttttttttccgattttacaagaatatatcaaatttgatgatattgcaaaaatataaccgtgtcaccgaatcacctagcgacacctggtgttgccgaagggccaaattggaccaaattcccatttgttatcgcctacttcctccgtcccataaaaaaccaatctaggtgggaatgtgacaccagctaggataacgaatccaaattcattgttctaggtggtttcacatgcttacctatgataacgaattgtctaggtggtttcgcatccccacctaagttggtttttttggaaggaaggcaataggtgaaaacagccatgcattttgtgactttaccttcgctttgtccatgcttggtgcagtggctcatagcccaaggcaatgtccacatttaaataagctacatcacacagtgtcgcgtgatgaaatggtgtcatcatgtaaattgacaacacaaatatatttttatttgaatttcatatattcccacaagataatatatatatatatatatatatatttaaaaatttaattcccgagtattttccttagatcaatcatattttcaaatattgagatatacatttattttaatatctacaaatgcaattatatttctaattaagaaactaataaattgtatttttctattactgcacatttattgttccttaaaatgattgatgagatgcacatccttacatgttatcatc

SEQ ID NO: 3403 - DNA, 13667 bp, Oryza sativa
cttccacagaaaaaaaatgtttgttttgaaaagtaaaacagtctgcacatttgctcacaagtttcatgcgcaagtgtatttctgtttactattgctggttgcatttttgcacaccatgttctatcataattacctttgtgggttctaatatatgatcctctgacaagatgaactaaagtttgatagctggtcattgacttaactatagtgattgtgcaccatttgttttagtcatgatataaagaatttttcaattttattttcttattgaacaagtcaactggaggtttctggattatctgtgtaacctagttccagaatttgagcagaattttcaagtaacgatctctgtactgcaggttgaactggaggatcctgttgaaaatattggagctaagttggttaggcaagcagcagcaaagaccaatgatttagctggagatggcacaactacttctgttgtgcttgctcaggggctgattgctgagggtgttaaggtatgctattagttgagacatgagacctctattacttgtatggtcaatctgttaagagtcgttaatttgtgaactaagtgaaaataattcatttgctctttttcaggtcgttgcagctggtgccaatcctgtgcaaattacacgtggtatcgagaaaactgcgaaagcactagttgaagagctaaagaaattgtcaaaggaggtaaaataatcgtcaggctctaatgctttcataatgttttagttgtggttgtggcaacctggtgtttgttgcaacaatgcttagctagactgagtcaaatcagatgatttatctatgtagtatatgcttttttttgttctacttataaaaaacattttcttgctttaggttgaagacagtgagcttgcggatgttgctgcagtcagtgctggcaacaattatgaaatcggtaatatgatagcagaggctatgagcaaggttggcaggaagggtgtggttacccttgaagaagggagaagttctgagaataatctctatgttgtggagggaatgcagtttgaacgtggttatatctccccgtattttgtaactgacagcgagaaaatgtctgcacaatatgagaactgcaaggtagcttcagcctgagcacacatacccctgctgtatgctgctttaatctgtttcagtttcttattgcactatgtttccactatttttcagcttcttttggtggacaaaaaaatcaccaacgcaagggatcttatcaatgttttggaggaggccataagaggtgcatacccaattctgataattgctgaggatattgagcaggaggctcttgctactcttgttgtcaacaagcttagagggtcattgaaaattgccgctatcaaagcccctggttttggtgagcgcaagacccagtacttggatgatattgccattctaactggaggtgaggtggacttgcgatctggtgcatttggttgggtgatcattaatgctgcttatttatgatgattctggagcatctggctggatgattaatgctgcttatttataatattttttttctctgcagcaactgtaatcagggatgaagttgggctgtcacttgacaaggcagacaaatcagttttaggaacggctgcaaaggtggtccttaacaaagagtcaacaacaattgttggtgatggcagtacacaggaagaagtgactaagagggttgcacaaataaaaaatctcatcgaggtatgttatatctgtttaccatggttaatttggcacaatagtgcctcgcaaatttttttttttggcacaatagtggttctatattccaccatttctttaatctagttatagactgtacatatctggaaatgtagcttgattggttacatgcttcatctggtttcaaactgaaagctttctctattatgaggctgtatattgaatgtgttgtttgtacaagaaaagaaaagcatcagtcctgctcctgattgcttttttatctatccaatttgcaggctgccgaacaagaatacgagaaggaaaagctcaatgagaggattgcaaagcttgctggtggtgttgcagtcattcaggtataataagaaatggacaaaatgccatgttatctgtatctgttctttttcttggttctttgtttggaaagatagatagatgtggttatgtgggtcgtaatccaagttttgttacttttgataggtgggagcacaaacagagaccgaactaaaagagaagaagttgagagttgaggatgccctaaatgctaccaaggttagtctgttgttataactgctttgagatagaaatagattaatgtttgcttcttaaggaagaaaaattaaggtagtttgttgctcactgagttgatatcaacgttcttctggctttggatctttaaaccgcttcctctttgtcaggctgctgttgaggaaggtattgttgttggtggagggtgcactcttctgagactggcagctagagttgacgccatcaaggacaacctggagaatgatgagcagaaggtttacaaccatgatctactttattcattgtttttgttcgagtgttctataaacctcatctctcaaaagttctgtttttgtgcctgctactatgtatatgggttagaaatgaccatctcgaatttgttgtcctttctaattgacttgttgtatgtattgcttgaactttttaggttggagctgaaattgtaaggagagcgctgagctacccgcttaaattgattgctaagaatgctggtgttaatggaagcgttgttaccgagaaggttagatcttgttcactaacagaaaatcatatgttcacatgtacatctgaataacataaaagatgatgttttaccaggttctctctaacgataacttcaagtttggttacaatgctgcaactggacagtacgaggatttgatggctgctggtatcattgaccccactaaggtctgttgctccccattgatttccgatatttttgcataaaaatttagattggtggattccctatattttagctgaaataattatagcagtgtggactgtgcagttacttttgtgttcacccttcagttcttacacatacagccattgttttgtgttgatgttagtagtttctaatgaaggttctagatccaaggcttagtgttgtggtcctagaaagattgaattggatgcaccatacaatttgctaggtttgatttagttactgcaagagagtgaaattaactttgggaaacgctaaaggaaaagcatgaacacaagtaaaagaacatagaattagactgtagcccttgcacatggttgacacactacgattgttgattcccttttccctaccatgcttcatgagaactgcgatgagctaaagactatgctttcctgatgatgggcaacaggtggtgagatgttgtcttgagcatgctgcgtcggtggccaagacattcctcacatcggatgtcgtcgtcgtcgagatcaaggagcctgagcctgcgcccgtcaccaacccgatggacaactccggtaaatgatattggccaaacgcactacacttcaatttcatgtgatcaaacactccctgaactgttgctaactttaaatctgctccgtctctttctgtccaggctacgggtactgatgactaagttacagttacttgttctccgggaaggtcactggccgtcaatttttgggtagtaggcttgaatctgaattttggtgagatttgagtagtttcgagacaatttgatttgttcccatgggaagtgaaataaacagggtcactatagcaaaatttgtggtgtaactggaacggctgtcaaattacgaaggaagatatttgaaagatttcatgctctctggggtttaccgttgacattcatccatttctggcgtaatttcctacagcattttcttggcaggcaggcaaagcagcgcagcatgggcttgcacgtcttcaactcttcatgctttgtctggtgactcgtgtgcatcagtaagaatttcatgcgagtatacgtttgtgatgacagcaatatccgatgaactcctgtattattacacggaccgatgactgataaagatgccgccggcgacctttcaccgctagtgtagggcctttttctttcaccgccggcgacctttcatcggacgtcgccggagcgagagaaggtatcgttaagagaaaaaaaatcggatgagtattctatcaaatgccatataccaaatccgttttctctaatgctgtaagaacacacgcaaattaattttagttcagtagaaaaactattgcgctccatcagttctcgtcgagagagaggttaaaaggcagtcactgaacatggggcccacatgtcagttagaacccaagaggagagctcgtcgatcgattcccccgcgaacagaaatctcgctctcgccgccgccgccgccccgcgtctcctcctcctcctccctggccggcggcgtgaatttgaactactccgtccggccagcctccgccgctccatgccatattcatcccctcctccttaaatcctagcaccctgacacctccagtcgccttccctagccctatcaacccttgtgtttgtgaatggttggatggattccatctcggtgaatgatctcgcgggatttttttttgggcacaattgcgatccgatccgggtatcccaccgatcgaccgaagccgggagggcacgggcgatcaactggttggtttattccgcgacctccacttcattccattccacttaattcctgtacggaattgcttcgttttactcagtctggccgatcctaagcatctttcagtttgttgatcttgatttgtctatgtctactctatttcgggttatataagctgcagtttacctcccaggatttttaactgcggcttatgctttctagcaccctccgctgttagcatttggatgtgtatgtcgtacgtgtagccagtacctacaattaatttctgaggagatggattttggtgctatttttctagttaagagatggattttggtgctatttttctagttaagccgtcactagtaggttgtccttgcttcctgaaaagcaccggtagattgtttgatacttctgatgacttctcctggtcagtgtctctgaacattgtacatggtagtcatacgtctgaactttttgacacagcacatgtatttgctacttggttttgtttgtttcattctccattgcgttatctgctgtctattgcatctcctgcataatctcacttaatatattactctactgtatctcctctgtagtcaacagtataggctatagctgtattaacatggtctgtctatcttacgtaagtgatatgtcgtgttaaacatttgttcttggcggtgacagaacatcgtctttgacacttcattgtgatcccaattagagactaaaggaatgctttccaatgcaaaaggttgagcttacgaacgatcttgtttttgccactaaggagattcagctatgcttgcctacaagatgatttctgacggcgttgatatacaaggcattacatcaaatactattctgtttacaaaataaaatgaaattgattttcagtaggcggatactgctggagttaattcagtagactacttgtgatatcaccaaactgcagaagcactagtcactaaacacagatagatgtccgatcatgtagattcttatttatggtaaaccaataaatctgtacctctagttaaaggtatatttttatgccaatcgtctaacttttgctgcccaagtactcccttaattccgtgaggcaaatgtgactacttccggcatacttgatgccagcctggttttaggtctagtatgaggcttacactatgtgctgcatcagcacttaatttaagtcgatctgttccagatggctttatgcctcttctgttatcctgtgaacttatgaatgattctgttatcctgctctagtactcgtatctactttgtagaaacaaaaaattgtattcagtttatcggaatctggtggtgttgcaggtccgaaacaatgtgcttgctgatgtcacaatgtatataggattggcaacatgatcagaggctatgagcatggttatgtgctgaaaataacctctgttggtgatggtaggcagtttgattgggttattctccatagtttgtaatagttagtgaaaaatagatcagttgagcatgaaaactacgatattatcgtctaactggtattatcttccaattgcttagtcgcagatatcagtattctggaaaatggcataaaatgtgggcatccagttctgttaattgctggtaatattgatcaggacactgtttcaatccagtccttgtggccaataagattggaagtgtatcggagtatggagactgcaagaaaacctggatgatatcactttccaattggaggtgatatgagcttcaacatctatatactgtttttttctttcaagaatacaactctatgtaatgtgaatagtcaagtggagatacactctaacccccccccccccctacactctttcagtcagattctgtatctatatttctcaatttctgatcttcctgcttgcacttattactacgattggcatgcaggctgaaagtgagctcaaaggagaagaaattttgggtggaagatgctttgaatgcaatggaagtgttatggttggtacccactatagtccatatcagaaggtgaatgttctttttagatcttcaatccatcactcgtggtgcatgtattgttcatcagccgtcaaattccctgtgtcagcatttagcagtgtcagttcatatacttctggcacttttatgaactgcattattgtcttagttgcactactttcttttgtaatccactgctaattcagttagttgtttgctttcttgctaggatgcagtggagaaagctattgctgttgctggtgtctatactcttttgaggctggcatctaaagttgacttcatcatagaatctcgagaatgattagcagaaggtgggtgaatgaagctatcatttttgcgacacatcgaaagtgattatttatgggttcatcttattttctttggtggagattattttcatggtggcatattgtagaacctttttggtcaattaacaacagatcgtatcgcccttcctgtaggttgaggttgaaattgtaaggaaggccttcagtataatccctgaaaaggtttgaagtttgaacaccattttagttactccaagcattattaatgcatgattcaatattatgcggctgcgtactactgaaaataatactattagatctctacagtcaggttcttgctaatgacaacttaatgctgctactggcaagtacgaggacttaatggttgctgggactattgaccccactaagagcaagttttatagtatagtccattgctagctctaattcatatatagtcaatttaatagccaattcatataatatttgtttactatactattaatatctggtcccacctaccatacgcacattacgttttggagtccgtgctgtagctggctacaaatctatagtctgctgcttttctctatcttcttttatctttttaaaatatgtttacagctagtttatagccttctattgtacctgctctaaggcatgccattatttgatgaattctagttcctggttactgtatggatcttatcatttcatttaagccatgctcaaatactcacaataatttttgttaactatttttctcctttttcttttattagtcattttatttttcattctgatgagctcattactcattagccccgtagtagtgttttcttggtcagtttaagatgtttgatagtacgaaacattaacctttcacttacatatccataccctaaatctttttacttattatttgtgcttagagagttacttttgcaaaaggaacataataggcggtgagttgaggtgtcgcttggagcattctgcattggtggcaaattaagacattcctggcttgagagttgagacgtggttgtcgacgccatagagagcgagaacgtacacctggtcttctgcaacctgcaaaccaatggcagctagctctggtaatctctgcacctgatcccatgcacgcctttgactgtgctatcttgcaaatctagcatagggataccacgttgcagaatatggattctgattgagcaacggcacttggcttttctgtgaaactgtggcaactaaatcttttgcttacatacagataggacggctgcacttagcaacactacacccgtagctaagtgaagtgatttcatgaatggtgtagcgttttctttaaccttcagtaaaagaatacttgatgccaaataggagtagttttcaacttaacatagggatagaaagtaaagtaaaatgggggtgaggggttcattggatactcaagagaagtctgtgattatgtaaggcccggaattttaaacaggtgcgtgcgcatttggcttgtcacacacacataggatgcccccctctgcttggctgcgtgttcgcttgtttctgcgtgcgcctgcacagctgcaaattttcaccagtgccagcagttgggaggtagcagtagcagtggtaaactagcaaaggcaaattcacagtggggggcctggctatccatccatctccttgaccttttttacctggagcatggaaggaaattccaaaaaccctcttgagctctttcgtgcttagacaaaaagaaaataccgtttgctccaagtccaaaccattgtacttttactgtaaggcaacccaagcacacatatagatactgctacattatgtctgcgtatgcatatagtgaccgttgttttgggtctttgtggttggtaaccactccttgcactgacagtatgactctacttattagacctgtgctgccgtgcattagatgtagtagtagtataacgttactgctagtagtattttgtttgtgaaggttagtaaaataattgatggattgtaaacaaagtctaccactatagtagcagtagtaatacaagaatagtaaaaaaacacaagatccgggtcggccggcctaggggtggaaggtggccgtccacgctccgtgcaaatgtgatcttcttcttcatcctagagaagaggagaggccaacggccggccattaatattccctcttcgatgcctgcataaaaagctgtgtactgtactactacccctctctctctctctctctctctgcctcactggcacctgtagtttagcgccgttgcacgctgcctctgtgtgtgtgacctggctggctggggctgtatgactttgcctatttggtgcctcgctgtactcttgggcccggggtctacttgcgaaaaaattttttaaccaaacaagatggaggaaaaagggcaaggattgaggaatatctctgtggtggagatgggtgattatacttgaatttgctggtgtttttttttctcattacttttgcacctccaatctttgcaactttcctaccttttggggaagaattaaatgtctgttcaagtctacaggggaatttaggccctgtttagttcacaccaaactttccccaaacttccaactttccattacatcacatccaaaactttcctactcacataaactcccaacttttttttccaaactaccaactttccccaaacttctctccaatttcagaaactaaacacacagttagtttttttttgtatgcacagagttgaatagaaatttcagttaccccaagatatactattttaccagccatgatttttgaatcagtagtgcattagacatatcccaccaacaaatgaatgtagttgtagattatcccccaactaataatgtgcgtgtgcaatgattctgtcatttgcaaattgcaattgccgcctcaaaacgcaaatgccaatatgtgacacctgtgaagtgaaaatggtgttggcatcataaaatatttaaccaaccccaaagcatgggtaccttctaagttagccacacaactaatttaacagtgtactgctatcacacagctgtacaactggcatatcattgctatacaccagtacaaagtgctcgtgcccaccgttttatgctgtaatctctctcaacaactgaatagaaaatcaaccacaaaactccagctggtcaattcttagggatattcttgatgcggcgaaaatctctgaaagccaatctttggtgccacctgggtattgtgcactttgtactttgagctggaacgaacggcttgtgtcagttttggccgttggtaagggacaaacaatactggagaagagtattcatttccctcctgcaatatcttctcacagtgtagtagtatggtctaatgcgatccatacggaattgtacacaggagtacatccacatacatagaattgggtggtggccccaaaagtactctccatctacttgtagtagcctagtataatactggaatgtgatgttttactaactttgtaagcaaatcatgcatgtagccatgtaacttaggctcctttggcacatggtaattttcagaaagttgttacattcatccattcatgtaaaatccatgcatttctagtatcttcaaaaggaatatataggagtatatttcacaccattgatgtgtttatcttgtgtcttacaatactcctacctaaactagttcagttggttccagcgggggatgttaatacatgccgcatgagctatcagtcatgattgcagccaacatgtaattgtaatgcttctccaactgaaattgtcgagttgggaggtgaccctgacctgcacaaaaaggtgaaaaaaaagaaaaacaatcttgcagagaaagttctgcaatattatccatcgagcaaaccaaagcacaggtaggagaaaaactcccacatgtacattacctactcactaccggccagatatacatatatacagagtagtgtgtagcctggctaatcaattactaagagaaaaaaaaaacctccaatgttgctgctagcaatcttctacccatgctcatgcaaaggacagctactgagagcaagtttagtagtacaacccactacttactataagccaatattaaagctaacatgtataataggttagctataaggttagctttatttttttttcatcctctctctttatctctctatgaatttaatgcttatttcttggagcttgtgtggagctagctcttgcatgagagccatcactccccacttttctttatctcttccacataagcatttagcttgcttatagctcaccattatcctttctctcagagattgttgcaagggaggaggatatgcattgttttttatctttagttttttctttaagcaaatagggtagtgtagtactttgggtcatggggaacagcaaaaacagctgtctggggttgcatatgattagtagggcaaaagctagtgagtgtgtgtgtgtgtgagagggagagtgtgtgtgcaagagggaggaggggccttttgtgaaaataatgataagttttggggagcaaaaggtgagaggggagagggttttccaatccagcttccaagtcaaaagggtcgcccgggaacgaagaagaaagctcaaagctaagctgggctggctgctgcgggcatgccagcatcattgccgctcttttctgctctgttggcatccgagacgcctcctctgtaaaggcacaccaaagctctcttcttggaccctcaacaaaaattcagcaactgcaaatactattagttattatagttatgtcagttagtagtattagatacagggatcaattatcccttatttaattctccctaatgatccttttctgtgttttgtttactttctctctggatatatggtgtgccattcacaaagtgattgacttgctttatttcattgaggattctttccaaccttgtttaggctctggcttgtttgcccgttgattgagttggtccaagaatcaggatatatgatattcatgacttactggaaagctgttaagcaacagcactaacactggtactaagctaggcatgttcttttaccagatcagataattttcatctgtttactttctgttatgtgaaaatgatccgagatttattgctgtggagagcacacaagctggaaggaaaagatgagtatgggtgccatttttgggcttggagggtggtccttttctctgctgtacattttttttctacaggatccctgctgtacaatggtagtagcttcttgcttcaatcagggcaaatggaggacagattttagcttgagctaacatgtgagcaggctgctggccacagtgcatgtttgcacacatggtaggcccttaactgagtggactgaatgggggtaaggtaaggtgaaaaccagactctcaaattcactttcattttttccagttccattggaagatgtttcacatgaaatccaactgcatgatcctaaaaggcacttattactcctgtagtacattgcttgtaacatctctaataatgcgcgggtcattgtcgccgaaatcttaacccgattcccttttatgtgtctgtactcctattagtatatactaaaacatccatgttgttcatgaaaatggctcattgctggtgacatgctgatgatcgcatcacgggcgtatcgctgtccgcagcaatacgttttgatgcgaactgaaaacattttatctgtactcgcatgcctgcttcgtaatgtaatgtaatgcttgtgatgttattgcaagcgatgtttgatataattgcttggttttatgtcatgacagggaagagagggaggtggtcgccgtcatggactgatgagggccgtgcgtgttcgttcgccaggccaggacaacccagcaagcatgctaactggtaagcatccatcaaagcttttctctggaaaacaaaacttggcctcagaaagtgggttctgatgaagaaaatgggtaggaaaaacagaaaaaaaaatgggtaggaaaatgaaaggggagatggttgtaaaacccttatcctcccatggctccatgccagggaggcatggagtgatggacacaggtcaagaggagaggtgcaagtgcaagaaggctgttttctttgtaaaccagctagtagtaaaaacttgcaattctctaatcagtgagccagtgacccctcctgggtgcaggtctcctaggagatagggcaagggaaatgaggccaggtatccaaaggcccatgtctctatttaccaggaaatgctatgggtccccatccatgcccccctaaaacaatcactgctttcctcctggaacaaaacatactattataactttataagggatgtaaacatgttgtatggtaaatttagctagccagacatgattaataaggatatgcgctttacaatacaaaggggtgttgtgtagtatgaaagatgactatattgtattataatttgatgatatctttaatgcaataggtttatatttaatcattaacaagcacaagtgattatagctatgttaaaatgactagttttatgatcttctataatcgatacgagaagacagggcagatgtcccttttgccaaccattcaaactcatctcgtttgataacta

SEQ ID NO: 3404 - DNA, 13331 bp, Oryza sativa
catatgtggtggtcactattctagaagataccaaccttgtgaactatttcgtctcatgtgctgctaatatgctatatacgagctacgtgttgagtacctggtatattttcacaacacaccaatatctctagtatttcacctcactgcataaaatcgcaaaaccaccaaagaacaccctaatacggctgcaactaccaccataaacatttggccatatgtaaaaacaaacgtcaccaaatcacaagggatgaagtcacaactcacaagtcataacctcccagcccaaccaaggaggaaggagggacttaggccaactcatcaacaccaaacagtgtccaccctctcttggtccccctagcagatcccacccccataaaactgcccctccattggttggctccattggcacaagcacaaggccctccacttctctcttcactcccttccagctccccccaaaaccccatttcattccaacctttcaaatccgccatcaccacctttttttccccacacacacacacacacacacacacacatatacacattgacacatagcagtagtgtgtgtagtactagtacaaacacacacaacacaagcttctctcttcccttcttggttttgcccaagaaacgaaaaccaaaaccaaacccaagaactctcctcaaaagaaccacctcacttcatagctctcacaaggctcacgcacacatagagcttgtgagagcttcttctttctctctctcttgtccttgtggtagctggtgcttaaaggaggaggaggtgagaggaggcgcaatgtcggagcagccattgccgcagcctcggagcagcatgcgggaggcgctggagaaggaggacaaggagaaggcggcggcggccaaggagaaggccgccgtccccaagaacggcggcaacgggggaggaggcaagaacggcggcggtaacggcggcggcaacggtggcgccggcgcccagcccggggaggagacgacgagggagattcaggtggtgagggaggcgtaccggagggagccggcggcgccggcgtacgtgatgccggaggagccgccggccatggtggagctcgtcgggtggtacctctacggcttctgctcctacttcatcacccacctgctgctccccgtgctgttcccggccatcatcacccaggtcgccttccccgcctccgacttcaccccggacaccaagtacatcgtcaagggcgccacctgctccatccatgagatgtccatgtaagagagactcagctcccttccctccactgtttgttcaaatcttttcacttcttcttggctgttttctctttgtttttttgagggggtttggtggggttttttggtttgagttttgaaggggttttcagtttgtttccttggtgatttgttttgttttcttctgggtgtatttttctcactccttttttttttcctctcttcaaaatggttgagaaaaatacttgcatctgtgtgagctaagctagatttaccaagttactatcatttttcccccttgtgtttgcactggaagtagtactattagtatttattctttcctttttactagaactttgagcaacttgactagtgatgactcttgcagtgaggtttttcttctttcctagtgtttcccctctctagctcctcttgtttaagacctctacaagcttatgtctccgctttttgaagtttccacctgatgtcttcctaaaatatgcttcttgttttgtacatcaaacgaacaggcatagtgcacttaggaaaaaaaaacttactcttttttctctgtagttttcttgctagtctcttctctgctcttgttcttggtttgaaagttttgagctcgttttaactttacatcgtccttcatcttgtgatctgtactcgtagttctctactccacctttttttaacctcttttacccacacatcttcaaggtaccccaaatgtgaaaataaactggtgtatagtacttcaaagattggatttttccgggctgcactttatatgtggcgtatatgcaaaatcctaaaaagaaatagcccgtgattcctgagattccatgtttctttgctctccattattagcagataagagattcttgtgcaaagctccaaaagatgctactgtttggtcctagatattgttcagtgaggctatttcccacatcccacatttctcttttattaatatattttcgtttttcctgagattttctctacctagacacgtaatgaactgcatctttttttgtcagtttctttttgttgtactactactagctgtgctcttgtgactgtgagagacaagatttcttgggaggaggataaggtcaaacaagaaatccctaggggtgcctttgtaaatttgttttaaaaatcttccgaacgttgagaaacattaggtggtgagatcgaaaatgtagtactgaatggacagtggaagccataagtatgaaatttatgaggtaccccaagccgaggcctgtgtgtctcattaaatatggcctgtgaaacttgcttccatgcttcagataactagccatatttcatttcaactactagtagtactgcaaaatttcttttgtgatccatgcagtgccatatacccctggagatggtagtagctcatttccttggctgatagatctagtttgtgtagctgagggttacattgcttttgtctcacttttgatagaaccaagaaaaagagtgcgcaaaagcagggccatgcttttgcctattctctttggcctgccctcctccctcccttttatttttttctcttttgaacaggaaaagaggcccctaaaccgttgcaattttgcctttaaccccaaatgctgttgagggctagccgcatgaccagccaactggtaggtgcaccacagtatggcatgcttaaattgcatcaggccaactaactgcccttgattgcaagggagattgttgatgctacttaaatgtgtcaacgttgacacctcaacacacaaaagttaccatcttttaacgggttaatctggtatgaacccctggaattctagcacggtgactttcagcaggcaatgcatgtgcttcttgcagtttatgttcacgcattgtttgtacaccctggaagcttttactgcataaatttcatagcatgcaatgtttacctgtacatgttcatgtgatgcaaccaaaccatcatggtcacaccaagtttgtgaaatgttggcaggtaccagaggctgaccaagcattcgattgccattgatggatcccggctgtccccgttgggctggagtggcctatcatgggcgattggaatcctcattgcggctccgatcctcacccaggctgcacaccaccttgaccgtggccagtatcagtcgctcatcctcattgccgcgacatcgtttggctcattcttctgcctcctcactggcttcttcaagacagtctgggtgttcctcttctacatcctgttcattggtgcatccatcattgttgctgaggctgtgcatacacgcaatcttggactcatgatccgtggccttgcagcacatgactctggcaagcaccttgtccttcgccgtcgtgctgctgccagtcagctcaccctgtattgcactgccattggtggcattggggctgcgctcatggctgctttcatgtaccacatgcttcggcgcactgaccagctcacaggcctttgggtcgtctccatcttcagtggccttatctggttcattggtatctgccatggtctcttcacaaaccgacccagcagctcatcgcccaccacagcatttgagcctaacttcttcaccaagctcagctacagcatgacccttgtgcgatacccacaggccatcggaagcttggttgcagtgttcctttcatctttcgccacaatgtgcatcttcaccagtggcacattgtatgctattggtggtgtttgcatcaagccagtccttgtgctcgtgctctggatactctacttcctgttcccgttgatctcacttccgctgctgcacccaatccagatcatcatccgtgctgatgctgttcgcatgcagctgcttgggttcatcatctgcctatttgtgtctggtgctggtttctacttcaagagccacaggtggagagccgctcacatcattgtgatcgctcttgtccagagcacagccaatggtgtgctgtactcatttggtcgcattctgctgctcgatgcctcgccaccagggaaggagggtgcttttgcggtgtggtatgcatttgtacgctgcattggtgctatgattggcttcgctgctgcatccgctgggcctgggcgtgctggaggatcgtttgctgctgcgttcctaggcagcttcctcggcatcattgttctgatctttggtaatgtgagcaacatcggggcgctgaaggctgctgggcatctgaagggaatggaagacgagaagaggctgggcatggagaaaggggaaggcatgagtgcggttgccgattccggcgagggaagggggagggtatgatgatgattaaatgggcttgtgggaaggaaagattggaaaattgctgtggaggttgtgtttgtgagagggatttgttcttctttcttgtttctttcttgttcatgtttcagtgacactgttaattcggtgctttgccccccttggatgcatgatgatgatgacatagtggtagaggaagtgtgctagttgttaatgtgttattctttgcttggaagacaattgtaactgatgatatggttctttgttcatcgccaccgaaattctctctggcagtcatgcttcgtggttgcttttctgttgaaaatgtgattgtcaaagtgaaataaaacccttatataatatttctattgcattgtgcaaacaaatttgcgcaatcttgtcacctgatttctggagggtgaaatgcaagatactattgtcactatttcctgtcaaaacaagaattattaaaaataagtccgggagctggaaactgaccggtgtaccaggcaacattgttattccgggtcaaattctattattttttttccctgtactctatttgaagttacctttgaattttcaactttgcccagcaggttctttagggttagggtttagggttaaactgaaagagcactgaggcttaaactgatttcgtgttcttgaaacctggataagggctcttttagaacgcaagagcaagaatttacaagaaaacataaaatccctatataatttctctatatcaaataaaacataaaaaaaaaaacttatgctaggtatgctggataggtcatgttatatcatcctatgtattttttctttttcagtaattatatcatcctatgtatttttttctttttcagtaaatctctattctgaatttttatttgcacgtttcccaagctcttaaacgtcatgttttgtgtaaaattttctatataatttttttagaatatttttctaaagcaactttccaactttgcaactagctaattcattacttcatatcctcaaatagctatcacaggagtcggattatccataaattttagctattttgttgttcggatgaaaatatagatattatcaactgttagagacacatggattttggcatcatttgtgatgccatcctaatgacttttctgccaaatgataaggtttgcagtagccgttgtaaactgtcgaacccttgaggataccctccatacctttgtcgaaggatgcatccgggcttatttccagacaaatgtgatgtaatccttctgactttatcagctgatcattgcacaaaacattgtacttccaaccatttgtttagtgtaaacatcagcacaaatagttgaacacaagcagttactagttcttacttaaaagctctggataattttttctatgtgcattacgaatgatgatcacctgacacatcccctttgcatgacaggttaatgaagggtttaagagaacaacctcatggcaaaatgaagccttaatttctctttcagagtttgttgggatgaaatcagctttgtacattaaatagtttgtattattttttctctaaaatcataaaagagtttgtttttgtgttgtgttcttctacctcttgcaattaaagaaaatgtacctgctcaaagaatctctcacctcatcaagacatcaacagcagaaacacatcacaaaccaggagacgacttatccaaatcaacaaccaaatgggactgcaatttagctcaagttgcagtccatctacggcagaattaacaataaaaacaacaacaaaaaaagagaaaaatttaaataatggtgattaggtcaagaagcatacgtacaatgaggtttacggagccgtccatatcaagccgtctcgacgtacacatcgggtcatgagtaattagtctcgtcggctgcattaatatactaccagtactactactaatgacttcattattctcattgcgcatgaagggtgtgatggtcaactcggttaattaattactatttggacagatcatttggagaatttagaaaaaaaagtacactatgatttatgggagttcatatatagtccaaaagttgcttatgaaaatactctatttgacaatttgtgccaattccatagtccaaaagccatcaataaagtggactattgtgcaagctctagatgcttgagtggccatgaaatcatccatgcatttttataattttatttagtggtagactttggatgcgtgaagagcaaagtttatgggggcgtattagagaagattaattgtgattttgggggtccataactgtgactttttcctacccaataaaacaattattgatggcaaagactaaactataagccagggaggcaagttgatcttcccccctattatcaggatttgttttttttttgaaaatagaatttgaatttaatctttttacatatatacacccggctacatatgtactaactacaagtaaagtaaagatatatacaaagaatttgtattattcgaagctgaaatcatgcttgaaaatttctaagttccaaacaaagccttggactaaaactcatattaattgtcacttcaacttaaaacaaagtagtcaagcattagctttacagaagaaacatggttagccatgtgttgatggaccacttgttgagttgagaataattatactagtttatgatggtaaggttggttaacctactcaaggagtagatatttatgtggtgttggcatgacatatttagaggcagggagacagggaggcaagcagcatgggttgggcatgatgatgagcccctgtttcctaatgtgcctgccctggccctgccagtggccagtagtaggtaacccatgatttctgtgggttgcacaccattgcttgtttcctctcatcacctcaagaatggagtattcttgtttttaaaatatcaccctaagttctttattattttctttgaaaaaaagaataaaatggccatgagttattttccaatggagtagtgtttttttctactgactccatttcataatagtgcttggcaatattaactaactaactaacaaacaaatggtttaattgaccactgatatcttttaaaccgttcgatcaagttggatgggactaatatatttaaatttaccgtgtaacatactttactaatattacttgtagatttatttataaaacaagagtagtcgaactaaaacaatgataagttaaattttgagaattgttactatgaaacagagaaattagaagaaattcagaaagagaaagagggagaaggagagcatgtagtatgatgattgcacatgtgcagtgcaggtgcagggccccagtgtcatctcctgcacttcacttgtgccatcctcttcacttgtgcagtctttactgtaagaattttcttgcaagttgagaagaaacagacaaggggagctcttctttcataccgttgccagcacggctattcaagcaaagtctctttgactttgacctccacgctggcacttgccctacgctttgctatcccgtcccaaacgtttttctcctgtttctacatcactccatcaaaccgcccgtctaacactccgaagtacataatccgtacttcacgtcgatgcctaaaaacgtactactcccccacattccaatattaatatacaacggactataggattaggtttttttttttaacagagcagtaatatacaaggttgcacttatattaatatggtgggattaagtatttataaccatgacttaaattgagatgtacataaatcattttcttatagataatggattgtttcattagtcaataaaaacatcctacacctttacatcaactcatcaaggatgcacacatgcagtaaaaataaaagtgaaagaaagatgaaaaaccgtagtaggtaacatgaacatgtcatgttgtctagcgatattttgctctattacaatcatgaagagaatatcgggattatatgctatactttggaacaacgccttcagaaataaagatcttttgatgatgtcaatttctaaaatgtatttgaatttaatggcattgccttctaaaatcaaagtgaccaaagaatttttaaacttaattttgatttattgtatttcaccgtagtttatttttttagcattgacttttaaaccacgaatataaatataaaagctttatctataaattatttttaatatctttgtttgtttttctatgacataccagcctagcttaactgcttaagtgctcaaccgatcagacacttcgtatccggctttctataacaagcaattgtccttttaccgttttatctgctattgcttgttatagccgttacgctgaatttaccacaggtcactcacgtatagatactaatactgtagagtgagctgtagtagcagtaaacgtcgcttaaaaggcgggaaaagctaccgttgcaggcaacaacactgaactacatgccggcaattgcctgtcttcttcttgttttaatcattcaatcacctcgtcttttcttgcttaatccatccctctggcctcttctcttcttcacctgccatcctcattactttactccattgcattcttgtttacaagcttaatcaccataggttattactagtcagtgttaactaatgcaagttgataatagccgttctctgatcgccggttggaaggtaaagatatgaaattaaggagttgaccagcgcaatttctgcactagacaacaaactgatgttttggagtcattcatacatcagattataactaatcaagatgcctctaacccaaccaaagcctgcgtgttctcttatctgcattaagccctgcttgctttgttgtttctttcaggaagaatgacgaaacttgagccggcaagattccttcctgcatcaggttcagttcagaattgtagtttaagaacaagtttcagttgatcagcagcagcatcagctgaggccaaattctcctgtttgtcaatgctctggccaacagtttcagatcatgatattattatctaaaaaagatagtttcagatcatggtcagatttcagagggtaagaaaaaaaaagtaagtgataataataatacaattggttaaggacagttttaacaagtaagctcacacctgaccttgagagcaaaagttctagagctgctctgattcaaaaggccagccatgctcagattgctttatgatgtccttttgattaatcaatccaaactaaactgatactagtactgcaaagtcatcaccaacacgaacaaaagaaaataagaaacaagaaagcaaattaaaggacagaacagtcaaagcgagcgcgccaactctttttgaacggcggaaaaaagaaacaaaaaccagcacaaaaggtgaaggaggaagatgaactcattcctcaatcctccagcgtttacctgtcgctgaaattggggcgaccctgcaaatctctgaagaccaggatgatattcagatttgtccatacaaactattatattgtttttgtaaaaaaaaatcagattaactgttgaattagattgtggtggtttcaactttcaggtgtggagtcaagaacaagtcatgtgaatgcaaagtgcccaaaaagcctagatttgaagtcacataggacacctatcctgagcactaactgaaatctgttgtcacttgatgcataagatttgtgtacccatgacagccaacaatggctggataatgttagacatattggttgacatcacaccaggccacgaattcctaatccctaatccttcttccttttagtgccaaagttggtgtaggagcagtaaacagcaacatgagtatgtcctaagaattcagaggtactgtagaaatgattaacatatcttcatttattttactgttctactaacttgtattagctcaaattaatgcctagcaatcctttgatgggttttgcaaaaattaaaaaaaaacgtactttttttctgtccaaactatagttgttgtaggacaatagtttataaacttttcctatgtgcgacatgattattattttgaaggtgattggaggttacaaaaaaaactttctcatgcagtagctttcagtgtgaacagtaagagaacttacacatgacatcttccatctagaagtgcaggtatcatgaagaaaaaaaaggacatggcaacaaatccatttatttcagccaaaatagattatgtaagcagcagccagccatctctctgcaatctagataagaaaagagaaaaagaaagaaaattaaagttgaggtgacaagtgcacataaaagtcttttaaacgtctaggtatgaaattatgtgatcctttcgcatcttccaaactccaatccgtctcatctgctcctcctcacatcattttcggttttcctgtgagcgatgcaaagtctactcttgtgtgtgcatgtgtggagactcagagaccacgattctcactgcaaatatatcattttctttctctctttttttttcaccaccgttcaactctctctttttgacacaacagcgatctccctgtcgtgttgtcaacttgtcatttaggaatatgtgtgtgtgtttttcttactggatttcacctatatattttgttcattatgatctgtactttttccatgttatcaatttgaaggtagccagggtttttgggattcactgatcttacttaccatctgagtgcacactcacaagaaccataaaaaggcccttgcatgatgcgtcttccatgtaatcgaaaaaaatagctcctgcaagacgacaaaccatttagttacccatactcttttcgtacatggtatctccaaaccttgtcacataatatttaattcagttctagaaccggttgaccccaaaacataaaagcggcaccctccatttccatctagtggtagtcaaatacgatgaaaaatccgggtgcaggctagacttgaatttggacccggcgtacatatctacatacaatttggtcaatactctcaatcttttccatgaaaaaaatcaaaacttgtccaactcatgacgacatagaagctgcatctgatggtcacattcagctggctgggtctggaagtacaaccgctgggccagtgttgatttcttggcacaccaaagccaaagaaggccacaaggttatcttcaaagtctcaagtctagtcttgttccatatgaacacttgccctgtttgtcatttctcttttttttttctcacttgatgcaaatgttgcaacatcatcaagatgttgaggcctcacagggctccaaatgatggggcatgctggagagaaattaaaaggtaaaaaaaaaagagaggacaaaagatgatgctgatgagctttattccagtcattgttaaacagcaactggccggctaggtgtgccgtttggttttccatattggcaactaggtgagcatcaagccatttttgacccaaaaaagggatcaaagtgatcacatctacatgtaaaagaagataagagttgtagattcttacggagtacattttactttggatgtataattggagtgatcttttttaaaagcatgccttcgaaaaaaatcttgctgatgaactaggcatgtggttggtctgagaaaccacacatgtttggctgcaagaatacctttttttctctcagtgagatttttttgtccacatgaactgtaaacattgatagtgaaccatcattttgaggtcatgttggttacaggtaatactgtagcaaattttagttgggcttgcaagaacaggtggtgaacatcaaatgattagctttatgaagctgtctggatggtgagattaaaaatagttagtaaaagagacgaacttgtctattgtagagtggatatgcatgtactattgattactgccaataaaaaggacaggacagccatcatagtgggttaatttagaagactagcacaagtgctcagtgatttgtttgtgattttttttattttaaaaaagaagctgaaagtgagaggatggacacaggacaggagaattgtctgctacttgaagcctgataactacagatgctacaaacatagatcttttggcccagcccaacataaccaacacatatgagctttaggcccagcccatgtagccaaatagcccagatggaataaccagaaactggctaggctgcaccagtggtctactctgctgccaacgatttgtcttgtaaatttcaataagaaatcttttactagacaatcttttctcttgtaatctaaattgtaaaacaactgaagctcagataagtacaaggagcagcagagcacctatacattctgcatttatatacatgatcagtgtgacataccattgcaagaattttcactggaaatgggtttcagatatgtgaactgatgacccatagatagcataaacccccagagaagatctcctagcgtatatattcttccctaatgcgtctgaaaatttgatcagagatgcataagtcatgaattttatttaggccatatgataattcagaaggagcatgtagagttggagataactaatagtgaaatcgagactaaaaatatcaacaaaataatccctaacccaaactgcatgcataaacaatatcatggcccgtggaaattaaattcgataactgtatctcacgagataggtaggtacctgagtgcctgaatttcaaatctgtcgaaattaaaaaaaggaatacccactgatgaacacacacctgaatgtcatatgctcgtcagaaatatatttttccactgcacatctgcattcgtcatact

SEQ ID NO: 3405 - DNA, 17291 bp, Oryza sativa
taagaaacgaattcaacttaacagttggattccgtttcgaattaacaaggaagcaatcggttcggaataacagttcaaattagatccggattcaattcaattcatcatgcaataaatatatgagctcatggcacctgatcggcaatcaatcaccaaacgtgggtcgtctcagagatcgatcagcttcagaattcgccgtcgatcaatttagacatctatcagctcgcgtgacatcatcaatggcggcggcggcagaagagaagaacaagaagatgatcaaggtgatcagctccgacggggaggccttcgagatgacggaggcggcggcgagcatgtcgcggatactcctccacatgatcgaggacggctgcaccggcgacggcggcgccgggatcactctccccaacgtcgccggcagcgccctcgccaaggtcatcgagtactgcaccaagcacgccatcgccgccgccgaaggtagcagcagcagccgcaaggcgaaggaggagctgaagaagttcgacgtggagttcatggaggtgggcatcgacatgctgtacgacctgatcatggcggccaacttcatgggcgtggagggccttctcagcctggcggcgcagcgcacggcggagctgatcaagggcaagtcgccggagcagatcagggagatgttcgggatcaagaacgaccacacgccggaggaggaggagcagatccgcaaggagtatgaatgggccttctaggctatcagggtttaaaattgtggaacgaaattccagttttatcggaggggacccctccgatatgatattatttcggccgaaattttaattttttttctttctctttatgtactaaaaaagatgtccgtgcgttacaacaggtgaatgatattttaatcttattattgttatggtttggctagcgtgaaattcactgtggaaattcgcttggatattttttttagaaaatcatgagctgtaattaggagtctgacattaatcattaggagtctgacattaatctcaagttagtatgtaaatttttttaaaaaatatttcttatacgactccttttatattttcaaaagcaaacaagtttaaaatccgactcaaacacaaatatgtattttcaaaagtgaacgaatttgaaaaccgactcaaacacggatgacgtactaaaatattggcaaaaacattttcaatttttataatagtagagatttggtaatattttattcaaatttgaccaaattttgttcgaacttttggaaatttcggtatatagacaccctttgctagaaacgccgaaaacaaaagattgaaccctgccttttagtagtacttactaactacgtattactacactcttcatcctaaaatataaatatttataattatgaatttagacatgtatttgttcaaatttatagccaacattattatattttaggatgaaggcagtacatcatacaattcacaaactatagtagagttaatacctccgtcccaaaataatggtcgctttgacttttttcttgcgacatttgaccatttgtcttatttgaaaaattggtgcaaatatataaaaaaaataagccatacttaaagtgcttttgataataaagaaaatcacaaataaaatagataataattctataattttttgaataagacgaatcatcaaaagttaaaaaaaaacttaaagggacaagtattttgggatggagttagtagttattattcagaagtaattagtaattgattttgtgcaatttatcactcgcatgcattgccattgcttaattaccttgtcctaatttgtatttgcaatgtacttagactcgatattcgattgaattcatggaaaaaaaaggatgcgcacgtagcatctgatcggcaatcaatcaccaaattaacataggttatagagatcggacagcttcttcgccttcgtatcgatattttacggtgccgatcgaataaattattttagttaggattgaataaattattcggagtcatgtgaccccgggtaatcgaacgtgggaacaccactacccgtatccgatgggaaatgtagctcttgatgtttttggcgccaagatatcaatatatggccattatatatcccccatagaacaatcacatatactccctccgttttgaaatatttgacattgttgactttttaacacatatttgaccgttcgtcttattcaaaaacttttgtgaaatatgtaaaattatatgcctacataaaaatatatttagcaataaatcaaatgataggaaaagaattaataattacttaaattttttaataagacgaacgataaaacatgtgcttaaaaagtcaacggcgtcaaacatttcgaaacggagggagtataaggaaaaaaaatctaatacacttaattgtctctgtaggaactactagagggaattcagttctaataaatcgtcttggttccattataaggcattattatgcttcagtaataaatatccatataagtcgctgcctttctttcactacgctgacaaaaatgcaaatgtttttttgcttctggcaactgtgcttctgttccgcaactaaagctgtatcactatgtgctattttattctgttcttgtctgatgattctatttttatgggggaaatgagctggacatgcttgtttctatggtttacaactgttgtatgtctattttgtttatctctattagtatcaagagcaatttgccaatggtctatgttataatcatcatggtttatacattatttattattggattaaattgaatggtaatttactgaaagatatttccaacattataaaccccaagaagatcttccctggcgcgtgtggaagtttgatcagatattaagcattttagataaagaaattaaataatctggccctcttcaccaaccgaatgtatcagagattagcatttttggataaataataaggcggccgagaagagggtagatttttttcttcagttctttgcgctccaatccgaaccgcacgcctctcatctgacggtcgcagttgagtcggtaacaaattaacaaggtgataagcgatccagatttatgaagaaacacccattcttctcttcgaatttacacaaggaaacgaattcatcttaacgtacatttggattccgtttcgatttaacaagcaaagcaatcgtttcggaatagcagttgagatattagactcggattcgattcgattcaattcatgcaaataaatagataagcacagatcacctactgatcattggcaattaatccaggtctgagatcgatcgatcgatcagcttcttcaataacaatttcggggacggctaatgggcgatcgatcccctcgagaatttagactatttaccatcaaattcgcgtgcctcaatttttttaccacccaatccgtatgccctttataatatgtcattaggactgctaattagtttatttggtaccacttttatctatctttttatctatctttactgtaattttcttttcttaattttatttgtatatattttcaagatttgtggacatttttacccctgggcccacctgtcagatcaaagaaagatactctgggtctggatcgattcgctccctccaggcgtagcgccaccgccgccgccacgcgcttcttcggcgtcgcgtcaccaccgacccgctgccctgcgccaccaccgagcgccgccccaccacccccgccggcactgtgcggcagcacctccagccgccccagctattaggcagcacatggcatggaaacgtagtaatccttcacaagaacatgccatgttttccatgttccatagctagctaagctttttagctttagcagcagcatggtgagtgagtgacaagattcatcggcatggtagcatctagcgatgcatgcaaagctactaacacagtgatgtttgtgtagccacagcgccacagatcgtgcagtggggccgtcgagttggggcggcgggggcgcacagtggcgccgccggcactcggcggggtggtggcgctcggcggttggggcggagtggcgtcgagtcagctgcggcggcggcagcgctcggcggttggggcggcgagctcgcctccccttcttctctttctactacaccataaatttttttaaaaaaataaagttagaaaaatttatgtatagaaatattatatataaaaatattgaattcaaattcaaattttaattggatatataaacttttgacttataaatattcgctatacaaactttagatgtgtaaaatttaggtgtataaacttaataaaagaggaaaagaaaaaaaaaacgatcgccgctagcgatcaatagctcagtaggactttcgaacaatttctccgtgcaaatcggttgctagcttgcttgacagttaatgtcatctatggcggcggcagaagagaagaagaagaagaagatgatcaaggtgatgagctccgacggggagaccttcgagatgacggaggcggcggcgagcatgtcgcggatactctcctccacatgatcgaggacggctgcgccgacggcggcgccggcatccctctccaagatcatcgagtactgcaccaagcacgccgccgtcgaaggccgcagcacggcggcggcggagctgaagaggttcgacgaggagttgatcgacgtggacacggacacgctgtaccacctgctgatggcggggaacttgatgggcgtggagggtgtcctggagctggccgtccagcgaacggcggagctgatcaggggcaagtcgccggaggagatcagggacaccttcaagatcgccaacgacttcacgccggaggaggaggagatcatcaaggagaacgcgtgggccttacagtaaatcataataatttgttaggcgtagtaataataattagtaataatagattttttttgtttatgcttttgcttaattattggtagtatcttttgtaattgaaatgttctcgagtcctaatcgatttgattagttacatttttgcaatattgttcaatttaacatgtgcatgttttggcgccaagatatctgagacatggccattattccccagagaacaatcataaacaatctaattcaccttaattaatcgtcttggttgcatatatatgatgcttcagtaatgcagggaacatatgtttcagtacactgcactcagcaggctggtgtagcaacatcaggagaaattttatggacatgatccttgatcagtatgtaaaagaaaaagggcataatcattcatgaaacaactctcagcgacatccctccggcgtcacacaacataaccattaaccaacgataatataatattaaggcagcattcacatggtcacagaacatagaccaaccctgcacagtacatgcaagaacctgcatttctcatactacagatacaacttcagtgtactcttacaagaatccatacatatgccacaggtcaagaaaccattaaatcacactagcaagtacggatatggcttgtgcaacgctggctaaaacttgatgagaacatcattggttgacatcataaatcaaactgggtaccacccacatgttgtctacttgaaagtctgggacgcggtctattctactaggaactggctgaccgagctcgaccgcagtccaaggttcaccagaatctccagatggtttcgcaacataaatccagttactctttccgccccatctttcagggctcgtgcaagagaatgtagggtccctcccatcaaggttgacaaagagagcctgattttccaacctttccatcttcacacactcaactgtttcagcagaaaactcaagacgaaagacttgaaaggtgcgaggcaattggtcgcggtctgttgacaaatcaaccatgagaagcatttcaccacaggccaccagccatggcccagaacgtgggcctgtaaccatttcttctcgtcgcagaaccgctacttcctgtatgctgagctcaggtgcaaattgcatggtgtgaagcctgccaagaacatccatcgcaaaaatctcacctttgaagagcacaatctgaagaatgtgctcaccgccataaccgtgctttgtccaagagtttgttccaacctgccaatagaatatggaagacctcgaacaaagtatcagatgtgagttgggtgaattaagtggagccgtaaggatgccgtagtagatatccctgtcgcccatgaagttgagtttgggagacttcagcttagtgctagtgtaagcatcaacaaagaggcagttcttctcatgataggagaagatgagatatccatatgagcagcccaaatagcgcatgcgatttggagcatctggcggagctgaacaacgaagggatatgtttctcttggatggatcatcaagctgccatttgcagtaagataaaagattgtccttcaaaaggacgcgaaggggacggatattaggtgtatttagtttgaggcagagaggtgggaagttgaaagtatatacggatggaaaggaagatagcgcagctcgccaagagtggcaggtggcactaaaagcaagcaagtcctggaatgagctaagcaaagcaatgatttggtgaaggaggctttccaggagacctggccaaacatggggttcacacaaggtagaagatgtaggcactgatgagtggcaggttttcttaaagggcctttctgcagcagcaacttccctgtcaaacaaagaaaaattcagagattactggagcagagaaaacattcgaagataaaattactacttcctactagtaaagattgagagatagagtggagtgatattgatccaactgtgttgtttcagtgaagcaatataaagcagtaacttcacctacagcttcttgagtcattacagtgacccttatgagttatgacacattgaggcaaataaaactgaccatttcattgaactgtaagtctgtaacgaactaacgattcccagaataagatgtgcatcaacgtcctagatgccaaccaaaacaatatacgccagaaccacctacagctttgatatcttgaacaataccacaattgtaataatctgtttatattgtgccaaacctatttttgtttttttcctcccttcccttcaaaataagacaaaatggtacttcgtattccaccctcccaaaattaatgaaaatgtttattttgacagtatgaatatgcggcaatacaccctatttatctggaaaaaagatagtgcatttgattaataatttattaatagatctggttggttcctttggcagccaacgcagcttcagccatcagtgattcagtgtcaaatgctaccatacaagaatgtcaggtaccataaacttcttggaactatatacctataatcaactagaaatctacaaaactaagcaaaattgaagcaagaacggaaaccaaattacctgtggccgagagcgctcagctccgttggcggcggcatctcctggcggctcccgtccatggccgctgctgctcctaccactcactaatccgtagcttcaccggatccgccggccggcgaggagaccgggcaaccggcggcggcgcgtccgagcctccgaggcgaggcgaagcgaagaagcggcggatatggatgcgtcggcgaggccatgatccatggcccatgggaggcccaaataatccgcaggcccgtagaacttcgcagtccggcccaaatattgagttgggcccataattttcggcccacatggagagaccaaactggcccacgttgaaggccataagacgagcaggagaaggggagagagagggcaaaccgacatcgccggagaggtcgccggcggcatcgtcgtcctccccgtcgccggagatcggacctcctccacaaggtctgcgctctctctaccctcccgccttctcgcgcctaaaccctgttcctcttttttttttcttgataaatttctcgatctcttgtgtcatccaaccctaaccaagaaacgggcgcgttcgctagggttggaatttccactggatttttgttgttagatgtgcttgctaacaaagtaacaaccctagattgatatggttgattaggtgggtttatcaatcgtgtcatgtaaatcaacgtgcctcttctacttttggggttgatttttttaatagaaaaatagtactctttggatgagcggtgttgatttttttaatagaaatttggaagccaagcatgagttgattgatgtacaaatggagagaggaatcagtacgcaaaaatacactcagatcatttttatgcgcgttatttgattacacagtactgaagtgctccatagaaaagctcaaaactgtactatgcaggaaaacatttcgattagagaaaaaaactagcccttttcctctatgatattgtatatttgtatctccctgaacataaaaatgcacctggttgaattgaaatcttctttcccattgtataatgacgatttaggctcagttcgtttgtgatggttctcaacctctccttctcgatttccgcgcgcacgtttttcaaactactattttgatgcgttttttgtaaaaagtttttatacgaaagttgtttaaaaaaatcatattgtttcatttttgaaaaaaaaattagctaatacttaattaatcacgcgctaatggatcgttccgtttttcgtgccagagccaaacgttcccaacctgctctttcgaacagagccttagatgtcttctgcatgtatttggtagctgaaattctagcaggcttccagattagtcagtttcatccttctaacttgtgatcaaattcgttatgtgttgcagggagttcggcaatctgccatcatgcaaagccccagcaagatctctgatgcctctggctcaatgccccctgccacgtctgtgcgcaaaggttccaagaagaactgcttcactccattgttcctctgttgggctccttcgtcgacattctcgcctttgctggcacctgccattcttggcgtgctgccttctcatcatacccatcaaaatctgcctttcgcaccttactcccaccactcctcgtccgacccaatgtccgcgtcaaatccccttgtatcccttctaccagcaatggtcctcacaagctactacgctcatgtcaggtcattgatctagccaaccgaaacaccccgctccgctgccagattcctcgagaaactctgcagaagatgctttttgcaggctcttctcatggtcaactcatatgctgccgcagtggttactgtctcgttgttgatgtgttcaccggtgctgaggtttcaccaccacgtcttccattcagcaaggaccatgaggagatctacttttgtggcactctgacggctcctatcacgtcacccaactcacatctccttatcagcaaccggtcatctctgttcgattggccggttggaagtgactcctggtctgagctcaagcttcctgttaatcgggtcgatcagattgtggaattcaatggtcagctcatcgccgtgattgaatacaagctgtacactttgcagttggcccccaagcttcgcctgaagaagatgaaaaccctgtggtgggatgacatgagtgaatgtccatatttgagaccatggctagtggtttgcgatggcatgcttctcattgttgaccactacataactttgtcatttggagcaccagtcaactacagaccgtaccgcctggacatgtcagccaagcctgcaaaatgggtggaggtaaagaagctggagaactgggcactctttatcgggggtgatgcgagaagcccgccgtttgctttcaagaacccggagcgctggggagggaggagcaactgcttgtactatgctcactactcccagccatggagccttcatgggttgggtgatgatgcagatgctgtgtgggatcctaccactgatgataaccttgtgttcaaaagaaactggtacagtcagctgcaggccttctgggtgtatccaagcatgttctattcagacggagacggccagtgattggcacacgcacgagtgctctgctcttattagcttcttctgaaattgcccccttgtgatgtagagcagagacttgtgcaacttggcctagaaatctaggagatcctcatggtggtctttatgtctagtttaacacttgcagtcgttttgtagttcagttattagctgcattaccatctgatagtagggtgtgactgcactggatgcaagtgtagttaactagttgttgcttttccactggtgatggtaggtaatgtttcgttctgtaagggtttggaacttttgttcttcttcacagcaatggtttggaacactaatgtaatgcttgtgcactttgtcttgtgatttggtgctgctccaaattttcttgcaggacaaatagattttcttgtactgggatattttctatgtacttctgaatcggaatcacattggtaactttgatctgtaattttggagtttcaggaagcagaaagaagcctagtgttccggtaatgggttgataaacatattggggcaattacaaatttaccacagttttaaattgttattgcaaaactacattcgaatagcattcttgcaaaatatcataaaaaccagagtcttaagttagattaagaaaaacaatggacaagtttgcaaatgccccaaacgtataagatttacataaacccctctcgatcagatcaaatccactccccgcaaaaaaaaaagaaagatcaaatccactcaactgcacgcgtgtgcatgtttcagaaacggattcatcgcaacagttcgcattgaaattagactcggattagatcggtttcatgcaattaattgatttctccgtgcaaaccggtcgctagctcgctggacagttgtcgtcatcaatggcggaagaagatatcaacaagatgatgagctccgacggggagatatcatcaatggcggagagggcggcgagcctgttgcggcaactgatcgaggacggctgcgccgccgccaaacccctcgctgagatggtcgagtactgcgccaagcacgccgccggcgaagctcaaggtaaggaagaggaagtattagacggcgagtccagcgacgaggaggagacggacatactcaggctggaggccagcttgatgggcgtggagaacatgctcagcgcacggcggagctcatcaaggactaggacaagccgccggagccgtcgccggagaacgtccccttccacggctttcacagtatacattcatttattgagcactgctacacagactaaattttcttattaacaatcatctcaaccatcttattatatagtatatatagtaaaagcagcaagctatattacacgagaatgcgccacatcatcacaaatataatagccatcagataaagggtttgggtaaactatagccattggatcaaacggatacatgtattaaaaaaaacataaatgggctaaacatatggaaatttccggaggtttctgttacctcctctagacacatgataaaaatgagtggggataaagagagaagaaagatgaggtttctagtgatttctcttattataaccatatagtacaacttggaaatcaatactttgtaaaataaaattaacttattatatcaaagccttcttcaaagcttacctaaactaatagaccatatagaaaagttcttaaacagattaaaagtcacgcaaagcgtgactacgaggctagtttaatttagcactgctacacagactaaattttcttactctctccatcccaaaataattttcttactccatcccaaaatgcttgacgccgttgatttttttaaacatgtttgaccgttcgtcttattaaaaaaatttaagtaattattaattattttcctatcatttgattcattattaaatatacttttatgtatatatatagttttacatatttcacaaaattttttgaacaagacgaatggtcaaatatgtttaaaaaagtcaacggtgtcaaacatttatggaaggagggagtattaacaatcatctcaaccatttaatttagttatatgaaagttataaaaaatcaacgtacactcatagcgtgacacgtcagttttagtaagaaaatgttaatacgtatagccttttccttgtttatttattattagttaaagacattattattcagagtaattagcaatagatttttttattccttgtaaaagattttgaatcctgattaatgatttatagtattttgcaacggatttgctaaatgtgtcgccagtttttttaggtttatcaggttttggaaaataatatcgctcagcagataaacgtgccttcctgaccagtataaaaaagaaggcaaattttcagggaacaatgctttcatgaggaatccatttatgccgagtcaataaaccgtagttaaatcacacaagcagtatggctaaaaacttgatgacaacaaaacgaagatgatagatagatcactggttgatgcaagccgacgcttcttcattcaggattccagggatgtactcacacatgacacattagtgttagtgttagtaagagtttactaataaaatttcagtgagttagtaaaccattactaaagcaaaagacatgattaaatgatcgtccgattttcggttctggaaactagtgttaacctatctatcatgcgccttcttgatcgctaagagaaggtaaagtaaattgcaatgccaaggcgttccgctaacgaagtcaatcatgaaacaactctcaacaacattcatagtacaatttagcctaaagatatatatatattgtgcaactcatgcgtcacataacattgtcagctatataatgtaagtctggaactgtcgaaacatgaattcggcaataataaaaggggtagtgcacgagacctaaaagtggatggatacggagacaaggatttagacaagttgaggccctctcaatgagaggtaataccctactcctgtttgggaatttgaatccgccgggtgtagtatagatctgacgatcatatgtgctcatgccccctagagggcctcctgcccaccttatataggatggagggcaggattataagatagaaaccttaaccaatacggtatcggtttactaaatctactttacaatcttatcaaaccaggactttagaccgttccgtaatatacaaggaaacgtaatacccaagtcatgatatgttacatatttcatagatatgagttatctcctataactagtcggataaccatgccgtgtgggtatggggtacccataatctccacagtagcccctaagaccttcgcagtcgaaaagataatcttctcacgaactagattattccaaagccgagtgcttcaatcatcttcgctatgatctcccgagtacttttaccgaatcagaagaccgtggagggctgaaaaacaaagtcaggtgcatcgactagatgcacctaataggtgtagccccgactatgtggttaattgaataaaccaagcatacagtcagggaataaataatccaaccaactgagtggtttttgatcattatagttaaccaagtgacttgatatcaatatatagcatatgcggtatgaatccccaaataacatgatccaagtgatataccgactgctttgtaaaaattgatgcgagcaatctaaagttgactacatcattgaaaattcacttagcaaaacagctataaaaaagcttgaatgcagtgaataaagaaatttccaaagtattgggcatacaccatgcgcacactgctttaacagatgtgcttaagtccttaaaagacacatggtttcaccacacctggaaatatacggcatatgtggtgtaacatccgagtaaataaactcataaggatttaccaaccgcctggaaaatgaccacaatatataatcagcctaagccataatattggtcaataaaaatgcacacttacgtggcaaaaagcaatgatattgtatccaatcaattgcttgataaacccaaatagcgccttgactatataaaaaagtcagcggggtagctataaaaaacttcactgttgggcaccttttaaaatgcattgtaccaactcctaaaaagttgagtaactatggtataaaaagattttaaggtattgggcacttgatcacgcgcactttggcctaagcaaaaagtgcctaagtccctaaaagaacgtgacaggtcacacctgaaaatatgggctgcagacatattaggcctaggccaaaaaatatgccttcgacatcctttaaaggatgacgcatgtaacatgctcccgagtaataaatctttcgggtgatatagaccaagtgtagctcatatgaatagcttatgatctgagtgattatcccttatgggatactcccaaatagatataataattgaatcccgactggcgtaagtattcggttgataacccttacggggaataataaatagtccagtctttgagcatagaaaatattggtggtagtgaagataatgataccaatcaaaagtgatgaagttgcacagccgtggaggcgaataaactagtcgatagcagtcaggtcagccagcaatgaatatgaaggcgcccagcgataaagttgcatagccatggcagcaaaataatcagtcggtgacagacgaggcagctggtgaagaagatgaagatgcccattagcggtgacataataagtcatccgtgaaggcgaggatatcggtcggtggtgacgaaagcaagccgagggtgaagatgtagacacgcatcaaaggcgatgacgaaatccaccaatcatgaagatgaagaaaatagtcggcgacgacaaacgcaaccgacagtaataatgattagcagcaacaaagatgatcgactatgatgacgaagttgcccatcaaacagcagtagaataggctatgttgaagaggcttgacaggatattgatgaagatgacgatgtcggtaatccagtcaatagcagtgtagcaaccaatgataatgactaagacgctcatcagcgtttgcatagtaggtcaaccgtgaaggcgaaataacaagccagcaatgacggaagcaaccggaggctaagacgtagtcatccattagcaacgacagagatgtcagggccgatgaagtagaggtgctggtgatgaagtcagtgacaataatccatcaaactgttaagaagatatcaaagctcaagtaattttcttgatgtgtgcataacgaagattgatgcaacaccccttgatttgtaaagatggtagtagaacttggagttgtagctgttgcagatgcttcacttgaagaaaagtaaatactgttatccaactcatcaaaactgagctgattggttgataactctaaactcccggacatgtagatagaatctcaaactttgatacttggaaaaatttggagcagattgtggcggcgtgaagaagccaaaattgccggtgtaataataagagttgctgaagtagaacgtctgctctgaagtgaagaccaaactgatgactcccgaagtagattccatagaactcgttggctgattgattgattgcttcatcttgacataaagcttgtcgaattttgagagtcttgtatttgtgtagcccccgactctttggttagttgagaaacaactgaacatagagtcgagaattgtagcttcttgtcgtcgagtagtcattgcttgagtgaagatacgcatagaagatgtccgagtaaaaatcttgaatattggaacaccacttgttatagtaaaataacacggcattatacttgttgacgcatgccgagatgttgaggctcttgtagacgtcgtggtcggcgaagtagcaaagcttgcgaagtaaaggcaatagagtttgccggtgccgaagataataaagatgaagttgctcgaagaagtagagtgatgatgaaaacaaagacgttctttaaccgcggcaaaataggccagccatgaaagtgaagacgccatgggcggcggcaaaggcaaactggtgatgacgatgacaccagtcaatgttgacgaagacatgtagctgtggaggcgaacaaaccagtcggcgtcagacaaggcagccagcaatgaagacgatgacgtccatcagtagtggtagcggtataaaccagccgtagaggcgaggacaccagtcaatcagtagacaagacgactggcggtgaagactataaggccaatcaatagtatcataatcatgcagccatggaagtgaagaaaccagtcggcagcagacgcagacaacttgtgttgaagataacgacgcctattagcggtggcggcgacgtggccagccgtgaagacgatagcaccagttggcgtcatacgaggtggtcggtcggtgaagatgtagatgtctaacgacggcggcataataggccagccgtgcaggcggagacaccagtcggcggcggacgaaggcaagccggcggtgaagtcgtagacgcccaacaatggcggcataataggctggccgtgcaggcggaagcaccagtcagcggtggcgaaggcaagccggcggtgaagtcatagacgcccaacaacagcggcataataggccagccgtgcaggcggtgacaccagtcggcggacgaaggcaagtcggcggtgaagtcgtagacacccaacaacagcggcataataggccagctgtgcaggcggagacaccagtcggcggcggacgaggcggccgctcggtgaagacgtagacgcccaacaacggcggcatagtaggccagccgtgcaggcggaagcaccagtcgacggtggcgaagacaagctaacggtgaagatgtagacgcccaacaacggtggcataataggccggccgtgcaggcggaagcaccagtcggcggtggcgaaggcaagccggcggtgaagtcgtagacgcccaacaacaacggaataataggccagccgtgcaggcggagacaccagtcggcgacggacgaggcggccggtcggtgaagacgtagacgcccaacaacagcggcataataggccagccgtgcaggcggtgacaccagtcggcggagacgaaggcaagccggtggtgaagatgtaaacacccaacaacggtggcataataggccggccgtgcaggcggaagcaccggtcggcagtggtgaaggcaagccggcggagaagtcgtatacgcccaacaacagccgcataataggccagccgtgcaggcggagacaccattcagcgacggac

SEQ ID NO: 3406 - DNA, 9754 bp, Oryza sativa
  unsure (1)..(9754): unsure at all n locations
ccagccgtgcaggcggaaacaccggtcgacggcggcaaaggcaggccgacggtgaagacgtagacgccctacatcggcggcataataggccagccgtgcaagcgaggacaccagtcagcggtagacgaggcggccggcggtgaagacgtaggcgcccaacaacggcttcataagccgtgcagacgaggacaccagtcagcggcgaacgaggcggtcgacggtgaaagcgaagatgcccaccaacggcggcataaaagaccagccgtgcaggcggaaacaccggtcggcggcggcaaaggcagtgtaacgtcccgccttcccccaggccgggcccgcttatatctgatagctttcataggtcatataacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctgtgtaaccactccgggtctacaccagccatgcgcaccatgcctgcgcaactgcgacacacgcgcccgtgaaaccgcgagagtcggctctgataccattttgtaacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaactggagttctttggagattggcttccggaaaaaaagttgcaacttgttgatatgagtattctattaatcctattaagccctaggccgggatgttacaggcaggccggcggtgaaagcgaagatgcccaccaacggcagcataataggccagcggtgcaggcggaaacaccggtcggcggcggcaaaggcaggccggcggtgaaaacgtagacgcccaacaacggcggcataataggccagcggtgcaggcggaaacaccgtcggcggcggcaaaggcaggccggcggtgaagacgtagacgcccaacaacgacggcataataggcctgccgtgcaggcgaggacaccagtcggcggcagacggaggcaggccggcggtgaagacgtagacgcccaacaacggcgacataataggccaatcgtgtaagcgaggctgatttgcatgtagattcgtctctctgattttgttgacatgatgggcttggtgcagccaaccggccttagaggtgttgtgtgtggcatgagcgaacgctgcatcatcaacatcagtagtcgagccacgcactatgtcctggcgtacccctctcggcaacatggttacagtaggaagcattgcaccgacggccatacatgcaataaaaaatcatgagaagattaatatgcgttagtaattaatctaaatatataaattacaaggaggtcaggaaccgcagcactgccaaatcccatcactcgttaatgaacgattttttgatctcaattgccatcctgggcatgcgaccaaccatgcatcgctccagtatacatgcaaaataaacaaatataatttgattagccttaaaatattacatgcttaactgtgtaatacatatatcaagctagggtttgatattaagccgtgcatatcagttgatctgcatgtgaagcactcaattgctgttgatcccatggacatgaattgttcccgtgtcgtatgaaggttacgccggtacctatacagatcgtactgggcgacgagaagacacaccgggacttcgtcttgatctcagccggtgcgtgaaaacaagaaaaagaaaggtaataggagattagtctgcagttagagaacaatctaactagtgaaacgacaaagccaatgacattggagattgaatcgatgaaatcaccgagattgatcccttcggctggattgaatccgagatgaaaaagacatgcttgatgaatctggtgatgtcgcacattggttccatcacactcgtgacaggaaactcgatgctcccttacctgacgcgccaactgtcgaaacatgaattcggcaataataaaagggggtagcgcacgagacctaaaagtggatggatgcggagacaaggatttagacaggttcaggccctctcaatgagaggtaataccctactcctgtttggggatttgaatctgccgggtgtagtatagatctgacgatcatacgtgctcatgccccctagagggcctcctgcccaccttatataggatggagggcaggattacaagatagaaaccttaaccaatacggtatcggtttcctaaatctactttacaatcttatcgaaccaggactttaggccgttccgtaatatacaaggaaacgtaatacccaagtcatgatctattacatatttcatagatatatgagttatcccctataactagtcggataaacatgccgtgtgagtatggggtacccataatctacacaggaactttttgtgctggaagtctggaacttggtactgttgaggatttccactggtgatgctagataatgtttcattctgtaagggtttggaacttttgttcttcttcgcagcaatggtttggaacactaatgtaatgcttgtgcactttggcttgtgatttggtgctgctccaaattttcttgcagcacaaataattttggagatattttcttgtactacgatattttctatgtacttctgaatcggaatcacattggtaacttcgatctttaataattttggagtttcaggaagcagaaagaagcctagtgttccggtaatgggctgataaatatattggggcaattgcaaatttgccacaattttaaattgttattgcaaaactaccacattcgaatagcattcttgcaaaatatcataaaaaccagagttgtaagttagattaagaaaaacaatggacaagtttgcaaatgccccaaacgtataagatttacataaaccctgtttacacccaaatttggcacctagagattaaataggagaaattgccaaagtttggaagtctgccggtttcctccgagtagggccggtctgaccgccgtgcgttgggctgtcagactgccggtttcgggccggtcagaccggcggcatgtggccggtctgaccggcaggtccgagtccgactgtgtttcgtcgggtctcaaggtttccttgctcgggaaggcatgtttcgggtttcctttggtttctaccccgagttggacgtggaggagggcctgtagagggcaaaaccaacccctatataagggatatggccagttcaattataactaatcaatctacaatcaatcaatcgaatcgtttttcatattgcttttaattttctcttagtttgtccatctttgtcgatttgcaccgaaaattgtccaccgccgctgcgagagtgcgacacccctttgttggtttatcctgaaaaccttccgttttgcccacgagacgggtagttatctagaaatcggctccgctagccggtttagttatcaaaacccatcttggtctagcttttggctagatcgaggtggttggcaactccaaatcaccgcaaggcgtttaggtgctgcgatcgtgcttgtcgacttttcacaaaaagttgccaacacgaattttggcgactccgctggggaaatccgttcaacgccatctcaacttcgacatcgccatgacgaagcctccatcaaccaaggcggaggtggatccatccaatgtgctgccggtgatgatggagagtcttgatgaggaagcacgcatggccttcgatgaacacatgaagaagtatgccgacgagcttttaaagacatgctcaaagacccgtcatggcgtagtcttcaagccggatttggtgtcttcatctacttttgacaaggtaagtattgaggaattatcacaatctcttcaacaacaagttgctcatacaatagatgcatctatggttgctttcaataacaaattagaagcatcttttgaaaataattgtgaaaagtttatgagaaataaactcggccctctcgtggccgattttgtaatcaaagataaagcctctaccagtgctagccaagctcctatagatcaaataaatagtaaaaccgatggagcgaagacacaacaaatcggcgagggctttccggcgcaaactgctgatcagaccgggccagataaagccactgccggtcagaccggccagatctggccgggtttcaccccggcggtcagaccgggactcaggccggtctcaccgcgcctatggacgccggtcagaccgggctctggaccggtcaaatcggcacaatagtgccgattcaggggatagattcaatgactaatgttagttatttgtattatcttagaacatttggtcctcctgtatctactgctgcaagtaatccccaagttcccccacatgttcctaatgcttataatgatgtttctagggggtatcctcctgatactaggcaaggccaatataatcatattgcgccacaacatcaacctattaggccaccaaatccaccaccaaatcaacataggcctgataatatagagcacttgattagtggaattattagggataaattcaggattgaagctaggaatcgtgctaaggtttaccaaaagccgtatcttgattactatgataatgtgccatatcctcgtaattatagggttcccgaatttaccaaatttagtggtgaggatagtaggactacatgggagcatgtaggtcaatttttagagcaatgtggagaggctaatagtgatacttttaaattgcgcttattttctttgtctttgtccggtactgcttttacatggtttacttctttaccgacaaattctattcatacttaggctcaattagaatagatatttcatgattatttctatactggtgaaattgagcttaggttatctgatttaacatcggttaagcaaaagtataatgaacctatcattgattatgttaagagatttagagatgttagaaaccgatgttatagcttgaacataactgatagagatttggctgatcttgcttttaatggtttaattactcctattaaagagagattagatggccaacaatttattgatgttagtcaactcatgcaaaaggctctggctcaggaaagccgggttaaggataataaaaaatctgttagaccatatgagaaaaagcctaatgttaattcaattgattactttgaggctagtgatagtgatgatgagggtgatcatgacatatatgttgctgagtggacatggactaacaaaaataagccttttgtttgctctaatttaatgccgactcctcgtaaagatcggcaaagtgagattaagtataggtttgatgtggccaaatgtgataagatttttgattatcttttgcaagaaaaacaaattagattacctaaaggccatattgtcagggttatggataccacatacccaatagtagttgactaaatctcggcaggacccaccacataccatgtcttatacggaaactgactttgagttggaggaagttctggataaggaaagacaactagagttctatatggaaacggcaaggactagtcggattgtatccatattggactccctagttctacttggacaaggggacacctatgggtataaatacaagaccccctaggaggagaggggacacgcaacaatagaaggaacaacagaagccaacatacgccaggacaagccgccggatattaacatcagagatatgcctaggaggaccctatctggtacctatggaggccggctgtagggatctagcgttatctctgatctcgccgggcacgagttcgaggaggaagactaccctgttgtcgactacgagttagcacttcagactgccaagtcgacaacagatagataggctaccacaaatattgtactggtgtgattatggtgaataagagcaacgatcggcttcggccaacaggatgtagggttattacctgacaattcaggggcccgaacctgtataaaaatccctgtctatctcttttacctcaatctcgcgtatatcctagtaccaacgatccccatactatgcaaataccggaatcgcgacatcaaacgttgacacatatcataccatctcaagaagaattgaagcgtcgagcttattgtaaatgtcatgattctcattctcattctactaatgattgcaatgtgtttcgacgacaggttcaatcggccatagatgaaggacaattgaagttcactgatggttccaagatgaagcttgatcatgatcctttttcggtgaatacaattaatttcaatgataagaaggtgttgattcggccggagcaagccgaatctactaaaggaaagggagtgatcattggtgaacctaggccaaagatgatagtgccaaagaaactggaggttggtgtatggaaggagaataggagtgaggcttcaacttctaaagcacctaggaagactaaagtgactttggacatgcttttggagaagtatgagaagcaaggtggtgagagaactcgcaacaaaggaaaaagaccaagatcacctcctagggagcgatttggtcattcaccaaaacggtcgcaatcacctccatatcatcattcacaagacatgtcatggggaccttatccaatgccgccaccgggttatccttatccttactacatgccatggggggcaacaccgccaatattcaaccatatgcctccaatgcaattcaactaagggtggggaggaccaaggaggccaattcatgagcgcttgtcttcaccaaataatagccggttttatggaaaaaatcgggttaatgaagaaaagagggaaggaaagcgtgttaaggtggaggcaaggacttcggaggtgattaccatcaaagtgggatctcatgatatgccaataccttctggagatggagttgggaagtcatcaagcaacaaatccgaaattgggaccagctcatcgcagttggccggtctaaccaggccctctggccggtctgaccgtagctctgcggaccggtcagaccgggccatcaggccggtctgaccaccgacccaatgtcggtctgaccggcgcttctagccggtctgaccggtggtctacgtccggtttgaccgggcttcaacgccggtttgacaggaggtttgaaaggagtagtgcaggggcttcattgtcttcaagcaaaatcaatagggggcattatttacctcctggaacagagccgaaacctaggtggatccctaaggatttaacggctactcaaaggagaaggttgcagcatcttcgggcccaagagataagagagaaaaaggccgaagagcaaagagataagaggttcaatgaattgcgaccaccaccttttggaggcataaatccgtagagagggaagaaccggttgttgtagaggagaaagaagaacaatcggttgctaaagatgagtcatctccaaaggaggacatggatatcaacatggtgtgtatgttgcctatggagttttgtgctatggatgaagccgaggttgctcaattttcactaggtcctaaagatgcggtttttgagaagcccgatgaatcaaaccgtcatatgaagcctctctatctcaaaggtcatgttgatgggaagccagtctctaggatgctagtagatggaggtgtcgccgtgaacttaatgccgtattcattattcaagaagttggggcgtgaggataatgaattgaagaagaccaacatggttctcaatggcttcaatggtgaaccaatggaggcgaaaggtatcttttcggtggagctcaccgtgggaaacaacacactaccaaccgctttcttcatagtcgatgtgcaaggtaactacaatgttattttgggtcgttgttggatccatgccaattgttgtgtgccttctaccttgcatcaatgtttgattcaatgggacggcgatgatgttgagattgttaaaacggatacatcggccgaggttgcaatggccgatgctacatttgaatggcgtcatggaatatccaatgcttatcggggagggatctttctactatgatttcattagtatctccgatggcaaatttgtacttatctctgtaaagccggctagtgtagcacggctaggctatataaatttgtataatgagtaaagaagctaatttagagtggttgcaaaagagggtgcaagaatatcggtctacaaagaacgatattggtgaaactattgaagattttgatgaagtagagaagcttggacaagggtttacatcggccgatccattggaggaaatagacataggtgatggaacaaagccaaggccgaattttgtaaacaaaaatatgagagccgattataaggttaaaataatcgagctacttaaggagtatgtggattgctttggatgggagtatcatgagatgccaggtcttagccgtgagtttgttgagcatcggcttccaatcaaaccaggttttaggccttataaacaaccacctcgtcgttttaatctttgctatatgatcgagtcaaagaggagattgatcggttgttgaaggcggggtttattaggccatgtcgttatgcggagtgggtttctagcatagtcctggtggagaagaaggggagtggtaagattagagtttgcatagattttagagatttaaatanagctactcccaaagatgtatatcctatgcctatagccgacatgatgatcaatgatgcctcgggtcataaggtgattagttttttggatggtaatgctggctacaatcaaatctttatggcggaagaagatatgtacaagacggcttttaggtgcccgggatttgttggtttgtttgagtgggttgtcatgacttttagattgaagaataccggtgcactatatcaaagggcaatgaatttgatctttcatgatttgctaggtattatcttagaaatctatattgatgatattgttgtcaaatcggatggtatgaagggacatatagccgatttgaggttagcttttgagaggatgcgccggtatggtttgaagatgaacccacttaaatgtgcttttggtgtgtcggcggggaggttcttgggattcatggtgcatgagagaggggttgagattgatcctaagaagatagaaaagattcgtgatttcaaagcgccgacatgcaagaaggaggtccaaaagttgctaggtaaggtgaattatttaagaagatttatttctaacttagcgggtaaaatcgatgcttttgttcctatactccgcttgaaaaaagaagccgattttacttggggggcaaaacaacaagaggcatttgaagggttgaagaagtatttatctactccacccgttgtgcgggcgcctaaagccggaaagcctt

SEQ ID NO: 3407 - DNA, 1337 bp, Oryza sativa
attcctgcagcccgtagaccatcatgtagatattgcttatgaagaaggggtttgcttagttgaagttataccttagaagatttattttgatggttcttcatgcaaagaaggtcaaggtatagaagtagttttattttcacctaatggcatgtgttatgaggcatcggttcatttggagtattattgtacaaataatcaagccgaatataatgctttattattcggcttacaagtgatggagatgattggagctaagcacgtggaagcttttggtgattcggaattggtggtgcaacaagtcgccggaatctacaaatgtttggacggatcactaaataggtatcttgattcatgcttggacattattgctaatttcgataattctagagcaaatgatttggcacaacaagcatctggctataatgtgaagaagggattatttctgatactagaagagccggtgcttgatttttaaacctttgtgcaaaattggcaaaactggagaccaggggcggtctgaccggcgttgcacggccggtctgaccggtgagcaggggcggtttgatcggccacatgccaccagtctgaccagccaccccgggcggtctgatcggtcttgtatggctggtctgaccgattctggacagagcgatggggggcacgccgcaattgattcaaagaccgaattagctgtgaattcggacatttgtgcccagggaacagaagagtccagatcggctacgaccagatcggctgagtccaagtcagatagggttagccgatacagccgattccgacaatatgaatcggtttacattatcgagctgagttaatgtgcttcacatggattgccacacatggatagagttctaagaaggcaattgtatctattaattaggatattttatgtaatttccttagagataagtttgggcaaaagtctgctgcaaagacttatggtatcttagagtttgttagagataatagtcgtgtccgacaaaggacatattttgtagtctcgggtataaatagaccccgagtcccatgtaatcaattaacacacgttcaaatacaatcttggcgcatcgccacccttttactttcgttttgtttcgacgagttcttgctttcgggttgaactgcatcggtttcgatcttcaactagaggtatgacttgttatggtggcttgcgttctcgagattggtgcttccatcattatgatactctaatcctatctatgtaagttgttgagttatcatatatcttatataatctctgacaatatcgctatctaacctccaatcggctagtgtctatcgctggagagcagccgatt

SEQ ID NO: 3408 - DNA, 1752 bp, Oryza sativa
atctatttgatcagctatgctgtgaatgattatagtttccttgttaatatatatttcggtctaagtgatttatactgtctcggcatggcgaccgatctatcccaattacttgatttaagtatatatcgacatgaagattatttatcattgatatctacagccgattgaatagatttagtttctttattattgcctcgcacagccgatcgatgcaaagatgacatcggctcgagtacaaatgatacgtcatcggcggctggtcgatcggctatcatttatggactaactactatttctttgtctttatttcttgttgattgcaggatcaaatcaactggcatgctcatgaacctcaaaggcaagattttggacctgcactagagttaagcagatctcccaggcctcgtgtttttacatcaacactctcttggcacgcccggtgggacctgagttttcaacgacttcatcccgatggccgaaaaaccaccaccatcaccgggaacaggagtcaaacctcccgtaaataaaatgggggccaaaaatccatcagctgaagtggacccaaccaatattgttccaatcacattggataggctgacagctgagcaaagggatgaacttgaacagatgatgagcaacgtgaagaacaaattcatggattcttttcaggagacccgcagaggaaccatcgtacaaaagtacaagttgaaggtggtcgcagccgatgaggtcagcccaagttcatctcagggtgacaaaggtactgcaactggctcaggtaacaaaagtgatattcctcaagatggtacagttgaagaccttggtgcagatggcaaccaagagccactgcaattcaataattttcaagataggatcgactatgccgtgcaacatgccttgatcaatcagtctggagtattagttaataccttaaccaatatggtaaagactgttgtcgatggttcgatagccgaacatcaagcttcaggaccagtctatttaccaggaggtgtttttccaaattatagaccattggtcacagcaaatcagtcgaatgtctcccatgcattaccggctcagccgatggcttcagcttcaacttctgcacaagctacatcatcagtgtaacgccccgattttcgttcgggattaaaaatcattaaataatgcattttctagaaattaaataaaagttaaatcaacttaatcaagtgaattattgggagaattaaaattttcccttaaaaatcattggccgggaatattttgtaatatcctttgtgccctaaaatactctccggaattttccgtgaattttcggagctcaagaaataattttaataacacaaagatcattgtatcaattaaaataaaaagaaaacaattaaaatcctctttcctctctttgggcccctttcggcccaacccctcctttctctccctctcgggccggcctcctccctcggcccgctcggctctctctctccctcaagtctgttttgcctccccagccggcctctccctccctctctctccgacaggtgggacccgtggaccccacctgtcatccccaacctcaggccggcagctgccgttgccgccatggccgcccgagccgccccacgacgctgccgtttccgcccaccttctccaccccgcgcgcgcgcgttcgtccgtgggacctcgccgcccacgtccgcgccgttttcccccatctctcccctgcaaaaccgccacccacaccccacgatg

SEQ ID NO: 3409 - DNA, 6923 bp, Oryza sativa
cctcctccaccgtttcccccatttccccccaagaaaacggcgccggtttgccccgccacgagctccacgtcgacaccccgcttcccgccggttgccgccccaaatccacctcgctcgtgctctctcccaccctctcgaggctataaaaacgatccctgtgctctcctctcccatttccccaattttcccgggcccgtcgcgccttctcccgctctccccgcgtgaacccgagctccgccgctcgtcgccgtgcttccagccgcacgccaccgccgctccagtcgcccccgcgctgcgccgccaccatcattggcatcgccgtgccgtgccgcaccccggcccctactccttttcccctctccgcctccgaaacaccactgcaccgcgcgcccgagccccgccgcccgccagcgccctccagccggccgccaccgtcactcccgccgtcgctgctccgcgcaactgtcaccgacggcttcgttgcgtcgtcccgtaccccggcatcccctccgctcctccattccgccgctggaaccgtcactccaccacaccacccgaaccgccatcatagcagccgcctccggctgccactcgccgccgctccaaaccatttccggcctcacgtcctcctccagtggcatcgcagcgtcgataggaagcccggcgttcccctcatccgagctccccgtcgccgatgcccgttcccgccacgcgaggtcgcggccgccctcgtccgcttcctcccgggcgccgcttgtcgccggagcagcgacgccatcctccgcccgagctccgccggccgccttccgtcgccggcgcccctcggtgaggaccccctccatctcctctccctttcccctcttttcgtcgcctcccgcgcgtgctgtcgcgccggtggtcgtcgccggcgaccatcgggccgtgcgccgtcgctcccggccggccgatcggtcagccggctcccgctcgcccgtggccgcccgatcccccttcggggcgatctgggccgtccacgtggccctcccgtgccgcccgagtcggtgcctctgtggcgccacgtcggcgccacctccgctagccgtccgtcgtggccgccaggtgtctgccacgtggtgcgcccgcggaccagcgcgtgcgtggactcggtccacggtgtgcccgccacccgtgagtcaccgacaggtggggcccgcttgccggcgccacctctcccccgtcggatgacgtcataattgatttaaattgcgcaataaatcggtaataattctagaaatccattaaaatggctcaaaacttccaaaattcatatctaattcattcgaattccgaattgagccattcaacttgcaaaattcatctaaaattgagctctacatgtttgtttagtttttatgtactgtttccttggtttttattagagtttttcctcgttttgcgtgccagcgtgtagaatccgtcgtttcggaagtccgcggtcgcgaggaaaagagtttagaagatccaagtgaagaagcaaggcaagtcacacattccccttgagcatgttgatcctaatttataaatgttttaccgtttacaaataaatatgcatgttttgctaattacacggggtcagggtttacctatctgctcgcttgtgccatgtttacttgatatctatcctttgtcaaccttgggtgataaattgactagctcgtgttacttatgtgacctagctagaactatatgcttagccatgcttaattaccactagctcagtcgatgggataattgcagtattagacattctagtatcttgttgagctgcgtgctcgagacgtctggccatgtttcatggtcgtaattatccaactaaaatacgactgaatggtgggctgtgggtgcatggttttgcgagtcgcacccatggcaattaaggaccggttcacgagaaaccctggaagacttacagtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacacggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgtcactttaattattcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagacgaagttggaagaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaatcagcaccaagacagatggttaaccccagattgttgaccagagaacaaccacaacatgctgggcaaaatgtcaatcggctgactcaggagcaagttgctgcaatgttcttgccaaatccgacaatagccgacccaacacagccgttgccgactcagcaagcacagccgaggtagcagacagttcatccgactcagcagcaaaacttacaacatgcgtcagcgagattgagaacacctgacaatcggccaatgcagcatactgtgaaccaagttattcctgaacacttggtccatcatgtacaggccgatcaatcagttgtgcctcagattatccctgaacatttggtacgtaatattcaaccgaacttctagaactatcaaggaagaaatttgaattatcaatatcagcctctgtcacctcatgtttagtatcagcaggcaggatcgcctcaacctcagtttgctcctcagttcaatcagtttgagctaatgcagcaacaaacacaaggagtacctcagcaaacatcatgggctgatatgattgccgatgtaatgagggagcaggttgggttcaaaccaaaagatactggaaatttgtatcggcatccttatcgaatatgcggcatattttttggaaattcggtaagtggtctcctagtagggaaggtccttatcgaatatgcggcattgttcgagggaacgcatattttttggagacacttcaaggggagccttttcagcgagcaatcaacgggaaatacttgaagaaatacttcccgagcgtttggcaagacgcttaggaggtgctatggccagtaattggattatcgccctaagaccaaaaacatgttctatgcttttggattcacgttgttcataaaaaaggtagggggggcatgtgtttacacccaaatttggcacctagagattaaatagaaaaaattgccaaaatttggaagtctgccggtttcctccgagtagggccagtctgaccgccgtgcgttgggcggtcagaccgccggtttagggctggtcagaccggcggcatgtggccggtctgaccggcaggtccgagtccgactgtgtttcgtcgggtctcgaggtttccttgctcgggaaggcatgtttcgggtttcatttgatttctaccccgagttggacgtggaggagggcctgtagagggcaagaccaacccctatataagggacatggccggttcaattgtaactaatcaatctacaatcaatcaatcgaatcgtttttcatattgcttttaattttctcttagtttatccatctttgtcaatttgcgctgtaaatcgtccgccgccgctgcgagagtgcgacacccctttataggtttgtcctgaaaaccttccgttttgcccacgagacgggtagttatctagaaatcggctccgctagccgatttagttatcaaaacccatcttggtctagcttttggctagatcgaggtggttggcgactccatatcaccgcaagtcgtttagttgctgcgatcgtgcttgtcgactttttacgaaaagttgccaacaaacccctctggatcagagcaaatccactcaactgcacgcgtgtgcatgtttcagaaacggattcatcgcaacagttggtttacgatttcgtaataagttgaaattagactcggattagatcggtttcatgcaattaattaatatatactaataaaatagatgatcgacaaagcatattactaattgatttctccgtgcaaaccggtcgctagctcgctggacagttgtcgtcatcaatggcggaagaagatatcaacaagatgatgagctccgacggggagatatcatcaatggcagagagggcggcgagtctgttgcgggaactgcggcaactgatcgaggacggctgcgccgccgccaaacccctcgccgagatggtcgagtactgcgccaagcacgccgccggcgacgaagctgaaggcaaggaagaggaggtattagatgatggcgagtccagcgacgatgaggaggagacggacatgctcaggctggaggccagctcgatggacgtggagaacatgctcagcgtggccgcgcagcgcacggcggagctcatcaaggacaaggacaagccgccggagccagagccgtcgccggagccatcgccggagaacgaccccttccacggctttcacagtttgcattcatttactgagcactgctacacggactaattttttttattactaaacttttactaataatcgtctcaaccatttgatttaggtatatgaaagttatgaaaaatcggcgtacactcatatagcgtgacacgtctaccctaaagttcaacaaatatctaccctatagttcaacaaaaacaaattctttcactcattcactcatcactcattctttcattcctcactcaacggtccagattacctcactctgatccaacgctccggattcaccccacctccctccccaccctgacagcccgacctggtgacctgcgccccctcccccaaccctaatccctcctcttcccctctcacgcgctgccgccgacgcccttcacctctctgccaacgccgcccgcgtctccgcgccgacgcagcccgcgcctccgcgcatcgcccttcgcctcgccatcaccgccgccgtcgattgcctccaccctctttgatgccctatccccgccacgcgcagctgcctcgccggggatgacctcgcgtcagtgacagtggtccagtgctcaatttgctgctcggtctgcgttgacactactgaggtctacggcgaggctactcccctcaggtcttatctcaatcccccgcctacggtggtgtatggttcgcatactttgtagtgtcctgttgaacttcgagtcatttttctcactaagaaaatggtaggtgataagatatcaggtacttcggttttattgtctctcaaacatcagtagttcggttgtgtgtttaaccaaatgaagcataatataatgtatattcttatgacaatgtattagatcgaacaatggtttttttaggagtattaatttggcactgttattagatccaacaatggtttttttaggagtattcaatttcaatgtaatctggttcttgatctacaaagggttcacgtgtactgtgttggcttggggtccagtctcctcctcctgcacgtgatgtgtgctgaacacggcggagaaataatggactgccaacatgatcggacaattcattgcttcctttagtttaacttgcagtgtgaatgattttcctattaagaacgcatgaagtcagaattaactgaaagaaagatattgcgtgtttaattaaactatccacagaatctgagtaattcagttcattttcttcacattcttttcaagaatagtctctgatatttcgtattagaattgcatgcatatatacaaccctgtctaattatatctgttcaaaataatttcagccagcttgacaagcaataatttctcaggaacctcaattggcaatatcaccacacttctaggaggaggagaggctgctccgcgggcttcgtagggatcccggcgagctcgcccccgtgactcctgcttcctctggtgtggctaaatcagttacggctcctctggggctttgcttgtgccttctgttctgattaggttaggacaaatttgtaacggctttgtggtctaacatttgctctgtgcggccgaattttttggtggccctataataattgagttcaactaatctaccctttagagcaactcaaatatcgatctgtcttttgttaatccaagcaacacatatgctgcaatggataagaacaaagaatatggtgctgttataatttacatgtttagaaaaaaaaactaatgcagtaaacacaattattcatggaaccaatgataatttacacttgctatggatataatgtcctgtatatttcagaatagagtaaagtgcacgagcggtccctaaacttgtgcgggtgtgtcacctaggt

SEQ ID NO: 3410 - DNA, 1644 bp, Oryza sativa
  unsure (1)..(1644): unsure at all n locations
atgcatggttggtcgcatgcccaggatggcaattgagatcaaaaaatcgttcattaacgagtgatgggatttggcagtgctgcggttcctgacctccttgtaatttatatatttagattaattactaacgcatattaatcttctcatgattttttattgcatgtatggccgtcggtgcaatgcttcctactgtaaccatgttgccgagaggggtacgccaggacatagtgcgtggctcgactactgatgttgatgatgcagcgttcgctcatgccacacacaacacctctaaggccggttggctgcaccaagcccatcatgtcaacaaaatcagagagacgaatctacatgcaaatcagcctcgcttacacgattggcctattatgtcgccgttgttgggcgtctacgtcttcaccgccggcctgcctccgtctgccgccgactggtgtcctcgcctgcacggcaggcctattatgccgtcgttgttgggcgtctacgtcttcaccgccggcctgcctttgccgccgccgaccggtgtttccgcctgcaccgctggcctattatgccgccgttgttaggtgtctacgtctttcaccgccggcctgcctttgccgccgtcgaccggtgtttccccctgcacggctggcctattatgccaccgttggtgggcatcttcgctttcaccgtcgaccgcctcattcgccgctgactggtgtcctcgcctgcacggctggcctattatgaagccgttgttgggcgcctacgtcttcaccgaccggctgcctcgtccaccgccgactggtgtctccgcctgcacggctggcctattatgccaccgttgttgggtgtctacatcttcaccgccggctgccttcgtctccgccgactggtgtcaccgcctgcatggctagcctattatgccgctgttgttgggcgtctacgtcttcaccgaccggccgcctcgtccgccgccgactggtgtctccgcttgcacggctggcctattatgccgctgttgttgggcgtctacgacttcaccgctggcttgccttcgccaccgccgaccggtgcttccgcctgcacggccggcctattatgccaccgttgttgggtgtctacatcttcaccgccggcttgccttcgtctccgccgactggtgtcaccgcctgcacggctggcctattatgccgctgttgttgggcgtctacgtcttcaccgaccggccgcctcgtccgtcgccgactggtgtctccgcctgcacggctggcctattatgccgctgttgttgggcgtctacgacttcaccgccggcttgccttcaccactgccgaccggtgcttccgcctgcacggccggcctattatgccaccgttgttgggtgtctacatcttcaccaccggcttgccttcgtctccgccgactggtgtcaccgcctgcacggctggcctattatgccgctgttgttgggcgtctacgtcttcaccgaccggccccctcatccgtcaccgactggtgtctccgcctgcacagctggcctattattccgttgttgttgggcgtctacgacttcaccgccggcttgccttcnccaccgccgactggtgcttccgcctgcaccgccggcctattatgccaccgttgttg

SEQ ID NO: 3411 - DNA, 14305 bp, Oryza sativa
  unsure (1)..(14305): unsure at all n locations
aacctgtgagcacttgattacctatcactcactaattcttttgacagccagtaaggccaacaagtaataacgctaaatagttgacagttcaatccaataaactattgtctactccctccatccacaaaatataagggatttgggggttcaagtttgtccacaaatataagggattccaaccacccttcatttaattttcacccacccttacctccacggctccacctaccctctgactccccaactatcccttagtctttccccctgactttaatctctccaaaagaacctaaatcccttacatttgtgaacggaggtagtatctactatagcatattgtgtagcagggttcagaaacatgcaccatatagggtaaatatcagtaagaaaattaatgagaatatactaacttgatcttttccatgaacatcagccttaactagcttggagtagtactctttacggccatcgcttgacacatcctcctcgtgtataaaagcaacccgaagagcttcatttctacaagttataagaacaaaaatcagcatttattcaatggtacagtttacagcatgtaacaacaacaattaagataaagacactaatcagggaacttcgcataatgaacacggaaccaagaacacctagcacaccatacacaccacacaaatttaccaagctacctttgcattaagagcgcaatatctgcagcctctggtgctttcctttgcttctgctgtccatatatttggcaagaaacaacataagtaaatttagatctgcttgggcccgtgcatctggagacacctcataaccttgagtgtcaatatattcagctgcagaatatccatcttcaatgcctggtagaacaatcaaaatgatgaagatagccgagaaacgtattgaattaatctagtaccaacagaataccaaatacgcacccccaagatatctcttctccaggtaactctgcaacatcaaggcccttcggtagtacatcatgccacgcactgtttcagcaaaatatgaaggaatatagcaatcaaatggtaggacaagacatgaaatttgatatgagaataaagttgatatacaggtgtagcattaaacatactatattggttggatatgaactccattgcaactttatcatttatattgcagacaaaagaaatgaaacaacaaactgacctgtccttgccaaagtttgtccacgatatgatacccaaaaccgcagttctaacatgtcacttggactttccttgaaatcatcttcggatgattctccccgaccgattcgttctaagaagttgttccactcatctgcaaaccaaataaaacgccatgccacaaacccataacaactcaccacattataatgaaaacaagcatctttagataaatattgattttgaaaatgctaattattatatgttgtttggagttgaaaattgttatgtgaagacattagctgtggtctgttatggttctaaagggattcaaggttttattttattttcatttatttattgcaataatgattctttaacccgttacaatcaacggataactactaaccataatctataagcaattatagtattaacaagtcccagcgctatccacttatttatataggtgagcactaaatataaatatgtaaagaaggagcaaagtatgtccaaaagtaaagaaccttcagagacaataagatattgtaataaagcagcggaatcataacaataccaggatagattttttgaagatagaaaagtatagaaatgccatcttcgttctcaacacatagctcagacatgctataaagcactgtctcactgtagtatggggtaaacacactgttgcacaagataattaggtgtcaataggttcctatttttgaaatagaatgaagtccatacatatttacagtacctgaagggtatcatctccgagacaggctttgctgccggcatatccatgaatagagagttcgtaaaaaattgcaaccttctctgagcttccaaatttttgggaatgttggcagcagagtctttaacagtcaaaagtaggtgtaaccgcttaacttgttctttctgcaggcaaacatagtcactcaaccaaggatatagaaaggccaagcaaatttcagttatttgcataagagaagtaccatttccagatcctttggccagaaaatcctagagaacagacgcccctcatttctagctcttaacagtagttgccatgtatcgaattgttccctgtaacaagaaagagcatattttcagaagaaaataaaacggagctatgtcttttgcaaattaaacagcgagttctcaccacatacctcaggttcggtgccagaaactcatgggtaacaacctcataaagctcacggagagcttttgtaacaccagctgcacgatcagcagtttcatcgcgtatctaaaagatattcaatttaccacataagatttcttcatggtaaatttaccaaacagaaaaaataggaaataattaaacaagaaccaaggcacgatatctctctatttgcattttactccaaaataaagtgcaatagtctttaccagaagtcctgtcaaaccagtaagcctcgactggactaattgcagcttcttgagatttatggtcactaaaagtgaaccttgtgctatactttcattcagatcccgaaaaagcctttcaaccctgtacatgtatcaatagtatgcattggcattaagtaaagaaaacttgggggaaatacaacacaatattggtgtcagtatcagatatttcatctttcagtaggaaagcataccaacgctgcccttcaccatcaactaaagagtgaagaattctctctgcactgaaatagcattccttgacggcgtaggccatgtattcatctcttgatattctgtcccataactcatactgtgagtctttacaatctgaagcatagtcattcgccaacataatctacaaaagaaaaaaccaacagattcatagcaaccaataaaagaatatatatgcaaaaaagggatctatctagctaatttcaattaggataccttgctagtcagaagaaacaatggccactgtacaagtcttagattgccacagttacttggcatcataagcaaatccatttccctgaaagagaactttgtcatgatactgaagcaaatgggatataacaaaataacaaatggctgtgattacatgtacctgttgctgatatagtcctcttcacgtaagctcttaataatatcattccaaaacggggagaatatcgaggcatgcatcttagtaatttctggaccctaatgttgagacaaccaaagcaatggtacatacagatattacacttgatagaacgtcaaaaacaagactagtatatcagctagcctgattttggggagctagattgtggtcagatggctaagtggcgcaattgtgcatccaaccctctacggttcaaatcctagatttggaggttgtccaccaattttaggagtgtacatgcatgcaaattcagtggatgcacactctaggggccattcggtgcctcccataatatttgaagcgcgcaggtgtgtgcgtgtgtgatagtgtgattgcggtgtgtgtccaaatgtactcactcaaaaaaaagccagatctttgaagtggatagaaaacggaggtcatactaatatgttcaggctatcataagtttagagaggtagcggcgagaataatgtaagaatacaacaaatctggtgcttaacaagttaagaataaacctagtagctccagacagaagtcacggaacaaactaaattagaatgacatgtttggtgaagtttaaataattgcatgtcagaaccaatctattgaagttagtattagaagcaaaatgtaagtttatttacctgagcaactggtccgttagatatcctgcagtgttacacaaaaacagaataaaaaccaaggatcggaagatcaaaatcaaattaaccaaacgacagatctaaaagaaactataagatctattaatcagctcctatcatgagcagacagaatagcaattctggattagtgggagcgagtacctcagtggggaaagggtttttgcaaaagcttcaggaaagctctcaaaacgtttatgaagcatttctattgaacggatctgcgttaaattagcaaatgtaacgatgattacagtttgcaaactacaaagagtgagcatacagttattaagtacttcgggatagttctagaacatcagaacaaaatgtacctctccaaggcgatctctagcacccataacaccaccaacgagagcagataaaagagtgtaccaaatgtgaatgtccatcaggtatatctaacatagaaatgaaatgaaccatgtatcattttcaaagttcatcttattatttcatagaaaattacatgtcaacacaagaaacttacagctaagactggtgcccatagactcaggatggtcaaagcatttttattccctaaaatgaaacactgtcaggaaggaatttgcttatctcgtacttagaggaaaaaagaagaaaatagttttcttcttagtaaagctgtagcagaaaatgggcaatgcttttagtgatatgtgcaaaatgtactaaccacttgatacaagatcatgccaggaataatgcagattacggagtgtcacaatcacattcgtaggatcgactagaggtcgaatctgcagaaatgagataacacaataaacaagagtaaattttgataacacaaaaaaataataaacattaaaattctgaaatacacagttataaccacctggagaaaatatgcaaaagtaaatttgcatgccagtataaccaaccaaaacacaacgtatctgcatcagaatgtcacaagtaaatagcataccatgaccaaaaaaatagctataagagaaccgctggtgaattattcaaactaacaggttggtaacgaatcatgtatatggttaacaaatcagaaaaaatattcaagctttttcttttttgcgatttccacataacgactgggtattagaattttttttcctaatctggagagatcaccagaaaaactaagaatgccttgtacatttccaagaatcatctagagtaaaagaaaagaacctggtatattcgcctatactctcataaagtcctcgtccaatataatatcgctcctaaatgcaaacaggagaaacaatataagtacacgatttcacaatgtagatatgttgcaaactactgcgcaggatgacaatgtgcatacttggtatatccacttaaagaattggaaaaactgtgacccatcagaaaaattggagagcctgtgacacgctggtatcttggccatcaatgcaaacacaagccgaacagcagcataaccaccaagaacaagaacgtaaatccggaaataaattgaatcagagcttcttgcatttttctcatccaagactttcctgtttgacattcagcattcaagtgaggtgacttgctgtacattaaaaaaacatgaacaaaatactgaatactcacaaataaagataggttacaaatgttgagactgcagtcaaccaaatgaaccggatgactaatcttgatagggcaaaacctctagctgtcttatatgctccaaacatgagcagcacatccaagcagcctagagaagaacaaaaccaccaaagtcagcttaggaagtatcctttgattctagtccacataacaattagaaaagggattctctttatgtcactaagctgtacattcatcttggtttaacattttgactgttaaggctacatgtcagatgaacccagtggcaaaaaatgagatgcatgaaaagcttcgtgatgaaacaaagtatatccgccaaaaattgtaactagcaaaagtgaaaccatgaacaaagaaatagagagcgtacactcaatgaagttcagtatgaaaaatgctggtccagcactaactaatattttaatggtaccaatgtctatcttcccatgatgaaaagctataatagttaggcactgcatcagaaaagagcacttttagcatcataaactgtattcagaaatgatacttggatttaagctatacatgtgtacaagtacgatatcaaaccactgacctggaacattaatattagaaaaatccaaaggcgatgaaaactacggtacaagtgcagaaaagtgcgatgctcaacaaagtttgtctttccagtctgtaaatataaaattaaaagcaaagttaagtgcacataaataaccataatgcaaacaagatatgtacaaattttcagtaaaataaatgtgtccatttccttctagtcattgccccagccttagtcatcggtaagacccaatattttacataactaagtttaatgcccgtaagtttgctatgggttaaaaatcctacttccatagcacagcaagcccttgtcacaaatcccaacacatgccacaccatatgttcttctatggtgactgaacgagctccgctttgacctctgttatgcctctacggccttgcactacctacatcttgccctcttttacaccgcgcacaacccactttggatccactgttagtggacagtgggagtgtagagcacaccatgttaccatcacaatcaccaagtgcatcttttaagtaataggcataaggataggttaggatgaagattgaacactgcatgtttacttaacagaatacatattcttttaatactctccttttcagtcaatagatacatacaactcctttttaatactgaggcttattgttctcactctacatattcattacatgattgcagtagggtacgtaagtgcccattttgtagcaacgactcctgttctacagtacctgtggtacaacttatgtgaatagaaaccatgccttggcccttaagacagtctctactttcctaacaatggcatatctctaactagggatgaaactggttcagatagtcatttttcggattcggatagtttcggtcggaattatccggaaattctcggattcggaaacgaattcggatattttttctcggaaacgaaaacgaatacagtaagggtactatccgtcggaatcggaaaacagtcggaaactatccggaatttttttcggatatccgcagacattgagcaaattatataaaaaacacgtatatatacataactttttcatacggaatcagatgaagacaaactttatatcaacattgtagagctcgatgagatctacaactttattattgactattttattatttgaggtcatttatgggtctaaatattcattataatataccatattaatttttacaaaatctcatatctacgggcctgtttggtacagctccaactcctaaatataactccaggagttgagtctggagtggagttgtggagctgcctaaactcagctccacaactctagtacattttgtgagagagctccacccaactccactcccagttttggtggagctgaaactgtttggctgagctccagcttcaggaggggtggagctggagctggagctgtgccaaacaggccctacaattcaacgacatctgatggagatgtgttccatatcaaagttgaagagctcaacgggatctaccactttgtagcttataacatttgtatttgaaagcatttaaagtataatacaaacattacaagtttcgaagatgtgaagtaaaataaataaaatctccaatttatacaatggtaagtaagttatacatctagtaaaaggtcttgggaatagaaaatgataaatcatatttgcatatggatctcttagaggaacagccatgaaaatcaattttcacatatggttgtgggaccgtctataaaattgacgatataaatgttggagattttgaactaaaataataagcgatatctcttccttgatcaagaaactcaatttgaggggttttttatataccggtaaatattcgctaccgtattcgttccgtctcatattcgctccgtatctgtattcgataatattcgatttcatttccgtatccgagttttcgattccgattccaattccgaaaaaaatatgaaaacgaatatgataaagctagtttccgtccgtttccgatccgttttcatccctatctctaacttactaattaaaccgacaaccttccaaattaatacataggattctgatctattatctaatattacggaaaaaaaataatgttacacaatctatctctaaggaaactaatcccagtggtgcgaaagtactgttggctaactgatagaaaggagaatctcaaatgatacaaaaagcacacataggctgatttttccataggtttgcaactcacacagccacattgctagccctaaaatactatggatgactacttactcgtttcctcttagcaggcttgcgcaaaaatttagaaccttcagcaggtggccaaccaagattaaagcaggagcgtgacctaaatatatgcaagagattaaatacagagaagcaagagatataataggaaacagcataaaagcagcagtttaaagggaaaaaaccagaaatattcattgaagtcatcataatttcgccatgcagaatgtgcagctttcccattattattattctgtgcctcctgtagaaggtatataatggatataactttaatacagaagaaaaatatcaaacatacagaaaacggttgctgcaatgtaactagctcaatttatcctttaaaaaaggattaaatcatcacatgcctcacaataatcaaccaattacaaatgaattggacaaaactactgagtgcgcagttacaacgaaatgccacctagtagtggccgtagacaataagacatgagaagatttcagaagattcaacttaattggtactgatttagatttagcagaagcatcatctaaacccaaaagtaaattgagatagaccttcaataactgaacgtaccgcttccatagtttgatatatcggagtaattattttctccagatacgaagcagaatcattagtaatagtacagctctttgcacgttcagcttcagatgaatcaagaatcccatcaagttcctttgccatctgacaatttgcaagcagcatcagtaagctcagcgtattgtacaacaggaaattgccactaaaaccaaaagaactactctcctaataagtatatatactgctacgtaacaccaaaatgccatccgattgctgtatcagtgttggacaccgtgttcacacaaatatatctctgagagagcgccatactgcgcaagtgccaggatattcaagagagaacacagattcggcatttcatccactctccatcctctcccatgttcccaccaacgagttcttcgcccttgatcaggcagtgcccggccccttcctttctgcctgttgatgatttcctatcaatctcagctctgtacccgtcatcctcgatctcgatctgggtaacttagttgcttcgcactgcacccatcttatccttaggagatggaagctagatgtaagtacgctgattgaagagcaaaggcccaagcttaaggtttcacggtggaattgtgctaacgttctaaacaagatctgctctaattaattttatcatgttattaaaatatatacccatgtcaccatgtttgtgacttctgaatccttgtaaatgtgcaatgctgtgacgagatacccatgtccaagcatcaaagatatactgaatcgtctaatatcaacagtcaagctcaagtttggcataaatatacagttggttactttaggacatggtgttttgttcatccaaagaataaaaactaagggtaaagtccatttatagcctttaaactttggccaatggccatttttcaccttcactagaaaactggatatttttcaccttcaactcttaatgggacaagaaacaccttgggacatattttttagtggttttgtttgaaatggaggtggttttcctagctgcatattttgttgatgcaaatggtacttaattaggtcgaaaatcataatacttaactgaagttcatgctagcgaaaaaccactatcatatcaattagaaccacgataaaatatggtttagggtgttatgcaagatgagaaatggactttgagcacagtttaaggttacaaatggactttaacctaaaagaaattcatgatctaatatttgcctaaatgaggaattatcgacaaaacttatttgactatccttttttagcataaagcaagcttccctgaatgtagtagtgcaatatcccattatcaagaaacatggaagtttcctgaaggaaaagcgctcaacagaaaagtagaaaagtacagtcaataatgatctccacaaacaatattgctcattatcattttgcgacatagaaaaagtaaatgtgcaacatccaacatgtgttctcacagtactataagattgaaccctaaaaaaagcaacttgacaaggcgaaagctgagataactagtcatctaaatgtttgctgtatttaataattttggtcatcagcagaaacagaccagaccatatatatataacactggatcctatgttgaaataatttctacgtgtcatcatctgcaattacatgaaaagaaaaagggcagaaattagtaggagagaaaggaactcacattgtggaaaatgtagcataggcattctggaagaaaacggacatttgcagcttcaccccaaataagaaaatacagagcaaccaatatgatttttctgttcttgttgactgcttcaaggctaatagaaaaggaaattaattagaaagcatccattgaaataataacaggcacagagaaaattaaccatgagaggttaaattacctggtccatgcaacacgcttgcccaagtacctacaccatttcatgtagttgtccagcactttcaaaaatacttctgtcacagccctctcatcaattttctacaagagccatggccattgccaatgttcattgtataataatatgtatcacaagaatttatagacaaaaatcgcaagtacatggaatttaaaggccaaaaaagaaaggaacaagagtaatcagcctatgcactgttaattactagtaactataccttattcattacttaaggtttcaacattgctttcataaaacatctggccgctgcaccgaggcaattataatagattagccatactgacttatatttctattctacaaacaagtttgaactttcattgattctatgaagggaaacagcaaccaatgaaatttatttagaccagtagagctaaagtgaagatcaagcaaaaggctggtgacatttttaaagctgagacagtattaaatggtaaccaccattattgttgcatgtgctccctttttttacatgcagaactatatatatttagtagcagaggaagtatcatgtcagtaggaagaaagatcttattgtactacaagtccaaatgatactccatgagaataggggaagaactaaccggctctgtcacatcaagcaagccgagccgggattgggcattggctaaggcaagcacaacattctcacgctgattgcgaacattatcttcctggaaaaacaatttaatctaattagaaactcgatagaaaggcagtaaccagtgatataaattagaccagtacacagaagcaggaaaacagaaagaaacaatttctcacacaatagatcgacgagtaaataatttaaataacataagatcaccaaacaaattatgacaaagcacatatttgcaccaaacttatttctgttttataatctttagttcttcacaaggtttctatctttctgaatagtagaaccgtaatgatcctacaatcttgggcaatcattccaatcatgatgttgtacaggatctaaattagggagaagtgtactaaatagtagtccagatctggccatcctttaaaataatgatgtttcaggttgatcctgtaattcatatcctgtcaacagtcaaccacannnnnnccccccanaatttcccccccttgcctagaataggatactcgacatgcaaaccttgctcacaagctccaacataaatcaagaatgttgatgcaattgcaaattcacaaaacatctagaagatgccataacattttaatcttcaaaagtagaagcggattatgatcaggattcacataagctgctagatggtatactggcttaagaaaccaatcaaaaattgccatagcactatagcagcatgtaatcaagtgaagttgatcgttacagagaataaggcgtagtgaacaataaatattctgtagtatgtgcatactgcagaacaaggatttgctggcagatgcagcatggaaaggacacaggtcatgccaatcaatttttaactgctaagctagtacaagatttccaaaggttctatttatgactggatctgcagagaggatgcctcctagtatggaatttgctaaatactccaacatgtcacaccagcaaagattaaaggaaaattattgcacgatttcagaaaaagtaacagttgtaactgtcacatgtcaactcaacgcataatcaattcaaattattctcatagaaaccaacataatgtggtcaactaaagaagaattgcccgtatgctaagcatacagatttttttgtgcacccttgaaattaactattgttttggcaccaaaaagaacataacagcttccaaaaaatgacaatgcagtctacaggatgtctttgcaccctgcatattaaacttttaatttgaaaatgtataaggaaaaattacaagtaggtccaaatagtggcatgcgtctttttctccttttcattgtcatacaattttctcgtttttgttgctgtttgcgtagaatgaatttagacttcaaatttcatgcataagtaaaatgcatcaataactacatccctaattttagatttgtcatattgagtcagtgcaacaagaaaaagcaattgcacgtatgtaaccaaaaagggatggttacatagcaaatgttgccatgaaatatatggtatgagatttttcctaacctggaagccaaatacgaattgcagaaggtcaaaaacatctttgtgtcttagctgtagttgaagtgcatcagaaggaaatcgtggcaggtcctcacagttttgaattgcagctattgcagccctgacctaatagatttgcatgaaacaatagacaacaccataaatatttttctgtttggcaaagtaatgcaagatgataacggtctgtgctgtgtggacaacaagcattgcaacatgtacctccgggaaaaaaccaatagtatttgccactgatgatggtgcatcaaggggtacaatattatatggcataagttcacctctcagggctgcatcagatctttttattctcctaatctgtaaaacgaaaatgagagggggaaaaacactagttgagtgagtatatgaaaaaaaaatcctcagaggtgttggcgagcagcagcaacaaaagggtttaacaggagtaggggttctgtaatgactgcacaattacctcgtctagaatttgcctaccaagtctatcggatggtgattgtccaatgagaatttccagaacatcaagcaaagccctcaaagtagcatagatctttttcatctcgacagccctagatcccatgctggtaaaaataaaatagtcatgagaattattagaatgtgcataagttgtctttctatggttagcacaatactgcaatagagtgtaaacacgagagcaatataatgatgcaacatcgatttcatcgaacaaggttgttaagaaatggctggcagaaacaacgggcactgcagaagttagttgttaggaaacaaaaaaaaagggcgcatcaactggtcaaaactagttgtggtgcgattggagagatggcatactctgtactaaaagttcccgattcgcggagcctctcctgctcacgctgcatatcatcaacccgacggcgactcttgtattgtagatagaagttccagaggacttggatgtcattctggcggtctatgggcgcgccatccttcttagcaagcttttgctgtagaatgcgatgggagcaagttagacagaaatggcattgacagagagagttagtggcacgggtgggaagaagcatatataccttgatgacagaagctaaacccgtcttgaactgaagaacaccccggccatcgctgtcgggatcgagattctgtgccatggtgtaggcttgctca

SEQ ID NO: 3412 - DNA, 690 bp, Oryza sativa
ttgtaacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaactggagttctttggagattggcttccggaaaaaaagttgcaacttgttgatatgagtattctattaatcctattaagccctaggccgggatgttacaggcaggccggcggtgaaagcgaagatgcccaccaacggcagcataataggccagccgtgcaggcggaaacaccggtcggcggcggcaaaggcaggccggcggtgaagacgtagacgcccaacaacggcggcataataggccagcggtgcaggcggaaacaccggtcggcggtggcaaaggtaggccggcggtgaagacgtagacgcccaacaacggcggcataataggccagcggtgcaggcggaaacaccggtcggcggcggcaaaggcaggccggcggtgaaaacgtagacgcccaacaacggcggcataataggccagcggtgcaggcggaaacaccggtcggcggcggcaaaggcaggccggcggtga

SEQ ID NO: 3413 - DNA, 2095 bp, Oryza sativa
ctgtctgcattcagcacttaactcttctagtatcttcaaatgttattgctcgacattgctgtgtatcaatcttgtcttctgcatatattgctatatagctatttctcctctgcccttttccaagccttgctaagtacttcatcccaaaataacttcatttttagcctccaccgtttgtcccaaaataagttcacttttactctctaacctacccactatcagcaaatcgatgagttttattccttcaataccccttgcctacccacccactaatactacttttctgctaatgaggggcacttttgtagttttttttctcttaccttgtttttcacacctagagccaaagatgaagttatttttgggacagagggagtagacataaataaaaaacttatgcacaatctgtagaaaagtagtgttaggtaatttttaattgtatcctctaataaattaacagtttatgaaaatataactcatgtattccgttggtgttaatcatggtagtctggttactaattcatgttactgtgctgagagatatcctatatgattttgaatgaaatatacttttgaataaggtcttgagattagaccgttcaactatatgacatgcttcttattttattctgttccctgttgtggtgcactttaattatccataatccgaactctagaaggaattttcttgtcaatctatgatgtattttactggtgtattttgcatcagttatgttttacttaaccatactgttgcacctgtaggaaatatactccattaaactgcctggtaatcccaagctcggcgagggaaaacctgaaaatcagaaccatgctattatattcactcgaggagatgcaatacagacaattgacatgaatcaggttttcttcttatcattatcattaacagtagccttgtccactccccttttccttaatgaaattaggtcgaccaaatcttttggccgacccggcaaaaaaacagtagcattatcctttttgttgatatattctcatgaaatgtcgagcttgtctagattcttatgtgtaattctatgagatagattctaaaaatatgctcatgtagtacgctgcttgccatttggattattcacaattcatgctgttattaaccatgattctgacggtgataggtcctcttcatgcttggtaaattggtgtaaacaactaaacatgaagatgagttcttgtttttttctttgtgatggaagtattaacaaaatcactggagaaaggtatccattgtgtacaaaccaggggccacggggaatttacactcaatacctcattgagtgaggtagaggacatctttaggtgctaacatgtgacatgcagattagattcaaaagagatgtgaggatcattgacccaggctcatatggagaaataacatggggtcatattctgacccatctaccttatcttgtccattggtccatgcaatacattagtttatacttgctctacgtagatgaaatatacttggcactcccctctttttcgaaaaggtgtctgtgcaccagaaaccatcttggatccttggctgataaaatttctcctgtaggataactacttagaggaagcaatgaaaatgaggaatttacttgaagagtttcgtggtaagcatggaatccgccctccaacaattcttggtgttagggaacatgtgttcacgggaaggtatccttactatgactactctcagttattcactagcttttggttttgcttttatttttgtattaacctattatattttattcctgctgcagtgtttcttcgcttgcatcatttatgtctaaccaggaaacaagttttgttactttggggcaacgtgttcttgcttacctcaagtgagtcaaatttagctagttgcagggaataatatctcattcttaccacattctcttttttcccccgcaacaaacctgtgacaatggttttaaccaaggaacttaattgtgttttattgttcttattacagggttcgaatgcattatggacatcctgatgtttttgatcgcatatttcatataaccagaggtggcataagcaaagcatccggggtgat

SEQ ID NO: 3414 - DNA, 8051 bp, Oryza sativa
cttattgagaactaaacattagttacgtcacttgtgcatgcttagtagtgtatctctttcaaacttgacttgtatgtgttatctaatctgcaggattcaattcgactctgcgccagggaaatatcacacaccatgaatatatccaggttatctgtttaatttttttgcactgcaaatgtgtataacatgaataatgtgcactcattatgatttgtgtatgagattggtcctgaggattttaaatatgcatggttttggaatatggcatgtgcacttgcatttttttttgttagcatgtctggtacagagaattaagcggcttggacgcgtattacacatacatcaatatggtcttcccttttcttgggcatgcaaattagcaaatgcacttgaacagatgaactaaactttcttacacttttgatttatttttttttggaagtgcaggttaacacatttgcttaatgggtgcatatgtcatcttgtgtacacttgcattttaaaatcagtatatctttgttatcatttcccaaaataataatctaacaatctatttcacttcttttaaggttgggaaaggacgagatgttggtttgaaccaaatagcacttttcgaagggaaagtagccggtggtaacggtgaacaagttttaagcagagatgtgtaccgtctggggcagctgtttgacttctttaggatgcttactttctttttcaccacagttggttattatgtctgcacaatggtaacccctcgccccaatcgcacatgattacgcttgaagcaacttacatggtctatgtgatgaaccagctcggcttgaacacttgagtacatgtgtgcactgcatccagacaattatttgattgatataattgctgttagatgggatgagagcgacaaattgcagttagctaatcatatatcatggtttggtttaattgcattgcactatcctaaactatcacctgtttgcttgagatcaaacacagggatcaagatacgagaactaggtctaaatcatataccatgaatgggtttacaccaagttaggccctttccagggatgggccgggaatttatttcaaatttctggccaactaaattcctggaccatccagggaggagccaggatttggtagtttggcctttgccaaacaaggtcttaaggtttgaggatgcaacatctagttgaaggcttaatacacctgtttgctgcttctcttttttaatcaatgggggtggagctttctactcttccaaactctcatcgagtgatacgcctcatattttagtataaaccctcatcatattttagtataaaccctcatcatgcatacgcctgttaaatcataatagcagtatatgttaggggcataactttatatttagcaatagcaaaagatagtttcactaacttgatggaatatagtgctatgtgaatatgataaattctgatcgaaaatactagttctcatccgaggacctgtgtgtatgatttcttgattgttgctggataaatagcttctataactgcaagattttcaatctgtcacctgatacctaatgtctcaatgtccttataagcattgttttgaggaatggaatattgcatgtccattagttatattgttgcctagaggattttggacacgtttacatcatagacatttttgtagttttgtcagcaattcttttattttgtttactatcaccagttatttactataactatattatttatgtgtgcatgcagatgaccgttctaactgtgtatatctttttgtatggaagggtttatctggtaagtatttaaattataatgtgttatgcttctgaatgcaagtaaattttgctgaatgttgcttgtgttgtatattatatatttcttttaccattcttactagctattgcaaatttgtaaattcaggcactctctgggctcgactatgaaatatctcgtcaatttaggtttctgggaaacactgcactcgacgctgctttgaacgctcaatttttggtccagattggtatttttactgcagtaccgatgataatgggtttcattttggaactggggctactgaaggtgggctttgtttccttttagagaacgatacatgcttttcacagggttgctgtaaatcatgttaggattcttttttgagatgataatcatgttacaatttcaattgttttgcaggctattttcagttttattacaatgcaactgcagttctgctcagtgtttttcacattctctcttggaactagaacacattattttgggagaacaatacttcatggtggtgcaaaggtataatttgtttgctagtgtacgtatattatattaccttttagattttttctgacgcatggccctttatgcagtatcatgctactggtagaggttttgttgttcgtcacataaaatttgccgaaaattatcggctctattctcgaagccactttgtgaaagcgtaagtttctacttccaagttttcaagtgaatacttaaaagaaattcaacttatatgagtagttgtcatttatagatatcttcgcctgatgaaatggagcatgcatttcattttgttcatattggtcttttagtatgttgtattacagtgacccatgcctacctatgttatcagacatgagctattttgtgagagtgattgaatgaaatgtttccttatgcatcttacaatatgaatcaaaatctggctctatcccatgtgtcgatattggtggagggaagtgctagatacctttactttagaaggctcacaagccctcttgcaaacacgcatttctgttttcttttgtctggatactgtagggatctgactcaacgaatgaaatctgcaattttaattatggtgtgcctgattggtttcttgactacttgatgattaatctgatatatattaatatttgcaggcttgaagttgctctcctcctcattatctacattgcatatggttatacaaggggcggttcatcttcctttattctattaactatcagtagttggttcctcgtcgtgtcctggctcttcgcaccatacattttcaacccttctggtttcgagtggcaaaagtatgttcagaatattcctatcttttagttaatttctctttagttgcctaacattcaggtaatatcaccagtgattgggtaaaatcaagggattgttcaatttgtttttgtgaagaaacataacactatgtttgatgaaataccttttctaggagtatatagggtagaaacttacgcttggggtagttttagagatgttcttggggctggataaattaatttccacaattctcactcttcattggcttccatttccaaacgtcaggactgttgaggactttgatgactggacaaattggttactttataaaggtggagttggtgtaaagggggaaaacagctgggaatcttggtgggatgaggagcaagtcagtaactatgactgtttggagtgttaaccgtatacttgatttaaccatatcttttgactatttcacttatgcactgttttattgcatgcatacaggcccacatccagacattaagaggacgtatcctagagactatcctaagcctcagatttcttattttccaatatggcattgtttataagctcaaaattgcttcacacaatacatctcttgcggtaagtcagggatctccccattgttttgcactgcaaatttttaattgctatgttagcaaaccatttcgtcacatcaaaacctttgttaaaaattcagttaagcacgtgtctgcctgattctttttccatcttgcattcttccattcatgtcgaatgcagtattaaatgctgtagctcttctttcctggcctaaaaaacattcatgtgttttcgttaatgtgaaacacttggtactgtgaggcctcatgttagctgaaaaagaattttttgttagttttggcatttgtctggagcacctgatttaaaattcctatgtgaacaatagtgttataaaccacaaaagactgcatggtatggattcctatagcttctacaatctagcaaatctatccttctgatcttctattatatctaatgcattttttggataggtttatggcttctcatggattgtacttctcgttttggtgctcctatttaaggtttgttacgttgaagtcttaatatctctacctgttctgtgattttaatttatatgggcaacatcatctaagctaatcttttgctgtatcgtgctgcagctttttactgcaactccgaagaagtcaaccgccttgccaacttttgttcggtttctacagggcctccttgcgattggaatgattgcaggaattgctctacttattgcattgacaaagtttacaattgctgatctatttgcaagtgcgcttgcttttgtagcaactggatggtgtgttctatgtgtaagtacagcattcctcttgtttctttcctcaaatgttgcagggttaatgctgtttgtagcacagattttagttgcatcactggtagttagtttgattagttcttacagatgcggtcctggcttatgcaaacttctctacttgaatttggttgccacattttctatgctttgttgtttggattttacccacatgccttctaacctgttgcatatcatggcagctggctgtcacatggaagcgcctcgtgaaattcgttgggctctgggactcagtccgtgagattgctcggatgtatgatgccggaatgggtgctctcatctttgtgcccattgtgttcttttcatggttccccttcgtatccaccttccagtcacgtttcctgtttaatcaagctttcagccgtggtctggagatctccctcatcttggcaggaaacaaggcaaatcaggaggcatgaaaagcctaaccacctaaccgcctggatatttttgttgtatattcttggaattgattagtggtacttgatttgaacaacacctttgtacataactgcctgccattttaggagcaaattatgtatccaaactaacagtgccatgccagtttagatgtgagtattcatctcttgtttgtagccgtaacgacctgtaatttgaacattccggtaatttggatgcgacaattcagatagcctgattgctgtatttgagcaaacaagtgtcccgaatctttggtgctgagacgcatataacgccgtatcagtttacctagtagaaacgcagttgtgttacagtcgtttcactgcatttacttgcatatgccacctggagtcccggagtcgtccagaactccagatcgttcacagggaagttgtattaagttcatagtggctgctactattacatgtctctgaagaacctgggtcatcgctacatgaaatgtgtcgcttgtgctgtcgttattgttctgctgatccttccgttcttctgtatagatctactgctctaggatgggcaagcaagagtgaactcgccatgattgcattgcaacatcctagcggaaaagaaaggcttttcaagaactccacaccgttgcaacattgacaaagaaagggctcttggaggatctatcaggtactatttatttatgtggaggagatggctatggtccttgtcatttcttccttctctacatcacctagctaggtcattttctaaataagctcccgattcactggcacttctggattcgtaagccacagcgcccacagttgtgttgagtataccttacgttatggaccatcaggcaggcatcagcactatccacagggatgtgttactatctaaaagcttagtgccccttacggatccattctctctgccacttcatatttaccatttatttcctacttgttgattgttacacgtgctagttttaccactaggatctttggggtactagtttaggcctcctttggaatggaatggatgagattttgttttttttcgtaggaactaactaataaaatttctattcctttgtaactgcgttctaaagaagtccttaaataacgtagtctgctttgaaatccatatagaaaactacctcagatgcagcctacatatgtgcaaatggcatggcccatctgttttgcttattgtccccttgccagatgaatcctggtcatgccactagattagctgtctggctggacgggtaatgtatgccatgtgccgaactgccgacaatgatgatgattgtgggccattagtgtcactatcacctctcttgtagttaaccacctagctatgcaatattgcaatggcataaacacctgcatgctagtaatagcccaataacggtttcctagaatccagacacaacttatgtttgtcctgcagtgaagttcgactctgttctgcattcatccctttcctgtaaccattcagagaaaatcctgcttaataatctttatggagaaatgcagtgcttctacccccattctagaactacatcaatatcctactggtgatctagcctgccaggtgcagttcgtatccgcctatccggggatctgaaaattatcatgaacctactggtgattgctatgctatcaggagatgccagagcactagcttttttctagttgcatttcgacaattcttagtagttacaggaacaatgttggctacatgtttattggtttgcacccaatttatcttagcatgcatgcaggaaggagctccgtatgctcccaacaagccattgaaccgaaccactgtttgacagaaacagcctaaacggaagctgatgagcaccgttgatgtgcctgcctgtcacacttcatataagccatgagcaccatcatattgtcctactcatcattgcatcactcgggtaaactctgtaaattccctctctgataatgaaatccctctttaacttttacagattgtgaatctctgcaagcaacacttgccgataagcaacaagaaatcaacagcagtagcacagctaggtgtgattaaaaaccatgacagtgtgcttgaatatattttagctctttcctcttgtctccatgtatgcagccatctctgtctgtttggtaaaaactcaactgaattgtaacaccttttgtttatgagcttacaagaaaagttttgccctgcatgagagtcctaagaatttactctcttaccacgtgaaggattaaaataccttttgatcaagatgatgcactggatgatgatctttgatcattatctgttacaatttacctgatccattttaccgcgtgctgaactaaaacaccttttcctttctccctcaagctttaggtgattatggttgttgttttactgctactgaaatggatggtaaaaagaaaatgtatgatgtaacttctatacttttgcaagggcaggaaatgtaatcatacctatgtgtacgtttctacttctctagaagaaatatgaccttattattgtgaagaaatgagaatatgaagggtttatctgcaccaaataacagataacacttgtgcttaatgatttgtgtacttctaaaggaattttacggagcaactgactctgatcatgttttttccaagactaatcatgtgtacgaaactacagggaacaaccaagtttcaacaaattaacatgcacaatgattcaagaaagggtacttcttcaaccttggtacttatgaattatgatgtactactaggcttacaattatagaactgtgttatagatgataacttgtactttcatctatcattggatcaataaagcagagcactttcagaaatgtatcatttctcccttgccttcattgatgatgcaacgaggttgagagtgaggcagagcaagcatcggttggaccacaggattattcttgcggaaggtaggtacgtggttgttccattctaggtccatggtttacctactaatatcttgtcatcccttgtgggacaaggcttttttgctttgtgattatactgccactttgttatcctcttgagcactcctgcgcatacaattaattgcatgacaaataggagctatagctagctacattaaagtcaaacttt

SEQ ID NO: 3415 - DNA, 7658 bp, Oryza sativa
ttggaaacttttgagaacaccgagcaagtcatatatacttaatttgatagacagctaatgatggttgttcaaagcgtatcctgtatggttgattagcctatgtcacaatgcactattttcctaacaaatagcaactagaagtctcccttcttcaacatttcaaaagcagcacaatttcaggaaattttctaaaagttttaaattattcacactttatgcataagaaagtctaggtttgacacattggtagtcaatatgtgaagttgaccatgctctgcagccatcgcatgcatattttatattcctttttcatcggttaggtaaatctgtgtatgtcaccatactgtggactgggttgcgtagatcgcatgccaacgattgagaggattattttcaggtggtagaagctacctctgtaacttaatttactttttcgatctgtacacgttaattatatttacctgatgcatacagtttaggatatcttaataaaagttttacgtacagcaatgatcgatgcataacatctgcattcgatttctaaccatgttgctattgaatgctccgcttgttagaccagttcgtgcagaaaatactgctactgtactaccaagacatgtgcctttctgatcgatccctgtacattaatttgttctctcttgcacatcaattctgttgcacagcaaactgtactagtccctacatgaaagtcactgtagaatgctttctgaagccgccaaacctgagctatatattaatgcctttataaacgtgtgcaaaggaagagagagaaagagaagagtaggttcttcctgttcaacaattatccataggctgtctatgctttgccccaacatggacatgacaaaacctgcatgatcagaaagcgatatatacgaaaatttccgggtacaccagatataactaaatgtataaaaacaataaaacgtatatatagcccatttaattaaggcaatagaattataaatggtggccgtatgtttcaattaatttgtaacaacgtgcaaaatttacattgtatgcataaaaaataatttcaccgagcaaattagttgtttgattactagctgcgtcaggaggtggaaaataatgagctcgatcaaaaccttccaactcaacaactctgtcaaattcagatgataagcttgtaataacctatgaccatgcataaaatggatttgacaggcatatatatacatatagttagggctgctaaaggatgatgctaataataattaaagcttttgatcgagaagagaggtctgcagccagcagatgagagagatgaagcataggcaagcgcaaaggtgggatagtcaatggcttgtggtgtcgggaaatgaggtatacctactggctaactaattgtctgacttgtgtttcaggaccagagaaaaataatatatttattttttatggaaagcaaaaggcacaactaggagccattttaactacaagtacactcaagtagctaatgatatttccacatccgatttctaacgaatctaacaatacatgcacaagcaatgaagcaaacaagatctgctgaaacagcccaaacacatatcggatacatggaaatatatatatatgtgcatttatgctatacacattaattaggatttgctagatttgactttcattattattaactacggggctagcttaagtgttaaaacttcccttgattatttgactgtgctatatatactgaccaatatattaagaactgattaatatatgtaggttcattcttgtggagagagttctagaacataggggccggccggtgattaaccttttctactttcacaagctacccatccctctccatctccaactaactaaatctttttaagtcatataccgtttgcatgttatctgatgcatctaataaccgccctggttagtgatatgatgtgtctaaccagtaattaacctcgtttcggaaagacacgggctaaagctagctagggaagctgcatatgcatgcaggggccatgcgtgctgatgtatacgtccgttgctttttttagtttctttttttttatcatttattctagacaatgatatatattaaatcccctggcaatttaattagagggtatacatatataatactgtgcccgaaaagaaaagaagattgttctctgtcgaagtcctgctgtgaaaatgaacggcttaattacttttttttttgcggggatgaacggccggcttaattactgttctgcttaaaactggtttcgtatatactatattaactagagtaaacttgagactatatatggattatatattatagccgtacgaaatcgtaaaatatatatatatatatatatattgtagtacatatagtcatttgattgattttgtttcaagtgtatctagggattgggattttgaaatggtccaaaaggaagctagcgaccacatcaacaataacagttttagatatctgttggagaagcaatttatatattgtttatttttgttctgacaacgcatacctagcttaattattccgagatcgagcaattatttcaataccgtgacgaccaaaatttagcttagtcacacacgatattagtagtaaatggtgtgtcaacaagtacatatctgaacagaagtcacacttggacataaaaatgggaaaattaatgtcttaatttcatgtcccagctatctaatcattacatatattttttcctccttgtaaaggggtaaaaaagaaacgataaaactaaacaaacaaaaaaacactactgatcgagtgttccatgcatgttctttgtgttctttctacataactaaaagtggaccaaaccaccttttctgatgtgaacaaacaaataaacttgacatcaaccgatccaatagttctcttcttcttttttttttgggttcatattatctccatttagtatccctttaattatctagttcttcacatctcacttgtgttgttttttgaaatatacatctcacttgcgttgttgctgctgatcaaccatgatgggcattgcctgcatcaaattagtatcatgtgagataagtatatataagtagtaaccattatctgtttaatttggcaataaactgcatgcagggttttaaaagaagatcaggggcacctaagctagctacatacagtagtactgaattggtaaactaatatatatagtatatattagatcatgtattagaatcttatatattgtcctgacattattgttccacctcgaccagtctggtgaactatatatcagagaggaattattggaaagatttttttttttaaaaaaaagatttttggataacaattgaactcgatataaaattacttttttaattaattagaaagttgatgagagtagctactcactctgctagcaatatgtccgtcatcgcccaacaaccttccatgtcgatgtcgtccaggttcagcccgtcgaacgtgctcgacgccggcgtctgctcacacgacatgccgtcgccgccgccgctgggggtgttagtattgcactgatgatcatctgcagctaccattggcggcggcggcgccatcggtgaggtcgtcatgttgcttgcgctcgggccgccctggccgagctccggcgagctaagcccgtccccgccgtggcaaagctccggcgagcccagcatgtccccggaaataccgctggaaattctgttgagtaggctgtcgggggacatgctcgacatggccggctgcgtctgctgcgtgcagctgtcgttggtcaacggcggcaggttgtcgtagttgccgttgtactggccgaggcggctgaggtcaacgccggcgagctgctgctgctgtccgagtatgccggcggagttggcggcgagggtggcgccgaggatggacgtcatgaggtctgtgccaggtagcacagcggcggtgggcggcggggcggtggtggaggcgagcacgcggaggaggccctgcagaatctggaacttggcggcgtcggcctggagcttgatggcgttcaagtccaagggcagctggtgggcggcgccgccgagattggcggcggccaggaggttggggaggccggcgaggaggtcggtgcgcgggcggtgcgtgacggggtctatcccctggctgagaagcttcttgcggaggtgcgtgttccagtagttcttgatctcgttgtccgtcctccccttgagcttcgtcgcgatggacgaccatctgcacgaacactaaagcaactcccttaattagcatatgtatgagctagctagctagaggtagacgaagaagaagaagaggctagtggttacttgttgccgagggtggcgtggaggtggatgatgaggcgctcctcgtcgtcggagaagccgccgcgcttgatgtcagggcggaggtagttggtccaccggaggcggcagctcttgccgcagcggttgagtccggcgagcttcgggaggcgccgccagctgccatggccgttcttgccgatgtactccaccagaagcttgtcttcctccggcgtccatggccctttcttcacgtcggcgtcctgctcacaacacggtgatctccccatctcgatctctcttcctagctactactcctcgttcgttagctgagctaggaggaagaagctagctaagctagacgatggccacaagagtatgtttaatttggatgataggttagatggacggctatggtgggggtggttttataggagaagaggaagagagagccctaatattatttaacggggctaattaatttaagtgataaataaactagacaagtacacaaagaccatagcattagcatgcatgcatgatcgatcatatcgagtcagctagctagctaagctaagtgagattaattgtgggctcaagcaagcaaacatccttcctttctgtctctagctctgactcttatgcctggcactaattgatttctcactttgggacttcaattagtccaaagacttacgtccatcgtgattagccattagctcatgcaaccaacgaaccaacggaaagcagcagagagcaggggccagcttgcttaagcatgttgtcaatgtaggtagctaaggttagatcgatatgcatttgctctgggtgtcgtgtgcttattgtgtcctgtttttctttcctccgtactttctgtaccttaaattatttgggacttttgaacatatacatatatggcccaatgcaagtggggttttatttaggatccccccaattacattatttttctcatgcacaattatattaatataagctcacaatactatagcatacgaattgatatatattactactagtatatataaggatcagtgtatatatatatatatatatatatatatatatatatatatatatatacgtacttctgtacgtatatactccttatataactttgccctacgtacgattttattaacgtaccgtggatgcatgcaaggatgatggtgataatggtatatatatttctacgtataaagacatgcatggtagatactgtacaaagatagatgtgaaaaaggccagcacattagcatacatatatactagtacatcgatgtgatagtaatattttctactgtgtgtgcgtctacgagggcgacgtgttacttggaaaaatacaagaaaaacacctctctgatcaagtaagttcatgcatgatttggacgtcatgttacgtacacaatatagtgcgttgacacgtacgcttgacaacttaattatccagccaggaaacttaattagcaagagagaacaaactaaaggacaccattcttttcttttctttttttaatgatactttattaatatactatataccacctgtggtgtgcatactatattaattctattaattgctacatccacccaaaagtaagttcacctatatgtctaaattatcatataaaagtatgggctatatgtcgagattcacgcataaaagtgaatttatttagggagtatctatctatatgtaagtgtatttgttcttactaaatcattaatgcatagagaaaatgaataggggagaaaaataaagagaagtgcgtactaatggttgaatgactaaaacgagaagaaaataattaataaacccaatactaagaggagcatgtgtaatgtttatttcataacaaggtcccataagtggggcccacggtgaagatagcatgcaccttgtgaaaagctttgtagtgtataaaaactctcagaggtgatatatatatgggtgtgatccactgctgttaaaaaaagaaagttgtgaaggatgacaaatagtcaaaatactctctctccttaattaattaaggatcaagcactatggctggtaccggtctctatgttgaggacagttgaaaaaacagctgcagtgtttagggtgggctctatccctttttctccccttaattaggaccttctctaaaactagggacatatatagtataaaccacgtacgtaaaaaaaaataaaaactattattagattaaaaaatggacgtgtgatatttatccatgttatcgaaagcaaaatttctacccccagcaaatttttctcatgactgaatctgtgagtagaatttttattcttagtgacatagataaatcacaaatattcatttttttatttaacggtagttttggttttcattatatatatggtttacactatatatttttcctcagaattaacgttgcagatactttaagaagtccataggtaaaaatatatattttttttgacggagggagtatcgtagtaactattgacaatgatacgttggtatttacgtgtacaaattaatatgtaggttttcgcaaaagcaaaagcattaatatgtcggccggtatacctgcagggcatgcgtgtttaattaggtaatattgacatgacacacatgtaaatatgggatgaagtgtagatccagtgcgtggacggcacgtgttgaggaggcagaggagaattaggttcgtgtggtctgacacgtgtgtcctgttaattgccatgatctaacaacaaataatcaaggagcaaattaagcaagctagctagagtatccaggaagaaggaaggaactactatacctgctcgattgatggaatggatatgatagctagatcccttgtttcacacgcacacatgcatgacacgatcaaaatacaattaagcagttggtaaacctctcacttaatttggtacatatatatatatatatatatatatatttgcatcaataacaagaagctatagctatggtcgttaggggttggggcccacccaactagctacagatgtggaattcatgtgcatatatagcttttgttcttgccattgctctaaactggtctttccttgtaaagcaatgatgacataattaacgaaacttaattgcattattatatgtgtactagctacctactactggatttttcacattttggtccttttaaaaaacatatttcgcaagtagacccctagaaaaacttatcccaaaaatggtcctttttggggcgccagagtggctggcgccgttgttcaacaggacggcgccagcctctttggcgccgtccccctgccgacgtggctgggcgatgttgaggtggctaggggga

SEQ ID NO: 3416 - DNA, 22774 bp, Oryza sativa
ccccccccccccccccccgaaattttttatttttgttttatttgtttgatatttttttcacgcttagggacacacaagaaccaaccatagaaaaattgaactcaaatgaacgtaatatgtgacatatagaatttttcctctcctctcctctctccgaactagtgcagaggagagagatgtgcaacttttttatttttattttatttttttgatatttttttcacacttaggaactcacaggaaccaaccacgtaaaaaataaactcaaacggacgaaatatgtggcatgtgaattttccaaagctccaccgaaaaacttctctccttgaaaacacaatcttgcaagcggaatttggaggttttaatatcgctgaacccggcagagcggggagaaacggatgtaactttttctgtagatgtccgtgcatatattatttgcctgattccgagtccgtatgagaaagttatgcctattttaatagatgacatattttgtccatttcggtagagttttggaaaattctacatgtcacatattttgtccgtttgagtttattttttatacggttggttcctatgttctcctaagtgtgaaaaaaatatcaaaaaaataaaataaaaataaaaaaattgcatctctatgtactgtttaacttatatatgtcatttcatgtggttatattttgaattagattaagtaatttcatatagtggtagagtgcattatgtttaacatgctgatcaaagggttttactaaaagagttatagtctaattttagtgaaggtgcaaagtagactaagtggtatgctagatattttcagacttagctaagtggtagttcgagtttaaattttttttgtggttggttgtatcgtgatcctgagtgtgaaaaaacatccgaaaaaataaaaaaaaatgacaccgttgcaactccatacagagaaacaggaatggacaggaatggaggcggcggggccagccatgctgtcgccctcctcctgccacgtcggttcgcgtgcgccacggtggcaggaggacggcgccagagaggctggcgccgtcccattggatgacagcgccagccactctggcgccctaaaaaggaccatttctgggattagtttttttaggggtctatttgcgaaataagttttttaaaaggaccaaaatgtgaaaactgcatgcacgcatgcgtagctatatatatgcgtatgcatgggatgggagtgacaaattctacccaatattaattattggcattatatattatatataggagcattcaccacaaacatatagtaaaatgaattctgatttttttagctcaagctaattatatgttgatccattttgtatggaatattgattttattgtgatatttgttttcgcgaatatataatttaatttgaatatgcatgggaaataattaaatatagtgcaacctcagttaatttgctctcacaaagatgatgctttagaatgcaagtagatgaactaaagaaaactaattaattcatcaatttatacttaatgaaaaaaataattgatcgaccttaaaacttataatcgcatatgctaataaacgaacttaatagtatatgagtgtattagtttcatccattatctaaaaaagaatttagaaatatgccattataattttgcaaagtttgagatataccatcggtatctcaatgacatgtaggacccacatgagtcaatgacatgtgggtcaggatggcatatctaaaattttgcaaaattataatggcatagttccaattttcccaaaaaagaatatatgtatactagctagtaactatatatacatatatagtacatacacatgaatggttgacttagcaccatttgcgctctgttgtgggagatcatgagcattacagttagcaatacaatggcatatccacaacacaaggcaaattgacttttgaaacttacactatattgctcagatgttgatccattttgtgaggagtcatatgtgtcgtttccatgtataattgatctttatgggaagtaccttcgagaacacaaatttgtatattgtgtgttaattagtttgcaagattaaagacgaattgaagttgcctgggatgagaatgtcgatcttaaaacttaattatatatgcactatatgttgggatatcccttgattccatgcatcctttatggccaataggcaatatttgcacccatgacgcgtgcaaactctctgaactttgtggaacatgcatatatatgcttagctatctgatattcacctatcagataatttacactggaatcctgtcaaagatgattagacagggtgcatgcgtaattaagaataaaacaaaggtcaagtgctgaattatctgcggtttccacgtccaaatgattcatattcatatcatcagaagacctagctagctgggagatgaaacagcgtggtttcagcacacagaaaccttcataggagatgtgtgggtccctttatcatttcttgaattgtttagtgttctatttggacaaaagaaataaaaggctatacattatgaatcattaggtattaagggcagctagcttaaatgtgtatacgtatacagctagctagctgggcatttttgtatagtattaagggggaccaaagtgtacctgcacactatttgtttaactgtataccagaaaattagttgtgcaattggaattaatgttagaccctttgacatggacacatgataacagtacagattgattactatgtaaattgcaagcatgtattggtttagagattgcaggacacataggttgcaggaaagtgatttgattcgtgttctctgcacggagtccagcagttagatgcatgtttgcaggtaggtgtatgcatggctacacgtactcttctgatggttttaatttctgcacatgaacaataatactcgatctgtctgagtcttcttctgtctatatcaaatactagcttgttttctttattcccccagttttttatttcttatttggtactgatcgaagaaaccaaagcgactttaatttgagatgcaatgcacacggtcatcagttaatcatttaccaaacgcacaactaccttctttgacatgaagagatcgagttgctgtggtaaatttgcaaactgaagtttgagccgtgcgtacaaacacctcatcggaagcttcaattccaagctgagagattctgccataactgctaatgtcattcttgacaaatactgacaaatacgttgtatgaattgaacttgcacagtgggtgaaaatacgtttaaaaacatgcaaaattcttattccggtgtaattagtcagtgaaaaacaaggccaaaatatgtctccgaggcaaattattgattttctatactgactagctaggatgccaggttggcttgcaagaccaccttacactgagcttgcctctgctgtccccagtactccttctacccacatgaaggaaatatatatataaggccaagacacaatggattgtaaattgcccagattagacaacttaattataaattggaatgatgagtgttccaatcaaaatagtctcagttcattaatttgtgtggccaattttagccctaatttacacagactaaataattaagttgttctactaaaacatgcactctgccaaaatagaaaaggggggaaacacattttgcaaattgtttcactcaccccatgtaagtttatgcactatacgagtgtaattattactctctctttctctttgaggtccctaaattaaaggatgaatagtttcagaagtggtagtcaatgcatttttgaaagtttgaaactacaaaggaagagaacatctgaacagaatgcatttttcacttggtctactgcacatatataggctgtgtttagttcccaaacttccgaaaattctatcacgtcaaatgtttggacacatatatggagcattaaaatgtggacaaaaaaaccaattgcacaatttgcatgtaaattgcgagacgaatcttttgagcctaattacgccaatgatttgacaatgtagtgctacagtaaatatttgttaataatgaattaattagacttaataaattcgtctcgcagtttacaggcggaatctgtaatttattttgttattagtttaggtttaatacttcaaatgtgtgtccgtatacttttaaaaaaatttgactgtggaactagacacggccatagccatatattcccatctgccaatttatccttcccataaagtttagtgaagtgattaatcagacaaccctttctgcagctgctggttacaaatctagttattgcagtacaagtttcaggccctgttgtaccgtagtctgcaggtttcaatctgtatcaataactaatcatgcagactagctaccatatatataatgcgaattattcttgaatagtatatgtacatatgtcaatagatctttcgtatcagcatcgtcgtcaggacaatcactatcactgtccagagtgtgaaattaaactatgttcatctgtactaatctcccttagtgttgcagcattaagcagcctatttggttagtcttccccttcaactaccttctttttaaaattgcatctctggtttaaccagactatattattatttggtgcaaataccagctaattaacaatgaaattctgattttaacttgctacaattaatacaatcttcactaaaaacttgcggctagacacacactcacagagtaatgttcagaagtaagcagtacatcagtttgcttttgtacgtacagagcacctttagtatttgtattttgtagtacttttattatcttttcacgcaaataattgagagcatatttccttttaaataatgtgagtagacatggcaggaagaaattgtgttttaattttggtagagtgtgcaagtaatctagctaatgcatggatgaattggcaagcatgtcacagtagaattcagatatatgagtagtatctagcttgacatctcatcatctaaaaacaaaaatctagatagacatctagctactagggaaaaaagacaagaaatggttgtcttgctattgctcgtataattgagacgagaatgtattattttagtgtgattttatatttgaagcacagtactacaccaatccggcatggacgcaaatttctatttttaactgccaaattcaaagcattattcacagttacattagcactactggaagaaaaaaaatttgaaccaaaagattgctttagttttctgatcggttttaacatgtcttacaaattaattaatactaccaatgtcctataatataagagattataggcatataactaaatgcaacatgagcaaaatcccttatattatgatacaaagatagtagcagtgatcagtacatacaaattaaattggagtatggtcagaggacgtacaagatacagtaccagtggttgtctctactgcaggcaatacatgaatactactgcaggcaaaacattccgtcagatttctcttgttatttgtttatttataatccttctctattatttgtacgagagatttgatagtccttttgaaatgaaagagatctttgatagtctcgcgctcaactgaagagtaatccattctggtaagaaatccaataaggacatcatgtactgccatatgtttattaatgaaacactcattttcagttcatcattaatgcgtaccaatggaagcaacaatgtcagaaatgcgatagaactacttgctaattttgtatatcatattctaggtgtcctaataattcctatgttgaggtgtcttactatatatattatggcctaagctatatatcgttgggaattcaattcctgattttttttccccaaaatcataaccaaaagtacatatctatatctatactattataaaaattaaagatatttttgccggtatactttggtacgtcatccgtgtttgagtcggtttttaagttcattcgcttttggaaatacaggagtcgtataagaaatctctttcaaaaaaaacttacatgctaacttgagatgatcggactcctaattgcaactcatgattttctagaaaaaaatatatatctaagcaaattctcacagtgaatttcatcttaactaaactgtatattttttttgccggtattttcgtacgtcatccgtgtttgagtcgatttttaaattcgtttgcttttgaaaatatagatccatgtttgagtcgaattttaagttcatttgcttttagaaatacaaaaggagtcgtataatatatctctttaaaaaaacttgcatgctaacttgagatgaatgtcggactcctaattgcagctcataattctttagaaaaaaaatccaagcggattcctacagtgaatttcaccctagccaaaccgtataacaataataagattaacatagcattcaactgttgcaacgcacggacatcttttctagtatagggaaaaagactaagatgtgttatttatttggaatattaaggtagagaccagagtgggtgcaaccagtctacatacttctggtatatgttctcaaaactaacaaagcagaaactgaaatgccccaagatgatgattaacaaaagaaaaaggaaataagaaaaaaaaaaaggcgcatatgagctttagggggagagaataacatgaagattggagatataaaatgcttctaaacaaaagggtgtgcatatgtaacgttctcttggcaacgacaacctagaacaaagatggtattgtaggcggtatcagcgacatccagggtggatagcttcggcctaatggtcagatccagtgccctgacaaaaggcggatgcagtgagaaaaacaaaaagacgacgggcttgttagtggtgccagtggtgatcagtatgcagggcggctatagtgaggagcaatatcagcagcgtggtagtaggctggttagcaatgacagcaacagacaaccctagatctagggtctaagtgccatggatccaaggtgtttccgtgtttgtgcccgaactcaatgcaccaaagagttttcttcttctctacctccgctggatggcatctgagagcaaatgcactagttcttcacttctttgcctccactcgatgatgtcagcaagcgaaggaagtaagtgctgggagttttcggatctagatcaaatggatctgtccaatagtaggggtaggtttgcgaacaaaccagagagaggtgggtgaaagaggatgagggtataggagttttgactacatttcaatatttattcgatacgtttttggtacaacaaggctcatcaggcagcagaaaaccaaaactgagtattctagtattttttgttttcttttttaattttttttgttgtttattagttataagacctggaatataagtattcgtgaaacctttacatatgtatatatatactccggattccatccattatccaaaaaatctataaaaaccaaatgcttctacggttaccattattctcgttggccacaataatattaaggctagcttcaatgtttcatcttgcagagactaatcaaatagctagttggtgcaagatgtggttacttatatatgaaaacaaaacagggatccaaacggtttaagtcaaatgaacagaaactcaagaggattcctcaaacagctgcacagccatggggatcttttagccaggattaggatgcagggtcttaacctaattagtatatgtgcacccttaacatagaatatatatgaatgaatgaatatgatgatggtcatgcatgtacgtccttccttggtatgatgacttgaattacggctgatctggctcaacagggccatgattaatttacatgcaataagcaatagagactgcatcccactatataaatatacgagtagttagtaaacagaatctgataaagaaataggaccagatctttacgtgatctaattccactccgaaggtcactgttagttgttataatttggtgagcctttgtgtgtttaagcttctaagttgattttagttatctaccccttcacgtgtatctccacgcatattacatgttaattaatcccaaatagtacgcacttcttattctacttgatgccttaatgcattgatcgatcgatcttggtacgtagctagcattaattaattaaaaaatgctgggtgttagcgttgattcaacggtacactgttgcaatgcagacgtgtagaaattaaactagaaatgaatatgatatttgataaatttgtatgagtcaactaagaccgtttcgagactgagttcgctgctccggtccttgatctcttcttcctgtgacatcatcagttacatatcgtgaaaaaggaaaaaaaaaacttgctgatcgatcagatgtcatatgccagtaaaaatattcatgcaattgtctcaggttgccggtaataattaatatctcagtatatataattggatatggtaaatctttgatgcatcgacataaataaaaaagatcatggcatgttgtacttataaattataagatcgaacagtttttagttttctcgccatagaaaacaagaacagttgtggctttgaacatattttgttcattctatcttcagatttttcaacttgcagtgcatgtgtggtctccatggtgtcatggtattgtgtaataaaccgacaactgctttacctgaaaatgtgcaaaaagaacttaactattgttcacaattttgtgcttaaaactaattaaactgagttgttaggggatgccggggcagccgggccgtgctgcatacatgcatgcacgagttgactttaccttactgaaaccaggggcctggtctatatattcattcagatcaatttgcaaaagaatattaattttccatacgaggtttggaattggattgttcattgctaatttgccatcatctcacaacggttctagaaataattaagaagcaggtgatctgtctgtggcaactgacacaacatttgcctttgtggtcaggcaaatcaagccggcctgaaattttctccgaatggatgggttaactagcgcaatttcagtgtacaactcacttccaatgcctgccaaaagtcaacttgatgcttgtgcgtgtagatcaaacaaaacagtgctgctgagattgacagaccattcttgatgaaccgatgtttctttcttctttttttaggcacaattgatgaaccatttcgtttcagagcatgcctgtactataggtatcaagagttggttacagataaaactggaaggactccaaatcttcaattcttaattgtttcagagaatgcttcaaccctgaatctgtgtgtcagtgtctgaacctcaaaacaagcacaagctactgtaccatatatccaaaaccagccaatagcaatgtgaaactgaaatgctctcggcacagattccgagatgctaaaataatacggtactagtatgcaagttgcatctataatttggattataaccaactgatgaactgaatcatttgtagttagtactatttcttttgtcctgtgattgtccttgtcagatcctagttcatgtacttgtgaccacaggattgatgcttagggatggaatccagtagtttatagttgctttctggacataaagaaatggtactggatgaagtgctttagtgaggcacctgtttaatccgtacaaaatcaacatgccaaaagtatcaattgcaacaagaacatgtacaccatgagattgcatatccattttaattctctaaatagtaccatataaatgcagtgctgcctgaatctcaccaaaggaaatagtgttcttgtttttcacttaaaattaaaaaggaggatctcacttcacctgttcttttatcttgacatccacacaaatgggagtttctggaatatatatacctagagaataatactatagcaagcattttgtcattttaattaattatatttacgcaagtgcctcagcacaagcacctgtacacgacacagaggaggagaaaaagaaaaccgttatccacaagtcacaagagggattaataggagtttaacaagaagttaaaattatcaactgaaatgcagccaatgaaaaatgtggcttgagattcttgatcccttgatatcattacactgtcccagatggctacattcatggagatgtaaccaatttagcaagcggcagcttcatttttttttaggtagatgaatccttccttggtcaaaggcatagttgagaagcatcagaaagccaaagaaaaaaggggcagcatacacacatcatggatgactagcaacagtgcttgactcctattggggcacaaaaataaaaagtactccagccagtgctgagcttaagcaagcacagaaggattaattagggtcagttctgcacttgattgttggattaatttaatcttgtgtgtgcagttagtagaagcagaagagtacagtggactatagtacatacatggagctagtagtagataaaggtagttgattgaggaagaagccagcgcaagaaacaagaggcttgtccgcatcaaggacatgcatgatgctaatttggaagggacaagccaggctaattgtagcttgagacatgatggcattttgtgtagcttggcaagggaggcttcagcttcagcctctcagtttattcagcttgagcttgagattaagttgacacttgacacatgcattagagtggtggaccagatggagtggcaagttactcttcctgtcaccacaccaataatatagcaatatatacatcaatatataacatactgtacatgtcacttgtagcttgatattattttataacaagtgaatgcccacctttttggatgctctatggatatttaagatctcatgaatctgctaagatgacccataataagaaagaagcaatgtgaaggaagaagtatcaagaaacatggagcgtttttttaagggtagaatgaaaggaagtagaatcagaatacataaaggatttagaatgaacaggaatggaatgaaaggaagaagtataaaaaaacatagagctaattcattaggagcagaatgaaaggaagaagtattagaaaacataaacaaaagctttagagtgaagagtatgaacaagaataccaaaagattaaaaaagtagtatctgaaaaagcaccgacaagagtagaatgaaaggaagaagtaacaaacggaagaagtaacaaaacaatacaaacaaaagctttagaatatcaacaagaatacaaaaaaaaagtgaaactggcaaaaaaatagtgaaatcgccgttgccggggatcgaacccgggtcacccgcgtgacaggcgggaatactcaccactatactacaacgactttgttgctgacaatcgattgcaccccataaaattgggacatttcttgtacggtcaaacaactgcagattatgactgagcaagccataatatgttttcaatggacacggtaatcacatacaaaaccatgaaccaacatcaacatgacattattaaaggagctttccacaacttttgccaaggttcatgcaagttactacaaccagaaacagtttgaacatacgccttataaaccagcggaatacattgtgatcaccatcatatttcctattctactggaaacaaaattcctgcaatgcgaaaagttcactgatagaagtatgtggtatgccaggaggggactttttctgttctatatctatgttttacatccatcaatacaacacaatgcggcacatgagagagcgtggagtcatcactggatgggtgtgtacgagtgccctccagaaggacccgagcccttatgctggtcttcagctgccatcttctcctttgtcattgtaccaacatcagtggcagccttggcaactttgttgaatgcgttggtgacccacgaagccccggtgaagacatacctattcttcatgatagcagatccagcagtgctcaccttctgttcagcagcagcgaatgcagacttggtcttgtccgacacctggaacttctgatccatctccttgaccttctcgttcactatggaagtaccaatagtgaacttctcgctaagaccaatcttcctgtcaatggaggccaccttggcgccagcagtggatgtgaacccatgcttctcatcaaaagcttttgccttgccaacggcatctttccccagggtgaaccccttagcaagcatggtgctgacaacatcctcagccttatggacaacattgttgtcttcactgacagggacactggttgcactatactgagaacagaacacaatattcaattcaagctattcatattccataagatcaacagaatgttgcaaatatgcccatgttagcaccgggagctactctaaattatatttgcacctataatttgaaattatagattgcacttatggttatgaaaatggaatatgtaaaagcacatgagacaaggtttcatttaagctaagaaagcagaaaatccagtgcaatcaagaacatgggtgagaattattgtgcagacaaaactgccatattcagttgatgataacatctcacttgggtcacatattgaaaaatcaaaatatgagcatattaaatcaaaactgaggaattgtgtaccattggaggagcagatgaagtagggggtggttgatattctggagcaggtgcgatgatgacagaaagatcaactatcgttgcgccctgtttcaatgaaatagaacgacatctcagcttttgctctagcagaacaaacaattgttacagggacatcaaatcctactataggaaatggaaatgcaactaaagatattgtttttgcttctgcttccttttttttggcaatgcatgcactagaagttccatagtgattgaccacgagcctatcatcagcaaaaaaaaatgggtaaaacgggtattaattcacaactgataagtagcaacaaaagctaaacttcaggtattgaggaaacatcaagcatgccaaacttgtaggtaacaaggtgctttcattgagataataagtctattttttttatttaaaaaaaagcatgataaggtaagacaagacaaggcaatcagaaacatcagacatcaaagcttcacacacatacacatgtagcgatgaaggaaacaagagttcaatgaaggttaaggaataaggaacagcgaaaatggagtacagaatatgcaacaagtgtactcaatgctacgaagtccttcaattacttactgaaagaagaagtgcagtttctgctccttggggatctttgaaagtcacatatgcaacttgagaccactcatcgccactgccaatggaaggcaaacaaaatgatgagaatgctagtaaagggcaaatcaaatctccttggttgggtacatgttgcaattttttttaaaaaaaatgaacctttgcatctccacatgttcaatgtctcctgaaaatgaaaagaactccttaatgtcttgcacagttgcactcagggagacattggtgaccttcacagtcctcacctgtaacgaataaaacattatcactataattttcgaatcaagtatgtagggatatagaaaacagggtatatgaaaaaaaaaatcaaaggcaacagcacacaattactgagatcagcatctgtacacatataagaaaggttttttttcttttgaaagtttatagagagagcatgcaagtggggctacccttgaccaacttctaaccaagtctaagcttgagattttcatctgtataaataattcacagcctaaaatgatgaatgaagtaaataataatacttcactcgcatgaagaagcctaaactatgtaaagatgtattttctgagcgtaccagaaaaggtcaatataatattatgtgcagttacaaactagcaccatcgaccaaaatgacaaaatggggcttacagcactgaaaaacttgcgcagaacggctagagcctgtttatggaagtaataaagcttatttatagactaataatcccaagcacagagccacaaacaaaccgcctgcctaattttgccctaattcagagtcactatgcagacgggatcaattaggtcgcttattaaaaggaaaggaaaggagggaggagtaggaagtgttgatgatctctacgctacacccataatctctcccctaactccagacgatcttccatgactagatctgcgtaaacactcccctcttcttgttaaatctaaaatcatttgcccaccaccgattaagctatgtatgactagacggttgaccgattgggcaccggattcgccggcaaaaagaaaaacaaaaaaaccgcgattccgatctgaatcgccgcagcaccggattcgccgcaacacgtcgccttctccgcagaccgcagaagctaaaccttaagccttaaggaaagggtaagtgcgggagggggatcgacggacgcttaccggcttgacgtccatggcgaggaggaggcagaccaagaccaaggagggggaagtagaggaaactgtaagcgcgaggaggaggagcagcggcggcggcggaggtggaggcggagtggaagcagcggcgaactgcggagaaaacgacggcgtcggcggaggagaagaagaaagaaagagaggagactagactacgcgtattgcgctgctgatttcgctcttgggcttcttgggctttctgctgggcctaattctctctgttttctcgatctgatccatttatttatttagtagatcggtaagtcaacgctgcaagtttcaagtcaaaaatacggagaatttgaatttgaattctgcaaaagcatcttccggttttactagtagtacaccagatggtaaccaactcacaagttggtatactggagtacttgacagttgacacttgacagtaccatcgacccaaataattacattcagatatttttacattgttctctagcttaatcccaacttttgtttgagaacaaagctaggggcatcttcagattatttgttttcggtttgcctcgttcattttcttaagctttacatctcaaacttaactaagatgtgttgttaagcaaacaaggattaagataacttccgttgagctgggtatgatgatcactagtacatttttagcaaactactctattgttcggttctgttgcaactaaataatatattcacttgcatggagatgcctaataaaccatataaggatgtatgtttctatcggggtttgttgggtataactataaaatgttcagattcattgtactacgaaatatcttatccggtattatgttgctatattataggacggagggagtatatggcaacaaacagccaggaacggatccaacgtgggtgcatgggactcaagtccccccttcacccaaaatactactagagcacccccttcaattttttcaccataaatgataaactaaaagttcctaaatggctggaggttgaagaaattgcgtaattgagtccccctaattatttttttgttcctggatccgtcctgcaaacagatatagtagcaaactacaatccctacagtagccattgcagctgctgcagtacatcatacataagttggttggataaatttttgcttgacaccaaattaaagctccttgcctttaattaccgatcgagctagtgacagtggaattaatagtggagtttgatgatttagtactgtggctagatcgatagctaagctagtcgacgatgaggatgggttggtcggaggtgaggcccttggaggtgacgacctccgccggcaggccgccgcggagtatctgcacctggaactccagacctccggcggcgcccatggcgacgagctcgaagacgcaggcgtccccgaccaggagccggttgtccaccgcgaactccgaccatcccgcgtccagcttcttcatcttgaggtggccgcagtagctcgtcgcccacgacttgccgccggagtggagcaccgccgccgtgcgcgcctccggctccgccagccgatgctggaaccgaggtggaatccactgcatataaataatattagtgcgcgcgcgcggacaaattaaataatcaaatcaattccgcacagacatatatatatatatttaattatgcatgatgatatacttatccacataatgatgattattaggagtaaattaaacaagtgcaactttaggctaaaaatttatctttacatgaatgtatttttagagtggttttcttctcatttttaagtaactgaaccaatagtattctatcctcgttttctcaccatatcaattaaggacatagtagtagtcttttaacatatttcttaatatgtctttaaatagctaaaacctcacttatttagggatggagagagtactctttaacttaaaagaaaaccgtttaattactccctccatttccaattattacatttgtcctaagctctatcttagcacatcacttttacaaatttatctagtttaacaatatgtgaattatatattatgaaagtatttctagtagtgaatcttaatgatacaataaggtatatgttaaactacaataatttttaaaaattgatagtcgaagatataagtaacatttttattaaatgaagaatgcacatgcatgttcatcaccaccacgcatgcacacaccataagtgtgttccctttttaatacacgtactccctccatcccaaataaaagataacctatgtggggatttgatactatctaaaataataaatctggataataaatctggacatgttgtcaaatcatcataaatgttgtcttttttttagacagaggaagtacactcgaaaagaaaaaaatgtcgagatgagctcattgtgcagtggctaggatggcaagcactatcagcctaggttcgagtctcttaatcaaaatttcaccatgtttgatgtgctaggataaaatatcttattgcttcttttttaacttcattggtgctaaatcatttctgggtgtccaaacttttcgaaaaagaagataccagcgataaatccgtgatgcttaccatctggaacttggggtggagatgagacttggcgatgagggcggtgaagaaggggttgccggcggcgagaggggtggtggcctcccaatcctcgccggatcctgaagccggcggcggcggcggcggcaactcgtcatcgtcgtcgcagggttctacttttggtttgatgatgggcttggccttcagcttggtaggatcagtgtccagctccatctgacaagatcaatctgccattcattgtaaacaaaatagggaaatcgattgtcctagtaaaatgtgcaaggaattttcagagcttcttcagcaaacttgacaaaattatgtactgcaaaactatttctgttcatgccatgacgaaaaccttttgcaatgtgctagaatttgcaacataggaactgaagagcaagattcatgtgcacaataatttgtagagagcaagattcacaccagaattatgtatcacaaggacaagaaactgatagcagcagcagcagcagctggacaaacatgtagtactactgcagaagggtcctaaaaaaataaagaaaaagagagcagagtaaaggaagaggagagggcagtacctgaactgaagaggcagcagagtcaagggctgtatctaccaatggcaaaactaccaggagtcaatttatactcttcaggttcaggcatgccaacaggcaccacgataaaagcgccaactaaccaaccagccaaccaatcacaacacgaggcttaattgctcctctacctctagtgcatagagacagtgagagaagcagattgcctcttgttttattgtttttcttttcttttttttcttcaccactgtttgaattttatagcatcgtatttattctctagcatgagttttttaatcactaagaatacaaacataaaaggtctacacgtaaactatgtttattgcttcttcgggttttttttttcacagtttaccaatcgtagagcaaacaatgaagatggtctcaatgctctattaagaaaataactccaccgcccaccacttatcttagtttgacagaatatcaccttatttagtttcattacactgcacattttgcagaatattctacaaaattccacgctattgatccaagtaattgccaagaattttgtacatacgggggatcagggcctcaggggaacctaaaaattgtatacgcatccccatgaaaaatcatacagcagtgatgtagtatagtatagtgcattgaagcagcagagcttggatttgatgaacaggtttctaagcttcatcattcaaagatccgatatgcatttcccactgatgaaatcaaccacttctgtaactgccttgtccagagctgctgtcacagcaaccaggttctgcagaaactcctcggctgttggtttctccccatcaacaatatcagtcacagctttcacaaagattgccggtgttgaaaacatgtcagcaacatatgccaccgcggctccctggaaaaacaagaataacgaagccagtttgagcctacaaattacaactgaaaacaaagcagagcagcagataacttcgtatgaataccagtgcacacaaagtatcttattcatgctagtcgatttaacttgaactcaggcattaacaaaaaaactgaagagatcagcaaataattagttggataaaaatatattcctatagacatttgcctacttcaatgccataacgacccacaaaatgcaagatgtgtaaaagttgtcctaaagttcataaaggatgaactcattccaacttccaagaggaacctatggttgaagacctccatttccctgttgtgtgcctatgttcttaagctgaatgcttgagcagaagtaaatagatacctccatatccttgactgtagcatcattgttcaatattgctgactcgtcatggggagacatatctagagaatcgccagttgagagcttcccaacctgaagcaaataaggcacaatgacttccggaatgttgaacactagcatgtgatcgactcatcttgttgagtctatacagtgctacagtttaccaataaaatccacaaattcgtttcagaaacaacaccatgctaaaggagacagtaagatatatgcatgtaagcacgactcacacagtattcattccagcagtttggcatcaactagcatagctctgtagcttaccttcaaattgagttccttcaatatattaggggtagcaaatgtttttcgtgttccaattccatacatgtcgaagacctgtggataagccaagaaggtccatgtcaacatctcaattaaacgtgtatagattatctaaaaagaacttgtagaaaatatggcgatgcaaatataatatcttgagaataaatggcaaaggagcagatgtcaccagaagcacaagtgagtaaagcagactataagtttataaataattagttgtcacggtgcaggaaggtagaattagaaaaccatgaaacggactggattatgaaataaacagataaaaactagcaatgttttgttcaagacatgtatgactttctgaattctaataatgtagcacatcaatgaactgaataaggtcacactgcagaaaaatgggactaggtccacaaaaaaaaatactacaagacataacagaacactcacagggataggtattctcctatcgtggaatgcaacatcggatgctaagtagacatctccaatgtctgctcctttggcctgaaagaccagaagggaaacaacatcagaacccaggtacaataaaacgacagcatggcatcaaacatgtgatatcttgaaacattaccttaaacccaccagcagtgccagcattgatgatcagatctggcttcaatgactgaatagaagcataagtcacaagtgctgctgataccgtgccaacacagtcaactcctgaaagaaataaggttagtttgtggataaattgtaagaattacatgatgaagaaacctatcaaattattgcttgattcttgacaacaagctggtgagcagcatattatagatgacaacttaccgagaacaggatcttttccaggccatacaaggtcaacgtgaaggcctttgtagttgccatggtatctaatccatggggcacctttaggaaatctgttaggcgtgtgccacaaaggtaggagttagcttcagagctgagagtatcggacaggttatatgagcaaaacagggtgatgacacaaggttaaagcttaatttatgtatgaaggacacaggaacaggaatagtgaaaacggatcgtatcagactatccctgtaagttggatataattatttccaaaagtttcgaggacagctgacattgacattttcatgagacagattaaacgaaggttgccactaaacttgcctagtaaagcagaacatcaccatccacaaaaataacttgttcttttttcttttctttttttttaaaaaaaatcctaattccagggatttaacttataaccacccaacagcagtaagtgcagcatggcatggaaggataggaaatggttggtgaagaggaacaaggggggagaaacgggagaacactactaacatggattcctccgcctcgacgaggtggaacttgttgacgagcgggagcgcctccgtctgcatcgctgaagccaaaccaaccaaacaacagcaacgggattagcaacaagaagcagaagcgcaggaggggatgaggattgagagtacctatgacgatgaggagcttggagatggcgccggcggggatcggggccgagtcgtcggagtcggagggcggggccatgggattgggggctgctctctaaaccctagctgctgctgctgccgccgccgcgtggtgggggaggagagagaggcggtgggtgtgggtcgtcagatagagggcagcttgacggcatgattagcgccggctgtcactgctaattgccggatttcattttaaatactgccccctcttttgtcacttctcacacgtctatcaatgtttttagagatgggtaatgcttaactttaaaaactgtatgtatgatctccgtctgtattcacattgatcatgtggaaaatttagagaaactactccatggatctaaagctaagtaatacctccgtcccaaaataaatgatgttttactttgttcacatctaaattttttttactgttcatcttattagaacttttttatgattagtattttttattaaatgataaaatataagttcacataactgattttttaaaaaaatttcataaaatttttaaataagtcaggttggatacggatatccacggctgcacttattttgggacggaggtagatataagtctttaaaatagttttatgagaattatctgtatcactttaaaagcattttttttcttttatccggtcctaacctccacgtattaaaagatatcctcttatatataaaacacctcccaccctcacctataaaaaacgttgtagaagaaaatatcagattaaactacgtttcttacctcctaaatcttgttgcaatgcaggcttatgtgactaatgtaaaaaaaagtcgtttttttctttttactgagtgaaaagtataatcaatttgttactttttttttactctctctctcggtcatggtccgacatggaataagttcactttgggtccctctattcgtcgcccagtctgatttccgtcccttgatcgcaaaaccggatacgacaggtcccccaacttacgaaaccgtttaaataaggtccctcggcagtatttgaccccggttttggctgaggtggcacctacgttgctaatttgactcggtcttcatccgacgtggtattgacgtggcgcttacgtggcaattcaatcaaaaaataataaaaactatgggacccacatgtcagtttcacacacacaataataaaaaaatggtggggcctacatggaccccacctgtcatcctccctacagctctctctgtcccctctctctatcctctttccttcctcttctctctatccccctctctcccccctgagaatggtgagcggcggcgggcggcgcagaggggcggcgacgcagctgagaggcggcaggcagcttgtggagcggcggcacgcacgcgcgtggcatcggcgctggcgcggtggaggccccgacgcacccgctcccccacccccacacacctcgcgctcgcggcggccaccggcgcggcggccgcaagaaccgcaccgacgtttacagcttcgggatggttctcctcgagcttgtgcatggccgcaagaaccgcagcgagcacgtgagcgacggcgtcggcgccgccaccggcgacgactccaactcctcgaacaggacaatgggcagctcgtcacgcggcgcacggagcgactactcggtgatggcgagcatctcggcaagagacgacgacgaggccgaagatggcgagcatctcagcgagccccaccacgtggagcagcgtcgacgaccagatcttctcccaccaccaccacattaggtacgccagcgacgccgcgaacagcgccgagaatataaggttcgtgtgccgatgggaaaacagatcaaaatttgtatagacctcacgatgcacaaattaatccctctgtttacaaatcaaccaaaatgatcaatgcaaccgtataatctatcttggaccggagagagctgc

SEQ ID NO: 3417 - DNA, 12733 bp, Oryza sativa
  unsure (1)..(12733): unsure at all n locations
ggccgcgcacaagctcgaggagaaccatccgaagctgtaaacgtcggtgcggtgcttgcggccgccgcgtcagtggccgccgcgagcgccaggtgtgtgggggtgggggagcgggtgtgtcggggcctccaccgtgccagcgcccacgccacgcgcgcgtgtgccgctgctcgccgctactccacaagccgcctgccgcctgtcagctccgtcgccacccctcagcgccgcccgccgccgctcgccattctcaggagagagagagcgggatagagaggagaggaaggagagaggatagagagaggggggatagagagagctgtagtgaggatgacaggtggggtccacgtaggccccaccatttttttttattgtgtgtgtgaaactgacatgtgggtcccataggttttattattttttggattgaattgccacgtaagcgccacgtcaatgccacgtcggatgaagaccgagtcaaattagccacgtaggcgccacctcggccaaaaccggggtcaaatactgccgagggatcttatttaaacggtttcgtaagttgggggacctatcgtacccggttttgcgatcaagggatgaaaatcagactggacgacaaatagagggatccaaagtgaacttattccgtccgacttcgaccggatagaccaacatgggcctctcaaacttatgggcttatcaggtaagcccaaatgtgaattcacgttatgaggccggtttggtttgtatttgtattgggctctcttctttgattgtcaaattattctacttcctccgtttacgtttacttttacatgacgtactttgatttccgaaagttaaactcaaaagattttgatcaataattaattaaggtagtatagttagtatatagaacttacactatcagactcacagttcaaagtatttccaaccaacattagttttatatccattagaaacatatgtcatgataaattcaaatggatggttaaaatttattctcaaagaatgaaactgagctcaaaagatcccttgggatgggagtatgggacctgctcactcaagttcaattcctagacttagcacaaatgctcacattcatgtctacggtgacttcttcaattttaagatacgttgatccagtctttaaaagtgcatactcatagagataaagtgtatgtgtatgagtttagaagtgagtgtacgaacgtgaatataagcgcggtattgttttgaaaatagattttaaaataaacaaacactataaaaatgaactaatggagtatagtatttcttcttcaccctgctagctcttcttcctcctctcctctcagtagcccaaccaattacaagtatcctgtaggtactaggtagcaatagcattgaccgcgcgcaacatgagtgttttgctgagtacttgtgctacagttatggactgtggatgcataattagttagtgggagccagacagtcagttatctgaccatcttgctagcttattagctggagtagattgctagcctggacgaaatgaaatgccggagacacatgcatgcaggcactgaatgaaaaagacaaattaatatctatatctgacatttcagaatatatataattgccatcaaaaccttcagctacactatttcttcagtcaagtttgtactactaattctgtatgcattgacgtgttccagttttacagtacgaagaatcagattgttcttacaaaattttgaaagtagagacatttaactcaaacatattatataatacgttcatccagtaaccaagaagatcaattcgatttcaatgcgttttagaagcaattagttaaagtgagaaaacaagcaagcggtagggcagcaaacctacatactagtagctacagtagtacagtgacaagacatggatcggatgacgatcaatcaaagctctgtactaacgtataagtgcagtcccaacccataatgtctataagtagtgtctattatgccatgtcaataagacatcacagcagaaagagaaaatcccctgtgtacccttgaaagttcacctaatcccttctataccctgaattttgctcaatcccttacatacccctgaattttagtttggatcccttccatgccctttccgctagttgaccgttagttgaccgttaaattcttatgaaaaagtccattttgccctttggtataaagaagcatataaattaacagataaattaacagagtatattgttggagcatagaaatttattatatgagactattatgtttattagatagttatgcaccatattatttgcgataaatatacttttagatatgacataaaaaattaatactaatttattagttattaaaagattttttttagcatatgtgttctgaagtaataaacaaatctgttgtattactatgaaaacacatatgctacataaaagaacttttaataactaataaatacgtatcaactttttatatcatatgtaaaagtaaatttgtcacaaataatatggtgcatcacatactcataaatataatagtcttatccaataaatttttacattccaacaatatacttcattaatttattatgtttctttatagcaaagggcaaaatggactttttcaaaagaatttaacggtcaactagcggaaagggcatggaagggatccaaactaaaattcaggggtatgtaagggattgagcaaaattcaggggtatagaagggattaggtgaacttttatgagtacataggggattttctccaatagaaactacactctacaacccatggtttcttaaagtggatcattaataaatacatcatctctcttctctaccaatcagatttattcttcatctattatgaagacactattatctcccaatgcaaaacttgacagtgtctagtgcataggttctcgtgttgaagctatgtcttgcatgagacatagtttcttcctctcttcactctctctctctctcttaattaatatagtgccacataagttaaaagtcctatatggcaatgtagttaatgccataaacaccatcttaggtggagggttaggactgccctaaccagctagctgtatcatatctgtatgtgtgttgcttgatacttttgctgcaatgcatgaatgctacagagaatgcaaagggaccaattgcaaaaggagatggagaacgaaggcaatgcaagcatcatatcatgtggggtgtaagtgtgtaacagtgagaaaggagagaaagaaagagagagtgagaaaagaaggctggaggaagagagcttgcaaacaaacatgcactgatcatctgaacaaaatagtcatctttcgctttcagaaaaataagttggacacaggactagtgaaagctaaaagctactagcgcatccaaccaaagtgaggtgatgtgtgttgtgcagtttttgctctctaccactactagctcgatcgctagatcgatccttcttttgtttgtctctcttgattattctttcctttttcctccctttatttggtgtacatgtgtgtgggtgggtgaggaactcgcgatgagttaaagctttgatttcagagagtttcagaccatgcgtctatatatatgtgttcagaggagaaatttatataggcaaacgaccattaatcacgagctggccggtagtagattatatgccaaagccaaacagtcatataaaaacttatctaatttaaagtgtactatcttcacaatgattaatttccagtacattgtcaattcatgtattgtattatagtactccaccataggaccacacccaacccatgctagccgcggaaatttacaaccagacagattcataagaactgaagagaattatattctacatccatatttaaatactccctccattttaaaatgtttgacaccattgactttttagcacatgtttgaccgttcgtcttattaaaaaaatttgtgaaatatgtaaaactatatgtgtacatgaaagtatatttaacaatgaatcaaatgatatgaaaagaataaataattacttaaattttttgaataagacgaatggtcaaacacgtacttaaaaagtcaacggtgtcaaacattttaaaacggagggagtacaattttaatttcaccctccatgcgtgtatgtttcatctattaaatttcaggacaaaataacgatgggtttgacaatgcatcggctggagatatctccgacgacagttttactgacggtcctctgaggcaaaacaaaagtatgctagcatctgaacagaacgacaccaatatttacagtggtttatggagcaataactcgtcagggtacttctttcaatcttactcgatcgaacaatggtagcgaagtgtgtatcctgctcgatagtactccctccatcccataatataagggattttgagtttatactgataacgtttgaccactcgtcttatttaatttttttttacaaatataaaaaacgaaaagttgtgcttacagtactgtgaataataaagtaagtcacaaataaaataaataataatttaaaaaaaaattgaataagacgaatggtcaaacattataaacaaaaactcaaaatcccttatattatgggacggagggagtagtaaagtagccagtagtgccagtactctgaactactgatgaaaccatcaatgcatgcatgtctattgaaattaaaatttcatgcatgcacgtaccacaatgtgtttcaaaatgtcagcagcaacacactagctacactagctactagctagcacagtactacaatgcacagaaagagagatatcaggtctgcacgctgcaacctgaaaagatgcagcgtgtgcaataccctagacctttagctctgtcgaaccaaggaccattttgcagtagtaagtgttccaaggtttttgaaactcatgatgatgcaatgatttcatggatagagttccaactgtaccgtatatatgcatgcatgatctttctatgactaaagacgtgagttagttctcacatcgtttctaggaaagacaagtctatgtgtttcgggaaaaggtatatctgaacaactgttgaaaatacacattgtttggattattatataagtcaacgatattgtcttttgagaaactcaaactaggagttaaattaatatgggatatataaataaaagcacggcaaattaattaaattaaattgaaacttctttgcatggaagctagccaattcattttctctagctaagctaacattgttagtctttaatttgttaatgactcctgcctgtgttaatgtgttattaggcaaagctaatttcctactgcctaagcatcatttgcaagcatatagttaacaactgtcccaaattcgtttaatatatatttgatttactggatatatatatttgcaaaactaaatgcatataccaatgaatagaccgtattctaacacctctactgtctggcatattttctattttgcctgatggactatttgcagcaaggtaggcttacccatcagagaaccagctaatgaaatttacagaagatatctcaaggtaacaaaataatacctaagcaatatgtaacctttacccacttttatgcccatatgtatgtgactctatttaatttctttcatatagaattatattgtgctatgtattaatgaaggcatcacaaaaagcacaaaagtgacagatatatatatagcacaaaatttcagttgatcttacctagcttcttgttgcagaatacaaaactgagcgtggacttagagacatctatgttgaggttaccaggtcggccgaaccttgagttcacacttgggattgggaaggcttcacaatgatacatcagaaccgcgaagtccaagcatgcataactaagttgattgatttcggtgtgctatagctagcttgacccagttagtagtatatagtgtcatttgcccgaaatgactagcttggctagataagaagccaataagactgtgaagtgtgaaggcacaaaaagatttaaaaaaaaagaggagagacactgtattttagctagtttcttacacatgccttgttctgataaagggcattgtggagaaataaagagattctatttgagatgccagcactaccatatagatatacaatatagtcttgtctgtatgtgtgtgtgtgagacagacaaagtaggttagtacgtagcatatgatctggctctatatgaaaaagtcatatgttgtctaaagctatgttcatgcatggagtgcagcaaacgtgacaggcaagggctcatcttttactgctaacaaagaaggaaatgctgcatcacgcacgtgcagttcccaattagagtcagcttttcagagccccacaaagcaagaaaatttgtgcatgaaggatgatctttactgaatgcagtcctaacttgttttcatgaatggagactgagcatacaatgcatgcagtgagagatgtcatttatttgaaaacatgtttatgaaagcttaattaatgttgtataatgtgtgtacattgtacaagagatcgagtacctagaggctagagctagctagtttctatatataattttttttgaggtaatttcctatatgtgagttggtgaaataaaacatcactcctgagagtaccagtatatatactcaatatatatatgcactagttctgatttcttttctctagttaactatttctttgctgtacgtaatgcccacaaggcaagagatctactacatgtgtgcggtgaaaacctatatcaacatgcatgtaagaatggggatttgcattaaacatgaagctagctagatgacgaaaaggtatcgatatgtactagagccagatgggcgtgtgaatgatatatagtacatagtactcccttcttttatcttatagagcttttatattgggaacaagaagcactgccaatgtgcatgccatctttcagcttttgtagctagtcactactgtgaatgcaactggggcaggctgtagaacaaaccaagcaagaagcaagttgatggaggtgatctcctaatcacctttttaccatgtgtctgatattgacccaaccaacaaggagtaagagtgcaagagtagcgtgtgtaaacagattcagagagagagagagagattgtagcaagcagtaaaatatataatgattaccttatgatcgacaataggtgtttgatcccatgatgagggcttttatcacgtacagatcctctctttaatcattcctgtttttctggctactggctagtgagtagaagctgtgatgacctgcgcataagagtgagtttttctttaatgtcgttgaatgggagctaatagtgagcttgcacaagaaaaacctgggactaattaactttgtaactgtaagtaataaaaataacatatgttacttatgccattttactttgcaccgaaagcagggccgtaaactttattttaaccagctggaacagcaaagctagcgacgaaagcgactcgtcagagggccacgtgcagctgtgccaaccgtccacacacacacacagggatgagacgacgacgtgcagccgtacgtgtcactgccaggtggggccccgtgcacaagggagcaaatgaacacgacaatcaggcaggcaagagggtccaggatatgataagaatgatttggcactccattggcccatgattgatgagacttcagagcatgtactgtagtggtcatcgtagttgtaaaaatcagcgcctccgcagtcaacagttagtacctttacttttcagttttcaccccatgtggcatactggcaaggtgagaagttgaaaggcaaggctctctctgcttcaactcaatccatccatgatccatctacgacgagtctactaccactgatgcagaggtgcagttgcaggaggttgtacggtcgctgtgacttcaactaccgagggttgctttgcaattgcaggcagcccttttccttctgacctctgcaagtaaacaaagcaatgagcaaccaaatcctgtcatgctaactccgcagttatagtcagaaaagcagcgaacttgtatgggccagctgaaatccttacctttagatttggcaatgttttactggtactgtacatggtcaatgctttgggatggagatggaggtaaatctttgcatatgcaggcttgatttcttctctcttgcattcagctcaagcttctctgataaaaaccgacactgatgacagacacatccaacaatctcaatattactagtagtttagtaccaccacttggcggccctctttgatcgccgtactcatatactatatatattatactaaattggagcacgctgatcacgttctgcatcaaccgtaccaattaccaactccttaattggactttaaagcttgctactcagctgctctaagctcacaccgatccagtaatcgagctccagacatccatcaatggccatggagctctctaacctgacgaggtgccatctgccactgctcctgctcttcctgctggcaggatcctcctccatggctttgccagtgcatcctgcaatggacagggtgagatggcaggtcgacaaggtcaaccggcggggccattccatcgggctcgtcatgtcgtacatcgatgaggccactgctcttgaatcctccggctacttcagaccttggcatgtcctccccttcgttgacctctacggtaactctgggccttccatttccaacccacatgcttgaatggataagtcttggcgtctttcattggcatttccaacatccaataactactgctaaaactgctaagtgaaccaaaataccaaaaacagaacaaatgcacatatggatacataatgctactattgaagtcagtggtagtttcagcattttttttcccgaaggacagtagtttcaacatttaaggacatcgaatacaagttttagatatacctgaatttgtcatatgtgatgaagccagcttgctctgcaaatttaaatgatctgcgctcaatcaagacctgaagaattcaacatgtgatggtttagcctgtcaattagcaatttcataatgtggtttggcacatcgtcccatttacttattgttggatgaacacatcaaagaacggggtacagctgtacaggaactgtaaagccgtaaaccaagatttcacatcatgttgatagatgcactataaaatagaaaactttgccataaggagaacacaaaaggaaaaaatacaataatataccacattttcattgtatcaaatattcattttacaggtttaatgaaattttatattccgctgatatattatattcccattcaatttcgattcagaacatctcatgtagtccttaattcttttacatcttataatggactctcaagaataaaatgctgaactcttcaaatttcaggacgaaggtatcacatcgggagtattagaggtgtcaatgttatatatgcactgacaggacaacgcagggtattaaattcataagttatttgcgtttacattatctgccttgtgatacatggagaaaaccattttcatatatcacaagtaatgccaaaagaaactgctgtgagatgctatttacatgcaggattttaatacaaactgcgctatgcttatgcattgttactatgcctttgttcttccagttaaatgcggctgtgactgtacagactctcatcgacgtctttactgtgtctggcattgttcattatggcacagcaggaagttctaatgattcaatgtcatttggcgatgtcagtgtccccaaatttgttgcttatacaagtgcttggacatggaaggtaccctccaactgtgatctgattccgtttccaacctcaaagaagtaaagattcaaagcaactggaatctgattattccccttaaaagaatggaatatgattatctgtaaatccagtattatagttgctttgaatcattaaattagttacatcgtgtcaaaatatatacactactgtacttttaaaagaatgctttggtgagtctaccacccagccttctctctactacatcttctactgactgctttgatgtgttcaataaaaaaaaattccatttgctgcataatgttaggacatgagtggctcatttttaatctttagcaaatgaatgaacattcagctaatctattaataaatttagttctgactagagaaaattaaactagcaatgcttatataagcatgttagttttaaatactatggtatactaaaaatcaaaatcacatttagtagtagcctagtaggtaaacacacatcgagcctggagtgaaagtagaggacagtttataagcacaactacaggataattagaacatactccctccttccctaaatgtttgacgccgttgacttttttaaacatgtttgaccgttcgtcttattcaaaaacttttgtgaaatgtgtaaaactatatgtatacataaaagtatatttaacaataaatcaaatgataggaaaagaattaataattacttaatttttttgaataaaacgaacggttaaacatttttaaaaaagtcaacggtgtcaaatattttgggatggagggagtattttagtaccaactgtctcacgtttcaaactaactctttatatgacttcttgtttttgattattttagaagttcaaatcaccaaaagagtcggatacagaacttagctttggagattttactgtcccaaatggaggagagaatcttctaggagctctgaaattcagaaatgaggagctatactcagtgggtaagcctatgaaagaagttttctggttacctgtagattcagcatggttcaaaatcgcagaaggacttaaggtgagatatagcataataaatgccagcttatgcttgaccattaatgcccgaaaaattgtactaattgtgaaatttttataggtttcacttgaaagatgtaacgacactttctgcttgccaacaactccaaaagtagtctgtgggctaaaaggatcgtcagctgatatgtttctagacaatgcagaatataggaagttccttttcagagaatttggtgtatcaacagtagatgaggagagtgcagcagtggtgatggtgagttttgtattttatctctcatggtttccacttaaatatctgccaatatttacacatcatttttcatgcaatcatgaaggttaagatagatttatataattaacagaacatatactaatttcaacagacaacaacatctcctggcatacctgtgattgtattccggggagtttctgatttggctggaggggagccaacatggtcgtcaacaagcctgatgaacctggcatctattaatgcactcaaagtggcagtggagtttattgctacagtcgggaaacagaagtcaacaatgtcagcaggaagtgctaataactgaaggaaaaagatcacatccatgctgatccaataatgccctggaataacattttacagcagtagctgcattcagaataagatgctttcctgagcttcaagtgcatgtcctctcccataaaggatattagtgttgaattattttgttgaaacttgtaagcatgcatgtgcgatcattttattgcaaatggaatagcagatgatgttgctttttacgaaaaaaaacaaattacatcagtacggttttttaatccatgatcaaaaggtaagaagaaaatgataactttcagttattgacagttcgaccgaacatgtgaatctaatctcaggccaaagataagacatgagaaagtcatggttgctatgaagaacaggttccctatgcactagtatcttaatgtaaatagaagcatttcaattttacaatgactgactggaatttgcagtatgtttcctgaaaaggtgaagtggctataacaattttcagatacttcacaagtttagccatttagtgttgatataagaggcagctgcacagccctacaataaaacaaggtaaaactcattggcaagggcgttggcaatagaaaaccatatatgtagaatcctattatcgcatagcatgtaccacgtataaaactaagcaattaccttaagaactttgccaattagtttcacctaattgtcagatctgatactctgatctttctgaagctccctcatctccgggtgcagattcaaactgtctcaacacttcactaccagtagtctccacatgagcatttgccatccttaaaatggtggaatcgctgaatatctctcatgattatttcccgtcctgtcactaaagatattagcttggttgcattatggcagtcattacaaactcggaggttcttctttatctggattgttgtgccaggggctgtgcgaatgagcccaaaagcaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3418 - DNA, 4051 bp, Oryza sativa
cacataagcacaatatacttctatttcatatgacatttttttatatattatatatactccatcagtttaggtcgatgttactgtgtatgaatagtagatctggttgagactttattttaaattaaacataccatataggcaatcctttagttcttttattttgttttttttagtttagtcctaaaggaagattccaaagttacaacttgcaacttattacttcctaatttttttaatatcaaactaaaaactaccaaactgagagtaaaatagaagaacaaacatgaagtgattaatttcagaaatattaaatcatgaaaaattttataattgttactgcaataacagtataaatcgatacttactaattacaaattttagaattacaaaataatgtaaatccataaatgagactccaaaccaattacaattcaatagttattagatattattttagaattattaaatcatgaaaaagctaacattaagttattaaatattacaattcaatagttattaaatattattttagaattattaaatcatgaaaaagctaacattaagaccccaaagccttttctctaagaaaaacatcaagaccccaaactgagtacaactcgatattttctaatcatgaatcgtaaatcattttagacttcaaataatatacaattgtatactaactaaccatgcatattaaattattatgtcacgaaaagctatgatggaggagaaatatcctgtgcacacaagcttttttatacaccgtacacactaacaaacaaattttattgaaaaatgtaaaaaaaaatgtacatgtatttctaatattgttgcacttatgtgtaaagtcttaaccttaaatttattatattttagcagcaacaaaaaatataaaaattctgatagttttaaaattataaatctatcagatttttttattccctatatataatgtatttgaagatgactgtttatacatagatgtaatattactaaaagttaaatgtatgtgtacattattttctaaaattttttattatatctttagttggtgtgtataggatatgtttccataattgagactgtaaacatagtaaaactttaaatgtttgagaaattttagttaacataaaagttgtaaatgagactacaaagtgagtatagcagtactcctttaactatatgtttctacattaaattgtacctaatgagtataaaccgatacttattagttcttattttttaataattaaattaagaatataaaaactaacaaaagcaataataggatggattctatatacattgttaattattttgttttacattattgtaaataaaataaaattcttccgtctttataactttagagcaaagtctatcgataaattcaacgaattttaataacatctatattaaaaaaattataactttagagcaaagtctatcaataaattcaactaattttaataacatctatattaaaaatatgattaaatttttattatttttactatcataataatagcttgtgcaacgcatgagtcgccggctagcgtaattaatcatgcgccagtgatccattcgttttatgagccgtgaacagctccaccccaactgtgcacataaagagcctgtttgggggagcttaagattctgagaagtagctgctgagaagctaactggtgagaatctggagaatctgggaaacctagttctggcttccagttcattttccagattctatgactacagattctcagaatctgtgtaaaaagctagactgtttggggagcttctggcaattggagattctagaagaagctgcagctgctagaagctcctccaaacaaacgccaaccgcatagatatctgtgataatccaggatatgcccaatcactggttatcttgcggtcaatcttttggtggctagatgttcatgttcaaaagaagaggcatcttacatctagccaaattctaaatactctgcattagtgtgcagcacatgtggattcatttgcgcatcttattataccaattgggagagcagaggccctggtcctttgaaatgagtaattatgggccctgattggaattttaacttctaaaatcctaataatctattaacttattaaagaaatagaaaaagaagcatccatgttcgctctcatggcttaaaaattctcacattaatcggagaaaaagaaaaaaacagagtatatttaggaataaaatttaaaaatagctgaaattcggaattaaaaataaggaatatagaaagagaatactacagcccataccggtatacaatagaactaatggaaatttggaattaaaaaataagaaaaaaaataaaagtagaggttagagtccatatagaaatacaatttagaaataaaaaaatcgagatttaaaaagtaaagaatataggaagaagaatatagagtccatatagaaatacaatttaaaaataattaaaattcgaaattaaatatattgaaagataagtttggagtccatatagaaatataattttgaaataatataaattaggaattaaaataaggaatattggaagaagagtacagagtccatataggaatacaatttagaagtaactgaaattcgaattaaaaaaaatattgaaagatgagtttagagtccatatagaaatacagttagaaataataaaaattcagaactaaaaaaataatcaatattagaagaagagttacatatagaaatataatttataaagaacggaactttgaaattgaaaaataagaaatactggagaggagtctagagttcatataggagtataatttagaaataactgaaattttgaatttaaaataagaaatataggaataaagtttataaataatataaatttataattataaaaataaagaatgttggaagagaagtctggagtccatataaaaatacaatttaaaaataattaataactatcacatatatacaatacattacgaatattacacattggttagtttgatcaagttagtacaaaatttaaaattatgttgccattttaatatattttaataataaaatgtgataatatatatgctactatatctctactattataaaaattgaagatgttcccgcggtccgttatccgtgtttgagtcggttataaaaattgaagatgtttccgcggttcgtcatccatgtttgagtcggttttaattttatgttttggttttaatctatatctcttctctatctctactattataaaaattgaagatgtttttgcggatattttgatacgccatccatgtaagagtcagtttttgagttcgtttgcttttagaaatacatatccgtatttgaattgatttttaatattattcacttttggtaatacaaaaggaatcatacaagaaactgttaaaaaaaccccgcatgactcctaactgcagctcatgattttctaaaaatatatatatccaactgaactcccacagtaaatttcatctaaaataaaccatataacaataataagattaaaataaactttatccgttgcaatgtaccagatattttatctagtgagagaaaaatataaagatgctagttgcgtaatttgcgcaggccaccataatgggacgctacatttaaccatggaacacagcctcctacctgaagttctgcccactatccacgccctcactcatcacagtgccacggggacccgccccaatccacctcgccgccggtgggtcccagggctccggtcactgctcccgccaacgacgaccttgttagccccctagcacaggtgactgttggctctagatccctctctctttctctctcccgttattcctttttattgggaatattggggtcgattctgtgcagctcatgttgttgctgtttgatttcctggggttctgggatggcagttggaggttgcgcggtaattggaaattttgtgcaacacttcttttaaatagggattggtggaaaatctagaaaacgatggcatgcattgcaaggtcgcaaggagga

SEQ ID NO: 3419 - DNA, 2311 bp, Oryza sativa
acatgtacagatgaccatagtatataacatggaattcaatcttagatgattttatcctctctactttttcttaacctgcacgctcatgttgttgttttgtgaagatgcaactctattttctctccattttctcccttccatgttagcaactacttcctccatttcacaatgtaagtcattctagcatttcccacattcatattgatgttaatgattctagacatatatatctatctagatttattaacatctagatttattaacatcaatatgaatatgggaaatgctagaatgacttacattgtgaaacggagggagtattgaacgaggcacttgctaagacagcacattgatgaccaccgtgcatgcccttatagtctcaatttacttatgatgtgctaatgcctaatggaatcatatttttattctgtctttgtatagtcaccttgtgaataccttctagccaggcttcagtgaatagtagctattaattcttctgttttaataaaatgaaaagaaatcttgtggtacacttctctgttttccatatattgtagaatattgatgagtaaccaatgcaataatggatagtgaaacacttgaccttgattttagccaatgcatgaaattggtatctaaatattgtttctcatacaggtttatactagtgaagttaatggatatacggaaggaagtgcagtgccctatatgcttaggtaggaatttgctttccctaacttgcttccagatgtagagataaaaaccctctttactttgcacaattccctctttacagttttacttcaaattgtctattgttctgtagatgtaagatttttttaatcaccattttctataaaaagtgaagcagcaaagttaatagtccacatatttctgttatccaagtatgtatatagttcgtataaaaaagatattgtgtataattgctgtccactgataaataacaagatgtctaagagaacatgcatgttttactttggaaaaaggtacatcactaagctcatgttctacatattttagagaagcacaactagacagagtttattacactaggttgagtaagcttctcatctgtggaattttaaatagcatctctgcacaaactgtgcatagctgatcatctgaatgccttatggccctattgcaggcattatccagaaggcaaggataattacggagtgtttgcaccggttctgtagggactgcatagaaaaatccatgtggcttgggtatggtccctaacattattcacctaaaattctgtcaatgccatttcgaaagaatggacctgactggggttttgaaatagaatgtggtacttactttttatgttaaactgagtgatacattgtttttatagaaatgatgaatgcccagcatgccgcacccttgcaagtagtcattcgttgaaggttgatcctaattttgacgctttaattttgacgttgtatccagatcttcacaaggacgaggaagaggtgatgcataagttttctggttgttgcacttagctatttcatttagtttcactacactttgcttgaccacacaggaacttgctttcactgaagagaaaacttgtcgcaaaaaggtgggtttatctgactgtgtcatagtatatttaatgtagggaaattattttccctgcccatttggaatttgtcttctgtttattgttactgaaattagcttttgtttatcaatggaagatccaagcatccaccgatgaggcacctcatagacgaaaagaagcacttgggaagaagcgctccgctgcaaaagcaataggttcttcaaggtctcaagggaatatgctggcaaggaagagaggacacattggttttcctgatattgtcccatctaaagttggtggtaaggatagggaagaaaatgacaacagtggctgcgatgagtggtctttatttgatgagtattcacaagatataaagaagaaaagagctcggaggtgtcttgtgccacgatcatcccctgctggacataaagtacccagcaaagtggaccaccatgaggaaggaaatgcaacacataaagcagaatcactctaagacacatatttgctgcccgctgtctacagaagatcagatggatctttcttctaaacaagacacattcacgacaaaaactgttataatgccaatggttttaacaatttctctgtgccaaggtattcctcctccagttattttgccattcctaattcagatttccacaactttgaagaaggacgctcatgcaagaagttttgagtgtggacaaatttgggctttat

SEQ ID NO: 3420 - DNA, 7287 bp, Oryza sativa
  unsure (1)..(7287): unsure at all n locations
taaatttaaaattcggaactggaaaaccaagtatcacggaaatgatgttttctctcatttagtaaatacgggacatattgactcaaattggcagattgaaatccttccgtaagtaggtgaaatttggtccatctacatgaactggacatttgactggactccttccagcaaagctacatgcgagttcaccatcggtgagatcgttgagcgcacggaagcaactataaaagtttccttatgaccagcgtaggggagttctgaagatacctataaaagatcgtttgaggttttctcatcaaatactctccttccgtttgacagaggaaagaggtggtgagctttgtggcttcttagagcttgatcctggttctgttcctgacattttcctcaatagggaagaaaataacaatgatggttgcaaagggttgtcatcagttggtgatcattcagaaggtccaaagacaaaaaaagctcgcaagtttcatgtgtcacaatcatcccccgctggacataaagtcaccagcaaagtggacagccatgaggaaagaatggcaaatcgtgtagctattcggctaaaggtgaatcagtctgaagcacatgtttgtcgcctgctgtctgcagaacatcatgaagatctttctttgcaaaaaaaggtaacctttcagaagaatagtgatagttccaacaggtttggtgattcctctcagccaatctgtctctcccacagtatatatgcggcctcctatggtgtctccagaccagctaacagaaagaaagatgttgatggcaacagtagactgaactccaatggtaaaaggaagtaaaagaagaatgatcttccattttctgttcacttgaatcgtaagaaaacgttcggtgatactgcccatagagctgacagacaatataatccacctcctatgacaagaaaagtagacattcaaggtaaaggaaaaacttcagacacagatgataaggacaatgccaatgctgaagctactaatactgttcgtcagaatgagcattcctgttctttagaacttccgtccccatatccagatttctatgattttgagaagctcagggatattaatatgttctcacttggtcagatatgggccctttacgacgaccttgatggcatgccaagattttatgctcgaattgaacattttgatgcatccagcttcaaagctcatctcacttggttggagtacaatgcagcaagtgaagaagagaagaaatgggctgatgaagaacaacctgttgcttgtggtaagttttgcttagggtcaacatgacagactcatgttctctcacattgtttcatggacaaaaggcaaaaagaggattgcctatgaagtatatcttaataagggtgagttatgggctctttataaggattggagcatgcagtggaattcagatgcagacagccatcggtcttatgattatgaagttgttgaaatattgtcaggtttctcagttaatgatggtatcactgttatcccattagtcaggattaaaggctttgtgagtttatttgcggcagctaaagacaaatctgcagttgtgatagcatcgagtgagttgcttcgattttctcataatatcccctgttacaggacaactggaaatgaaaaagtaggtgccccggcagggtttatggaacttgacacttcttgtctccccattgacatggatatgatatttccttctgtcaccctggactcttacatctcccttggcaagaaaaagggcagtacactcattgatttgacgactgacagtagaagtagtagaaaggatcctggaaatgaacaaacggagaatctttctgaagcacaaaaggagagtctttcttctgaaaaaaactcatccttgcccaaaaatggccacgttgccaatggttttggcaataattctgggccaggctgcccttccccaaccccaactattttttcatatcctgatccagaattccataacttcgaagatgaccgcacatgtgagaagtttgaacctgggcagatttgggctttatacagtgatgttgataaattccccaagttctatggttggataagcaaagtcgagcgacaaccgttcatagtgcatttgatctggcttgaggcttctcctgaatatgagcaggagaaacggtggttggagcaggacttaccagtctcttgtggtaaattntaaaatcccggactggaaaaccaagtatgagagaaattattctttctcatttagacatacaggatagaatggctcaaaccggcagaattgaaattcttccgcaagtaggtgaaatttggtgcatctacaaaaactggacatctgagtggactcctcccaaagtagatacttgcgagtttgtcgttggtgagattgttgggcgcacggaagcaagtataataatctatcttgtgacccaacttaatggcttcagagcggtgttcatgcccgacaagcaaagtgcagttatggagatacctacaagagatcgtttgaggttttctcaccgaatcccctccttccttttgacagaagaaagaggtggcaagctccgtggcttctatgagctcgatccagcttctgttcctgacgttttcctgtataggaacactgttatgggctggataacgtaccagcgttaccggcgtggcatgagaggtgtgccaggcacaaaggcagcagtggcggctgacgctctggtgtccatgagtgctagggcctcagccacccatccaccactcctatagccttcgcaacctcaccaagcactttagttccacccataacagacactccatgacttacgaatgccatagcagactcttgagacagtagaactgaaattcggtcttaattatgatatatcttgatgtatggttctactcattttctgtgtacatatatgccttacctgtaatctattcagaaacctgtactaacattctaattatgtggcctctcttacttgtcaaatgccatgttttgctaaggataagccctgttcaaaaccatcataacatgcattctattacagttgcctctgctggctgccaccctgtggaaggggctgcactgcaatcagtactttttttctccaagtgttttatgtgtttagtgattttcttaatttcaaatgctattgtgaaatcctgtcaaaatgacataagttgtgtttggctcctgagccctgactactgttggaactgttgtcggcatatagtgttgtctggcagcatgctcctgtatgtatgagcctgtactttctgtattaaccttaataccatcaatgttttacccagggataagttatgttcaaaacccatcctgacattccattgcagaggcctctgctactgattactgaacgatgcccatggaagggttgcagacttgcagtcagtatcttttttctttctttcagtacattgtaatcagcaaattagtgtacccaaattttcccgaaaaagaggaggccaggaactgtagtactctacacagcttttagtgtgttcagtgatttaattggaaacgtaagaacatcgaagatgcacgctactcatttttggttttctgtagttctgtcattctgttactcgtccagaaaatacagccttttctttttctgtgtcgactccaataccattgacttggaacaaatcctacttgctaggtttggcagagaatgataaatggaatgattcataaattactaataacccagaacatatcttgatgggaccacctatacatttgttgacaaattttctcctaaaaatttaacagatgtaattatagtacaatcgtagtgtaattacattgtaacttgcatgtaactacagtgtaacttgtatgtaagtttcacgtgattttgaatcgttaaatttattactccctccgtttcacaatgtaagttattctagcatttcccacattcatattgatgttaatgaatccagatagatatatatgtctagattcataaacatcaatatgtatgtgggaaatgctagaatgacttacattgtgaaacagtggaaatacaagatttgttatggtgaggaagaaaaaaaatcacagcacacacatatgtgaaaggatttattcccacgacctccatttgacccaaataacatgttacggagagatttttgaaagttacgtacaagttacattatagttacagtgtaatgacatgcaagttacagtgtaattatattacgattgtactgtaattatatctgtcaaatttttgggggaaaatttgtcgacaaatatatagcaaaattgtattaagataattagtgatttttttattaagattgtttccaagctacactactacatgtatgcgatgttggtatccatgtagtattgtaagattgtttcctagtcaatctttgaaataggaggtggtgtttgtgcacaagaaattttgccttgttttttgggtgcatgtgtcacacagttgacatttctctattagtgatttttttgtatgtatgcaggaactgatgcactaaattttcttttttacatattggaatgcaacagagaagaggctgtaagggtcagataaattgcagtgaagaagttggaaaacaaggacattttttgtgccaaaggccttttccagatcttgactacatttatcagctgctaactgtctgcaaagttcattcttcagcagaggcgaaaacctactgagactttggactggtatggtgttcttcaagtggaggcaacagcagatgacccacattaaaatatcaacatgacaagctttgccttgtggcttttatcctgatgaaaacactctttctggtgctgaatctgctctcaacttggtttcagaagctcatctaatactgtgtgatcatatgaagagatctttgtagtatgacagcaaaagggagtatgcttccatgaaagcagcacacaaatctgaacatctctcaaacaaaagggagtaagaactttgcattcaagctgcatgaacaggctgtgccgtcgagattccttttagcttcagcagcaattaccgaacttcgtcagaagcgttttcgcgccgatatcacagcagacccagtatattaagctttcttcaaccgagggaacacatggatacagaaacaagttcaaatgttgagcagatcatggtgccttcaccagctgcagcttgagctcctagtgctggttctaattatgtgcaaatattggatgataattcagctgtaagtctatctactgaacatcatgtccccatcaaattggacatccatggggaaagaaatgcagaacatgaaggcgatcaacagaattaccaaaaagaagccggtgatactgcttctcaggagtcaggactctgaacaatcctgtgattgcctaccactatccagacttctgtgatattggcaagtttagagatatcaacaggattgaagttgatcagatctgggcactgtatgacgaccatgatttcattccaagagtctatgctcgaatagatcacattgatatatccaacctcaaagttcagttcacttggctggagcacaaagctatgaatgcacaagaggcgaaatggagtgatgaggaattgcctgttgctcgcggaagcttctgtttaggagaaacatgcattgtagaagggttactggagctagatacttcagctcatctttcaagtgagttggattcaacatttctttctatcgctctcacccattacatgtctctcgacacgagaccgaacactgaattcactagttgcgcgcatcctgtttctgaattccacaagtccggtcatgtgataagtttgaacatcagcaaatttgggcattgtacagtgaccatgataagttccccaatctctatctctggatagccgaaatcaaagctggatccactcagattgcatttgacatagctagagatttgccctgaactcgaacaggagaagcaatggttggagcaggatacacctatcagttgcggcatctttagaattggaaactgcaaatccatgtgtgattcaaatcggcaaattattttttttcccaaaggtaggtgagatttgagccatctacaagaactggtcacctgattgggctccttccagattcaatagctgtcttgagtatgccattggcaagatcatcaggtgctctgaaggcagcacacactgttttctcctctgagtgaagtagacgactagatggatacatagctgtgttcaagcttcacattgggaaggagatactggagatacctgagaaagagaacctcaggttttcgcatcggataccttcgttctctctggtaaaagaaaagggtttgaagttcagtgacttctatgagctcgaccctgcttcagttcctgacgtttttctacagaaggaatggaggatttccacccaaatttcagctgttcaacacctgatttatctaaatttacccaaacatagattcgtctggccatgttaactttctgtgcaaatcctcattcatgtttacacagagaaaattatacaattcatttacggtacattgtattgcaagtatatcctagcagtatatagaagggtatgtttggtatttggtaaaaatctggaaagggctttttagccatttgaagttcacaattgtttctatcgggagtaccctgtcgatctcgtcgtgtggtcatggtagcgctcttccagaatacgaagacgatgcacgtggaggcggcccgattccttccccactcggcttctcccgcgtccccggcgccatgcctcgtaggctcccaccctagccgccggctttctcccccgtattcaacctctgccttctccaaaccatggcagcgaggttggccacgtcgagcccactgcctcatcccgcctcccacctccgacctcttgctcccactgttaaggtctaacatgcagaaccatgatccataaaattgatagatgaatctgttggatctgttatactctacctggtgtatatactgtgtccaccaaatgaattcttctgttggtgatgaaaaatgctgtttctcaatctccgccatgggcacagtaatcttattcttgcttttcaatatggcatgtgaagttcattaattcctctggctaaaataccatcttactagtacattgcggtggcgcagggtgcctgtggcatgtgggcacgcggtggtcgatcgccgtgacgaaggaaggcgaacggctcaattaggatttcgctcgagcgggatccgtcaaaggaaaaaaaaat

SEQ ID NO: 3421 - DNA, 7228 bp, Oryza sativa
taaatgattaatctatggtttaaattatctttctccttttttcctctaattaagtcatatcacatcaattgtttttaccctttaaatgattaatctactgtccaaacatctctctacttttcttcttccataaagtcataccaccttactttttacatttcaatcaccattctacatactatttaaatttaaattatcataaaccacattaatttacttaatctgatgttatctagctatcttgcacgttattttttttattgttatcatactaaattcccgcagcaatgcgcggggtttcacctagttgaaagacaaatataccctttgtcaatttatattacaagctaattgagtggaagatcaaattaatctaaaccattagatcatttatactggtaatatatactactagtatattataccataaaaatcctcaaattatagtgctactctgttgctaccgcatgcctgatgaggtctcagtgttagtggcatggtggtgattcaatattcagtatggagtttcctcatgcagacagtgagacagacaatgaccacaggtctatataaatgtgatatggaatattaaattttataggaaaaattgcaaaaaaccaccccaaatatcactctaagtttgatatgcccccctataaggagatttgttgcaaattcccacctcctaattcactctaagtgggactaggttgatttcgccatgagattctccaggaatcacgcacgtgtggagagaaggtgtctaaatcaaaccaaggtgaattagaaggtggggatttgcacaaatcttcttatgagggggcatcttaaactcagagtgatatttggggtggtttttacaattttcccaattttatatattggagtttcttttacacataaatgaaaaatacttgggggttttctggctccacaatgtggtgggctagtcggtatgggttcgaagcctcacctcttctatttatttaatattagttcattatataatattcgcgtttcttttacacattaagagtattctcttttattttttgagcacgtgccaaatagggtgcacgtatgtgtaatgtgcgagcacgtgccaaatagggtacacgcatgtgtagtgtgcggtccggaaaggctatcgtgcaaaagtttgcgtgcggcttagacactttatacaccatgttctttcctttaatttttttttggcaccgtacaggttctatttttaagtaaactagaaaaaatatccatgtgttgcaacgggtgaaggttatcttattatcgttatatggtttaattaaggtgaaattcacttgagaattcgcttggatatatatttttctaaaaaaaccatgagctgtaagtaggagtccgatcatctcaagttaatatgcgaattttttatttaaatttcttatacgactccttctgcatttccaaaaacgaacgaacttaaaacccgactcaaatacggatctgtatttcgaaaaccaactcatacacggataacgtaccaaagtgccggcaaaaacatcttcaatttttaaaatagtagagatttataacagaagtttatatgtttgatttggattcaaatatttttttatattaaaagtttgtacatacacataaaaaatttctgaaatagctttttttgttaggctagatgcatgtgagccgggccaaaagtgttcgtgcttgaacattcatccattaggcacacccgtccatacgtggctttcatttaattggcaataaatgggtagataatactccatctgtcccataatgaaaccattttgagatagacacggatataacgaaagtagatagaaatgattggacgagggttatgattaaaggagaagagaatggttgtgattggttaagagaaaaaggtaggtgaagaaataactttattttggtacacgttactttgctaaaaatagagatagtagcatttagcatggacaattccctttcttgagatggcttgaatagaagattcatccaatatctctacaatcttaaaagctaaatcatcctcctttatcctccaaccgagcgcaccacctcccataaccacccgatcaatgttttatgttaaattaccttataacctatatctatttatatgggcatggtccattacaccgaaggcaaccaccagatcaatgttttatctcaaatcaccctatagtccattcctacttctgtggttatgacccgttacaacgtacatttaagtataaagaagagaagtttcctgtctaataatttcatgaaacattacttctctctctctctcaattacattcatttatttttctgtcagttatacattcatttttccttaattgtacatcacgatacaaattactgcaaaagaaacccaactattaaatccaactattaaatccacaagtaatcatagaaagcgtcaggcaggcaggcagtcagtcaatatactcacaagtggccaacgaaaaaaatatatataaactcctagtatataaacttcagaggagtagaaaaaaaagtttaattggatcatgctattgcaaatatgcatattcagataaataacattacaattcgcatattcataccgtgtcattgaaattttacaataatagaaacatgccaccactgtcacgtttccatccatctctttcttgttttccgttttctcccgtcttcttccatccatctccttcgttttgttccttctctcttccatcttcttcccatccgtccactccgacgcgccactggagcgggttcgacgcaggctggtggctcggcgcggcacctggcctggcggcggccaaatcgggcgatgcggtggccaaatccggcggcgtggcacgtcacgcccgctgcgccgccaccacgaacgcctcgacgcggcgacgatgcagtcggcggagaacctcgtgctagggcagggcggcacggtcgccgccatgtagtccctgctcacctgctgcaggctgcagctcattggcctcacatcggaagccagcatgaagtaccatgtctggctgggcaatcgaccgatcaaatccacgaggtaacacgccgtcttgttgatgtttgtctgggtgacaaactaggagccgccacacacgaagtcattccgacgccgagcgccgaccaggctgcagcaccgcgccgccacttgccccgaagcagcaccaaggccgcagcgcgccaaggtgccgcccgctatgcatgcgtcacaccgtcgcacgtcctcgctgagccgccatcattgcgccgccgagccgctgggttgcggcgcaccgccccacggtgactggcaccatcacataagaaaaagaaaacgaaaaaaaaaaaagaaaaaacggcgagcagcaccggatgcccgagctgcgtcgccgttgcacgcgccgtgccccggccgccgctcgccaagtccgtgtcgaaaccgcgttgagtccgccgcccgccgtgcttgcgccggacaccacaccaccgtgcgctcgccgtcagccgcagcgctgccttgtgccggccgccacgccgccgtgcgctggccaccaaccgcgcatggcaggaggaagaatcaacgcactggccacggtggcgttggtgcccctgaacctccaccagacatcatccacagccgccaataggtggatcgatccccccggaagaaatcggtagctcaatggaaaaagaccggaaaaaaagaggaagaaacggaaaaaaagaggaagatggatggaagcctaacagcaatggtacaattctaattttataaaattacaatggcatagttacgaattgacgaattgtaatgacatttatctaaatatgcatatttgtaatggcatagatccaattaaccctagaaaaacgtggggtctccctagagatggcaatggggacccataacccgagacccgacgggtttttactccattaggagctaatcgtgttctaactcttatacccatggatctactaacgggtgaaaactcttacccattagatacatggatataggtatgttctttacccacccgtacccaccaacccgtgggtaaaaaaaaacctgttgattgagcctaaaacagagccatataggtctcaacgactactaaatcatagcataaaactcttttcacaccttaagcattgttctagactagttatataaaattattagttgatttcttgattatgtaatgtagttgtataattttttactcgcctttgaacactaatattaatagcattgttgctagagaaaatattaatggtttacaactctaatatagctaattagagtacaaaactataaatactacaagtcaattatatgggtatgggtgcccgttggatacccgttatccgcatgggtgtgggtatggggacgattttgtacccgcgacgggtgtgggtatttaagtggaaatattttgatatcatgcgtgtgggtatggggcaaaggaacccgatggatatgcacccgttgccatctctctcccccactgtttttcggtcaaaaaaaaattaaccctagaaaaaaagacccctatcactcacttccgttgatctcgagaattttcagtatatatgctatctgattcgtagcactttcagcttttgccactcaattcgtaacaccttcagaatatgccaccagagacgcgaattgtttcactccgtgacactccctccatccgacgtcgcatccgtcagtcggtccgtgccgtgccgtcgttcgtccatcgggcagggagcagctcgctcgtcggtccttcccgcgcgagccaccagccggcgaggtcctcccagcgctcgccgccgaccggcaatgacttgcgcgtgtatcttgctaccgtcgagcgcctccggccgccgaggtcctccatgcgcacacatctgcccgccatcagcagtcgatgtcttcccagcatacgcatccggccgccgtcgagaaccgccagctaccgacgtcctcccgattggcacattggggcgttcggccgtcatcgacgagctgctcctcgcgcacggcgtcggccggcgaggtcccccgcacgcagctcgctggccgacgaggtccagccgccgccggtcgcttctccaatggcctcaacatcccggacatcaccagcgagcatgcacacattacttcatgtcgttcatcggttcacggggtattcttgtttgtgagtatgctgttcttgctcgtgtccatgggcagaggttgtacgacatggggacgaggagggtgctggtgacagggacagggccgttgggtgcacgctgcgtggccggaacggcgagtgcgtgtcgcaggagatgaacgctcgcgtcggcagtgcgggaactccaactccttccgcgtccactagcttcgactgcagccggcgacgcgtgcaggaaggacctcatcggctggcggctcgcgcagggaggacagacgagctgctccccgcccaatggacgaacgacggcacgggcacggacagattgacggatgtggcgttggatggatggagtggcacggaatgaaacaattcacgtcctcgatgacatattctaaaagtgtgacgaattgaggggcaaaatctgaaagtgcgacgaattgaatggcatatattgaaaaattatccttgatctcgaggacttcacttcctagcatgacacgtgtccaattcgaccacagtagactactcactctgtcactcacctcacctctgcctctgctcttcctctaagaacctaacgacacccactgcccaccccggtggctcgccggcgccggccgctgcggatcacgctctagccccagatctgctcggaggtagcatctgttcagcatttgcgtcccattgccccgagttctcctctttattgggtaggttggtttatgccaggttgtgcgtgcgtgttaggtttttttggatcggaggtttggttttgcgttctgggggttagtgtgttcttcgcgaggatatggccagcgatttgatcgtgcagacctcttaatttaggtgctttaggaggctagggtagtagacatcgagtaggatcgaaatatttcccctctttctttttcggcaatttttttaaagatttttatgaatgtatatatgccacttcaaaatatggttgtttggaaagatgccatccagtttttttttcaaaacatttcaaaatggatcccttttgttttgaaggaactgtatgtcatttttccaaattgccattttctgaagtgaataagactacacgagtatatccaaatgtgctttcttttttttcccagagtattcataattttgccatatatattttttctgttaataaaaatgctcttttgtatgcatgcagggcctgatgcactgaaagttcttctcacattttatagatcttgataacatgataggtagagcatgttaatgccattctggaacaagtatatgtgaagggtttcttggtcaaatttctggaatactttgatggaatgcaacagagaggaggccttcagtgccagagaaattgctgtaaagaagctggaaaatagagactttgtcggtgcccgcaagatcgcgattaaagctcaaaggctttttcctgagcttgagaacatctcccagctgttaactgtctgtgaagttctttcttcagctgaggcaaagatatctggagagttggattggtatggtgttcttcaggtggataaaatggcagacgaaacagtaataagaaagcagtacaacatactttcgtatcggcttcatcctgataataatactctgtttggtgccgaagcagcattcagatttgtttcagaagctcatgcagtattgagtgatcatgcgaagaggtctctgtatgacaccgaaaggcagcgtgcttcaagagaagtggccaaggaggctacacaaccaccaaacaagactgaagcaaacataaacaatttggctggatccatgccaccatctgcttctgtgcttgtattctggacagctagctgggtggcccgcgcaattacgcggctagcacccatacaaaattatctattttttaatatggttttacttaaaatttattaaatagctatctcattgtcttaagattttaaaagacaaaaccttatcatcctcgtgcttctaattttatagtttttaagtcatatcagctgctacaccttactttgtcacgccttttttatgtg

SEQ ID NO: 3422 - DNA, 1754 bp, Oryza sativa
ttttatttatggtctttgagattttaaaaattgaacaaaattatcgtttgggtttattttttttactttctagaagtcccgccaaaccgtcagcggttgtgccattgtactcctctacagcttgctcgctgcctcccctcgttattgtcattgagattttaacatcagacatgattatcattgaggtttattttttactttttagaagtcccgccaaccgccgcgaacatgttgcttaatggcatgtccgccgtctctcattttaatcatcatcgagattctatttagggttttgttaatatttttagatgtctcatcaacagtcaacactcaactcaactgctttacaggtctgatcgaactgtcagcggcttcgctattatactcctctacgacccgtctgctgcctctcttctttaattttttttttcagattttattatctgaacatgattgttattagggtttattttttttactttctagaagtcccaccaaccgtcgtgaccatgctgcttaacggcatgctcatcgttcctcgtcttaatcattattgggattctatttaaagttttgtgtatagttcttagatgtcccatcaatcaccagttcaccaccactctacttatttacaggcatattatcttccctctttattgttatttccatcgttgtttagagatggacttcttttttaaaaaaaattccatatttttttattccgatcttagttctttgtcatgctttatttgcttgctcaatctaccactacttttattcttcttggaacctttaaaaatttgaccacgtggtttttagtgtttctcgttgagttttgtttttataatttttaggagaccctcaactggcgccgccatactcctttacggttagcccattgcccttactatttattatcattaagattttaaaaatcgaacctgccattaccctattcctttgccacccctccacttgccctcttaaaaatataatatgattactgggatcaaatcatatataaattacgtgacttgtgatttacgatgcgtcactgtgtataaatacttcttaaatgaaaatagctattttgagtattattttacatggacccttcttttaatgtatttactcctaattttgacgatttataatttgtataaagagtagtacagtcctgaacttctgaacgtatctaagctagttttaatttatttttattatgatttttttgatttagaattcgtatttaaatttagtttaatcccgcattgtgtttcatttgtttttaatctgtacggtacgtacttggcggtagtaatggcggcaataatcactttacataagtgatgtatatacttacgttaatttgaagcgctgctagggtacataaaaagaagtgcttctctgaagaaaagaaaaggctgagttgcctcaatcggacaataagtcctattcaaattaagctgccttggttaggagtccgatccaagtcagatcgtatatatttctatgtttgatttttataattttattttatttttttatttcaaattttatttaatcttatattgggtttttatatagactcttcttccaatattgcttaatttttaattacgaatttcagttatttttaaattatatttctatatagattcttcttttcttttttattatttactagaaaaaatacccgtgcgttgctacggaaaacttaaaatttaggataaaccttttagaaaatattcttt

SEQ ID NO: 3423 - DNA, 5237 bp, Oryza sativa
agtatctcttatttaatttaaatttccatataaatgattgtattttatatacaactctctcaatcaatctacaccactataatatagatctactatgatctaacggtctatttttttcttcttttctccgattaatgtgggaatttctagcccccacagcgaacgtagtgcctttttctcaaagctgttttaataatataatagaataatagatagatatatagatagatagatagatagatagatagatagatagatagatagatatgtccgcattgtcagaagcaatctctgtactaccaacggaactttttggcccgctgcaatgattgtggtaagttctttgcaatcaaactgcgtgagcagtctgtgccctcaagaatcctatcaactgctgcaaaaaggtctcagctttcaccgtcagaaatgttctcatttcaacgaagtagtgtccccaatcagcatggtaatcagcatcaacaaggtaaatgcttggtgacaagaagcgaggccattcaattttcagcaatgaagcaaactaaatctcacatctgctcttctgacaatgataagcctggaactttggtaccaaagagttctgatctaaactccatctctgttaagaatttgactagagaaagtgcacctgcagaggaaaatgctgcagaatcatccagttttcagatattgggtaagagaaagctctatgttacctctgacagcagccatggtatgaactccaatattaagaggcaaaggaagtatatttgtccatccgattctgattcgagtaatgagcagatatgtaatgatgatgttgctgttcctgataatcaatctactggacagaatgttcccatcgaagtggacagtgaagaggaaggaaatgcaagacatggaggcaaccaacaaacttgtcagaaaaatgttaatgatactgctgctcagaagtatctcaattcagtgattgcctacccttatccagactttgattttggcaaatccagagatactgaagaaactgatgaatccataaaacagtatggctgggctggtgacatggaaggtaaaggcctggtgacaagaagtgacagagttcaattttcagaaattagccaagctaaatctcatgtgcctcctgctgacaatgatatgcccggaactttggtaccaaggagtcctgatccaaactccatcgctgtgcagaatttgactggagaaagtgtatcagcagggacaaatgctccaggatcatccagtcttcagatattgggtcggagaaagctctgtgatagctctgacagcagccgtgctatgaactctaatattgagaggaaaaggaagtataattctccatctgatgctgattggagtaatgagcaaatatgtaatgatgatgttgctgttactgagaatcaatttgccaaacaacatgtccccatcgaagtggacagtgaagaggaaggaaatgaaaaacatggagacaatcaacaaagtcataggaaagatgatactgatacttcttctcagaattctgccaatccttttttttttgggaatacgcttctagcgtatttttgcatttagaggagtaaaacagccatttacaaccaaaggcaaaagcagcaggggacaggggaaccggacaagagaaaacacacccggccacgtgcctacacaccaccacaccgagaggaacacacggccacctccaaaacgatgccttcaagaaggtcacgacattcaaaacgccgccatcgcccatcccgaaaggatgaggttttcacctagaggatccttgaagagggggagggaggcacctcaacaacgccctcaagagggttgcaacgcccaaagacgtcgccgttgctgcccaagaattgggccggctttcgcctagcacctaccaatgcccctcttgccactacctcactgactcccaagcaatgccaacacgtggcctctacagcaacgacgcccctccgtcggctggactccaagcgacctgattctgccaatcctgtgattgcctactcttctccagacttctttaattttgacaagtccagagatgtctcccaaattgcggttgatcagatctgggcagtctatgatggccatgattgcatgccaagagcttatgcccggataaatcatgtcgatccttccaacctcaaagtgcagttcacttggctggtgcacaacacagtaaatgaacaaaattccaaatcgaccaatgaaaaactgccatttgcttgtgggaacttctgcttaggagaaacagatgtattgcacaatccatcgaggtacttatcccacagtgtttcgtcgacaggcaaaaatggtaactcgtgtgatataaatcctaacaatggtgaggggtggccgtgtgggctctttataaaggatggagcatgcagtttgttgagttgtgatccaaattcatttgcacttaataaaggccagcttctgccgtagtggagcggaggcccgtcgccgggaggcttgggccggagcgtagcggatagatatcaatcatatgggtatgatattgtgcaagtcctttccagtggctcaatggatgatggtgtcacggtttcaccgctggtcagaattgcaggggttgtcagtctatttgcgaaagcgaagaacgagtcatgtttttcgatatcatcatgtgaggtacttcgtttttctcacagtatccccttctataggacgaatggaaatgaaagggtaggtgttgcagaagggttcctggaactagacactgcagctcttccaagtgacttggattcggcatttacttccattactcttgaatcctacatggctcttgacaagaaaacaaatatcgaattaatctgttatgcatgccctgattcagaattctacaacatcgaacaagaccgctcgcatgataagtttgaagctggccagatttgggctctttacagtgatgctgataaattccccaacatctatggttgggtaagcaaagtttttttttgccgggtcggccgaaaggttcggtcgaccaatttcactaagaaaagaagggtacattacaattaaagagcttacaacgacagtatgctgtcgaaaacagattggggcaaaagccctgacccggtaagctagaaaacttctacaaattacaatgcatattacgtgatctcgctattgcacgttgtgaacactcctgccgtcttccagacaatggcctcttccttgatatcttgcacaagctgttccatgcttcgaaatttctgttcaaagacacgcgcattgcgttctttccacagcagccaacatgttagcgcgaaaacactgtcgaagatgctcctgtagcccgtccgaaaagccatcctcgccttcatccaccaatctgccagggctggttcgttctctgtaggcaagaggaaattgattccaatccatccctgcatcatcctccatactctcctggtgaaagcgcacgttacgaacagatgtaggcagtcctctgcttcactctgacaaagggagcagcaatcttcatgctgccatcctctcttgcccaggttgtcagctgttaggcagcgacctttggcagccaaccataggaagaagcgcactcgggatggagctttgatgtgccaaataagttcgctgaaagggcaaatctctcttgccatgaagaaaaggctataggctgaagatacagtgaaaagtccgtcagaggaaagcttccagcgaatggtgtcttcttctagatttagctcgacagtgtgtacttcatcccagagctggaagaattgtgccatggcttcattggagagtgcaccttgcagatctctgacccatctgttgttggttaaagcttgtgccactgtcagctgtgagcggccaacataagtggacaataccggccatcgccaagcaatgcttccaccatttagccaattggctgtccaaaactttgtgtctttgccgtttccaacacagaattcagcagctgagttaaagattttctccacgtcttctccaagtttatatcctgacttggcccacggtcgatttttttgctcaagacttttggctaaccattttagtcttagcgcttgaccaaaggcgtcgagatttcgaattcccaatcccccattctgtactggcgcacaaacatttttccaggccactagacagtgtcctccacttacatcctcttgtcccttccataagaatcctctgcatttgcgttcaatttcttcaccgcccatttcggcatttgcagcgctgataggaagtgcacaggtaatgccatcagaacactcttgattaagcaaagtcgaccatcaggtgacagtaattttggcttccaacctgcaaccttgcctgctaacttgtctaggactggttgtagctctgccttggttggttttctcatagatagtggcagtcccaggtagataatgggaaattcctcgactttacatgggagcagttcagagaccatatctaattgttgttggttgcagtgtataggcgtgatggagctcttcaggaggttgactttcagacctgatgctgctccaaacaggtctaggactgctttgatcagtagcacttctttcctctgaggcttgacgaaaagcattgcatcatcggcataagctgaaatgtttggcagacgttttctggtgttcagttctgaaagtattccttgcctctttgcctgtaaaagagttgcttgaagtgtgtccatgaccaagacgaagagaagaggcgacagaggatctccttgccacagtccccttgctggtttgattgcccttgagtcatccccatttattgtaatgcttgtttgtgctgtcaagaaaagtgcagcaagccaagacctccagcgcgggccaaaccctctgtatttcagcatgttcagcagaaagctccatgaaaccatatcaaaagccttcgagatgtcaagcttcaggagtaaaacttcctttttttgccggtggaactgttgagccatacctttgacaaatatgaaattttcatgtatggatctgcctttgatgaatgccgtttgtgtgtggggtaccagatcatccaaccttgtgccagccgccgtgccattacttttgttgccaatttggagaagctatgaatgagactaattggcccatagtccttcaacatggttggcgcttctttcttcggaatgagtgtgatttgtgctgaattcaacaattcaagat

SEQ ID NO: 3424 - DNA, 5270 bp, Oryza sativa
atatagattaatcattcaaagataaaactagggtgataagacttcgtaagagaagaaaaggaggaacataatttggaccatagatcaatcatctaagagctagaaagaattgaggtgatgtggcttaatgagaggagagaaatagcattaactacacttagtggggataaactttatagatatataggataagggatgcatgtcaaaagtctcaaagtgagagtacaaccatgaattatggtggtcctgtgcacaagcaattatcataaaagatggcccaatcaatttggataataaataagaaacaaaacaggcaagcttttggtgggcaataccaatatgtgacaccatgactctccagatttataacaggagatgcacagcatttggaattggatctcgccaagttaaaaaactatttgcattggtgtacttatgccttttaggaattaagatcatgcatcaagaaagcgaacaactcatcagatccacagagtatctgcatgttgggttgtcaacttgtcatataactttgggatgggcaatctatttgagttttgagagcaaccaacaccaaggtcaagctcaaatcattgtgcacacagccacacactcaaggttggtcaagttaagatcaattaggctcgagagaacatacatatataatactacctccgtcccataatagttgtcgctttaactttttccttgcaacatttgaccattcgttttatttgaaaaaattagtgcaaatataaaaaaggataagtcatacttaaagtacttttgatataaagcaaatcacaaaggaaataaataataattccaaaattttttgaataagacaaatgatcaaacattataaaggaaaactcaaagcgacaagtaatatgggacggaggtagtatagtatagcataatagcatactacgttaaccataaatagttttaaatgaagatgttaagttgttaacatgtttacagcaatcattagtcattttcataatttctaagtatttcatttttttcccaattgcgttgtatgttctccaaatgtaaaaataaaatcaagcctccaagggtgtcattttgcacagcaggtcttgcattcacatgacaacataaataatagaggtaaatggatggagaatataaatggcaaggttatggcagtcccaaccttaaccatggtatctctcatatagtcgtactcaaaacgcttcagttgaagttgcaaaactggggggaaatcaaggaacagaacaccctttttcgcatcctgagacaatatcaaaaaaacatattcaagaattggcaccaaaaccaataaaaatgggcttcatttataaaatatagatggagcaagctgttatagtatatgggatgcagattccctttatcttcatagatacataaaagtccacaagttatatcaaacctttatgaaacaaccaactctagcttcagtttcaaagcttaaagtgagaactgagaagaacatgtgggtacctgtaaaccatgattctctgcatgatacttattatcaccttcgaggcgctcaacttcaacatatttatcaaacgatgcatacacatcacgacaacctttaacatcaagttgaaggtctgcatggccataatacagcattaacttgacaataaataatgaaacacatctaatgtgaacccacaatctggtaccaggacaaaacctaccataaaaggactccttcctgttggatttatagtcaacatttatacactctatataattgatgtggtgaccttcgaataacttttcatcgttccctctacgacagttctctaggaagaaagcaaagttaatagcagccaacatgcagcatatatacagctctataccagatttgtcaccttcatcttatcttcaagtttctcacagagaactctgttgagctcttgtacatcatgttgcatgaaggaatcatatgtgtcccatccaaaagatttggtcagctctttggtggctacactattgtcactatactggagcttgtagaaaaggctctgcaatgccaacggaatactcccagatggcatatcattttcggtggttggcatatgatacacagcctgggtaaaataatgaagttagtcaattagttctggaaacaatagtctagaatgctctgaattatgatgcatgatctcacaccttcctgaagtatggtatatggtatagtgtctgtagtagagagttcatgtaacaggtagctccttggttcttcaggccaacgtaacctgtttctttttttgaatcatatgtccaataatcaaccattttgcggacagcaacctcagcctccacaacaacagtatcatcgacaaggtatcctctacttggatcatagagctcactcaaaggcataaaagatgtgaaaccccaatcactctcacgtgcattaaattgatgctgagtatctgccagacagagaatcacaggtccatcagtgatagatttatcccatacaaatcactgaaatccgcagaccaacgtaaagtagatctactcagcatcatttgatcaagtagcagtatgcctccttaactagctaagagaactcaaaataccaaagaaaacaatgaggcctagcatttgcaagcatggggccacacaactccgagatcatctaatgactattataaggaatgaagcaaaagtatatacaggaagtaaaagtggccttataaaacagaaaagcctaaagaagcaaagcacaaatacaaatataacactcttgagtctgagaggagtttcatgttcaagaaatataaagaacctctttttctacactaggggaacctggccttggagaagtgagagctcttgcaaatagaaatgtcaatcatggtcattgccaatctgagcttggataaaagacccaaactgcgaaggagaagagtacagtagaaccttcagctgtctagcgggtccatttaaacaaccatatccttttgtggttcatcatgatataatgatgtgtaagtgtaacagaggaacaatttgattcaaccaaatcattgaacagaaaactatagtgtacccatcaggatattccgtgcaagcatgccaacaagaccaaacaaggtgctcgataacgcaagatcataaaggttgacaagcaaatagaaccattttcaaacatatggcatccatttacttgatgaaagcacgacctctgacctcaagaggagcaagtttttgaatactacgccgtgataacagtttgacaactagtgaaacatagcaaagtatagcatcatcatactctcaagcttatcatgtattgcttttgcattttaagtgtattcacgtaaggagttgtaaacatcatgatggaggaccataacctttgcgtatcgtatacttctgttggatctggttgacaacggccaagctaaactgagcatatcggctccaaccatatgggaggttagcagagtcggcaacatccaagtacatggagaaatggtccacgttgttccccttagggaaaatgagcacacgcctgcatgaaagcccgccaaacattactatcatccaaacattcaaaaagaaaactaactccattaactaccctttttatgagaccaggagctcaccatttgtacccgccaacgacaaacgcatccgagtagtgcttcttcgcattgatccgggtgaagttctcgatcgtccacgtgaaccgcgacgtctgcgggtcctcagctggctggctctccgccgtgctagctgcctccgtttgcgcaaccactgctaccacaaaccacgagcatatattactaccaacccacaaacactcccaacaccacacattacaaaaccacgctgtacaaatcacacggaagcaaaggaaagcagcacagtgaacccccatagagagcaatcaacatggcaccttccatgggctgggcggcgtcagcagcgacgagctcctggtgaggcacgagcatctcgtcctcctccggctgcgcaaagaacatatcgacaaaaagaaaaaaacggaaaggggggtcagatccagcgcggaggcataaaccctagcaaaaaagcggcaccacccgatcggacgcccaccgcacgggccaccggagaacggtgcagccctagcgagggagatcgggcgggtagacaggagaggggagagctctctctctctctctctctatctctctcgcgcgcgcgcggagaggcggttgcttacctcgagcgggggaggcgtcatcatagtcatggagaggggcgcctgcaggtcgtcggcgtcggtgagagcggtggcgtacggcctccgcggcggcggcggcggcggcggcggcggagaggagagcagcgggtggaggtggaagcagcgagtcgggggcggaggagaagggaggggggagtgcgacgaggaatggaggagtttgggagttttggaaggttgggggtggtttggggatttcgtgtgccgcaggctcgcagcgcaggtagcgagaaagagagagagagagagagagagagagagatcgagggaagcagaaatctcgttccttttccttgccggttgccgttttactctgcccctcgaatttcgatgtgattttatttttttattaatgatgaaagttttattaagctcagtaaatttaatcgtcaccgtacaattatcgtatttcgcataaccaactcacatatgttctaatgaaaaaacaaaatggattacaatgagaattttggtgagattttatgtttggacaagatgcttttcttagttggttttccttaccttttcctatagcacgtaagctcaaatcgtgagggcaggtttgaaacataggatagtaaaatataaagaaattaaaagtgtcaaagtttttctgatgctataagagtataaaacatagacgagaaggaaaaggaaccacggattgattatgaagatacttttacaaattattgtttttgtttcgggaaaaaatgtgttaatgagtttttgtaggatacacttcaagctcgaaataatctttctaactcccataagagttgaaataaaattgtatagatcatgaatcggaaaaccttaacccataataaaaatgtactaagttctttctttgacttaccgtttaaggtcgtctttgaaagcaaatcacctacatacaatttaaatagccaaactagcatatccatcaagcttgctaaggcattcacagtgcgtcatccctattcgaaaaaccttagagtgccacgta

SEQ ID NO: 3425 - DNA, 13223 bp, Oryza sativa
  unsure (1)..(13223): unsure at all n locations
attcctgcagccccccctgaccagcagccctccttccttggcagcctccgcgtgcaccacccctcagtggtgggagactccaagcgggagatggtgaggtcggcggcgcaaagtgtgggggatggcaggggctcggcagcaacgttggggatggtaggagcttggcagcgcaggagcgtcggctcccccctctgcttccacagctggcgttcctcctatgtcatgacttcctctctcctctcctttcttcacgtcacggcggcagtcaagaggccgggaccgtggcagcgaaggaggccaagtcagggtggagccactgagctctccggcatcttcctcgcgccctggctagcttggtcacctcagcgcgaagtggacgacgggacgacgactttgccgagtcggggatgacgacgagctcgatggcgcatgacggggatgacgccggattgagcttctcttccctccccttcatggtgaatcaagcttctcttatcttccctccccgacgaagagcttatccacttctccattctgcaggggtcgcaggggcggtgagggcatctccttccttctccactttttgccttttaggtttcagcgccaagctctgacctccacagtgcggtttcgtgcctctccccatgcgcccgcacgccatcaatcaactcggagaacgagtgatcaatttgggctctgcattgttcactagggggcacgcgaggcggacgtggcaacgaatattcgtagtggatggtcaggcccaacgacacgtgtgtattgtgaatggccttaagctatgtttttaagtccattttcctaactttacccctcgtttttcgcgcgcacgcttcccgaactactaaacaactagttaggtgcccatgccgtggcacgggaaaaaaaatgctgtgatagctaacctaataaggacaacaaatgagaggctcacttcaatttcttgagtgttaatgagggccccaaggacaaaaataccaagtgaaggcagagaccagtacacatagttcaatttatctttgcttcctattcttattactgtaaaaaatttaccgtcagtaacatgaaaaaacagtagctatatgtggtgcagggcaattacaccgtgtgcaccaaactatcaagacaaagatatatatagcttgatgtactggttctgaagttcttaaatctccacaattgtggttccattgtccatgtaaatatcattaaataaaaatggactaatatacaaatttcagaagattgataaatcatctaaacatttgttccctacaaaagtgcttttcatcatcatattcatatggtacttgactatatgttgaaagacatccacatttagaagtgctctttaccacagttttgaggtcttctcttccctaatctataaaattacaaaaacgtctggcatcatctatcctcttgtctcttcaaaattgatcggattagtggcctcttaacacaaccatagctacaccgccgacatgaacaataatacatatatttatctaaaattgatcccagaagtaaactgcaataattttagtagagctcagtttacaaaacaaacaccgatgatatagccaagagtcaggagaagaacatatatcatttaggtgagataagaatgacaaaactgcgtattactctgtacaagtagagattgtattctctgcaaccttttcccttcacccaactcaggaaaaatttgtaaattgtcaaattttgctgaaagttttttctggtttgaagaaagaagaaaaaagagcatgaatgtctgatatacctgctgagttactgcagttcttctactgacagaactttgtcaaacaagaaaaaagatctccttccaacgcctcctcaaaattaaaagggactttctagtggccagttgatgattccctgaccatagtcacttgaatgatagcaaatgtgaaaaataaaaggatcaggttgaaacccctctacaaaattacgagagtgagcatctatgtagcatgaaaatagatgcagataaatcaagaagtacaaacctcattatttccaattccttgcgagcattaggaaatatgagcaaaccaatcgatatgttgcacatccccaccattaatgaaacacaatgctgaaaaaaattgcatttagaaacaataaagataaatatgcactgcacatttccaggtcattgtggagcagaaacaaatccataacaaatcagcaagaggaacataccagcatccagcaacaacaaaaacaagagccagggaggacgttgacaccaggctcttctttctgccggtgacgaccgcagcgatgggggtggaggcatcgtgagggacaggtggtcctggcgacccgcggcagccagcagcggagggcgaggaatttattttattcacttacatctaatccacgatacaattttccttttctcttacattataactttgtgtgtaagcttgttgatgtataaactttatgcacatggactttttaccgtagaaactttgtgcacaataactttatagctatgcacatgaagtcttcatgtccccatcccgtcataacaaaacaaatgaattctaaaataaagaaaagcttaaatatgttttagttgaagctcgaacaagaaacaaaacaacgttcttctggccaacgaagttgcctccattgaagagacgatttaaaagtaccaataaggaaaacagaacaaagcattttaacctgagcggtcgttaagccaaatctcatgtctaagtaaagaacaagagcaaatggcaaatccaccaagagaaaacttaaaaaacttgcaatttgaaaacttaatatttgaatacctgagtcatgtattgttaacagatttgaaaacctgagattttcaatcaagcaaatgtctttaattatctaaaactggatatttaaatatctttagccaattctcaatgagcactattgaccatatcacagaaactgaaccggacagcagaagtggatataccacttcagcatacatggcctaaacagactatgttttctaatttttcatctcagataattaatgattattgctcagaaataaaaataatttccactgtatataccacgaaatggacctgaatagctagtaggatataaaatgtcaagctcaaatttataattgaaatttgttgccgttgttgtggttgtggtggtgctaaagaagtcagtacaacctcaactcaacagagcctagtagctgaggtttcctttcaatatggataaaaggaatatgcaaaagatattattttgaagaatatgcacaaataaggttttgaaggaaaggtagtaagttctgcatctcaaggctaacgtagaaatgaagcacatcaatagaactgattcagtattagaggaaaaggatcatatttaatcatctcgtgacaggagttcattttgttagcaaacctctgcatctcaggctaaaaaggaaatgaagcacatgaattgaacttcagattcaggaaagggaatttagccatcttatgacaagagtttatttacttcaacggtatggaatattcaaaattttatcgttctaacaattaaacatataatgagatttatatatggttcacacaaaaacgatgaactaatgtacgctagcacaacagggaacgggaaaaatgcacaaacatggtactgcactaataatcttacctgttcctccgtcgccgctgtccaggcagcgagggaagcgtcgaggatgtagggaggtggcagggcggcgtcagaggtcgaagggcagggtggcagcatcgacggggctggggcagtttgtttcggggataagacagacttcacgactccggcgagataacgcccttaatgaggaatgatcgatggccgcagattaggaacggattccagggcaagcaataacagaggatcgatggcggcgtcggtggcacttgcggtgggcggggcacgggccggagggaagggaggaagctcatggtggaggacagcaagggcggcggcaaggacgccctttcttgcggcggcgcaagtgatttggaaggggagggggcagtgaggggaatcgacggtggctcggcatcaaagggggaggagcggttactttgtgcaagcgtggatggaggcgcggggcttaggaaagttgctttaaaattaatattaatctatttttaagttttttaagctaatacttaattaatcaagcgataataggtcgctccattttgtgttcccagataaaaagaagtttccaaccataacaatatgtgccatttcagtagccaaaccaataacaatcaagaagcgtgttgttttagccaaatatcgatcaatgtttgcctgtactgcccattgtgtccctagtaacgtcagtctaaaattaagtgcccacttgtctgaattgggattaaataccaagctcgacgaccatatcatgtttttagtcctaagagaaatacatacgtttaatcttaaatatatcttagtatttgtctatataattacacatatacatatatagacaaacttatattattttactaaatgatgcatcaatattgacatgtaccataatatactccattaacataagcttggatctccccgacacccccccccaacggccatttggcacgttgtcatgaaacattacaattggtggtgtttgaatctcccgaagatgaagataaagattaagtgttttacgcaaaactatgtggtaataacgtgtgattaattgagttttaattattacgaacttgaaaatggattaatctggtattttagtacaactttcatataaaaagttttcgcacgaaacataccgtttagcagtttgaaaaacgtgccataaaaatcttcatcttcatccaactattgttggagaaacgaacaggaccaatgagtaagctcaagattagatgtggactcttgaagcaacttcacagtacattcattgtggtcacatgtgaaaaacatctttggtgtgtaaaaacaaccacgctgatcgatatcatcctgagttaagagatatgcaaggataggaaggaaataattgttcaacaaagggcacaagttcttttagcctattggcaaaaacgaagaagccatggtaaagacaattgctaaggctaacctaatatttaccttttggagaatagccttttaatcctactttcagaggttagttagccctagtttatacataagcctaattttctccctactttatataaggcaatttattttgttggtctattgttgtataatactgtattttttaagagtcataaatttttgtaactatatgcatgtgcaaaaataagtaacttggaaatcacctttacaaaacaaacatgcaagcctactttcgctatgaaatatttataatttaattggatatgagtttaaaagggcacactactaatcatcatcgtggtgttctgaaaattagtaagtactcgacaaattattaaaagaacccattctacctgcaaattttcttcagttcctagtaaagtttatttagtattgacaatatatatatataaagaaaaaccaacatgcaaaaaaggggcgtataaaacatattttcagccaattaaatattatgctagagtggatcaaatttatgaagtgtttttttttcattgtggccaaaagaaaccaactccaagtaatatttgttaatgcaatcatgcttgaaagttgaaactaactctaaaaatatgattagaacttgcgttaattgtaaaacagtcttaatctctcgacgagtttaacgtaaacgaggattaattcatagtcaaagattacatcaccaatttagacatatctaatcatgtatgttttttattcacaatttcttgacattgtatttagttttacaaccttttgctcccttaaaacttgacatgtatggtaaataaaaaaacatcaatgtgtgaaaattcaagtgccatcgatgagctttaacggaggaagccaaactctattgacaatattttagaacaaagagagtagaaattaacatctgaaaaatgctattggtaaatttctcataaaaaaccaacgatacttacaaatatatatagtttggaatagtaataataagatattttgccactttcctgaatctcgttgtgtcaaccttgctgtaccgtcgacgtctaaaacagaaaacgtaaattgagaggggtggaggtagcacaacatttggaccgaacccgacccaccggtgcgaacccgtcccggtcgtagtcgctaggctcgcgcacctcttgcttcagcttcactctggttcacacggggaatattccgctccccccacaaaccacgcgccccctcctcctcgcgccgcctccgcgccccgaatcaaagcacgcgaacgctagggtttgctcttccgctctctcgccgccgccgccgatggcccagcgctggcgctcgagggcgcggcgcgacccggacgtggacgacgaggaaggctcgcccccggagcggcggcgcaggggggctcgaagcggcagcgacgacgaggaggcgggcaacgaggacctcagcctcgagatcgtcgcgcgggcggcgcggcggcggcggcggcgcgaggccagcgccgggttcgcggccgacgccttctcgtccggggacgagatcgacgaggatgccgtggtggagctcggcgaggcggatcccagcagcaggaagcggcgcaaggagaagaagaagcggcgcaaggagaagaggaagcagcggaagggggcgccgcccgagggctcgccctcgaccgccgccgccgacaaggaggttcacgtgggcctttctttcccctgatattgcttgtgctctatctctgcatttagttcaccatcccatgccagaattgagttggattcttttattttgagactagaattgagttggattgtgagctgtacgtggactgattaactaactattctgttggatcttggagttcatatctaccgcctctctgcgaatgcagccgtagtgattgttagtaagcattcgatatattacgcccaaggggagcaaacacgtatactgattgatatcggtttatgtaaaatgtttaaaactttaaaaggcaatataaatttttttgttgaaagggtctttcgattctgtagacttcaagtgaaaataatgttttatgttgctgcttcttagaaagtatacgcgtattgaactatttgtgaatttattaatggtatggaaaccttacaaatagataactgattttatgtttgtgagtgagcattggtattcgatgtttctttgttgggaatggattactaacgctaatatgtttcggagttactaatgcgcggatttgttctttcagtctcaagttgctgggacccaggaggggcaaactggcacagcacaatcagtgctcactgaagatgggcctgatgtccctttatctgacaatattgttttacggaagcttcttgtaagtaccaagtgaatttccttgcatatgcacatgtggcacaagataataatactcatgttgcttttcctcatgatccagcgcataccaagatactttgatcctggtgaaactttattggaaacatgctttaattgtggtgaggagggtcatgtagctgtgaactgtccaatggaaaagcggaagaggccttgttttgtttgtgggttgtttggacacaattcaaagcagtgcacgcaggttggtctccctagctccaaggcattattgcttggtgacttgggtatgtatgctcatgcccttgacaagatcatcttatttagttttccattaattacatgatgttgctgcatttgttatttcaactcataagttaacatgcttgccttgtttagataggttccagacttccagttcattaatcacacatatttacttgcccctgccaatgcttcttgcctgtgtggcatggcctgccaatttcaggaatcaaacatttgttaatcatttttgtagggtcaagactgtttcatctgcaaaaaaggaggtcatattgcgaaagactgccctgaaaagcacaataggaatactcaacagtctactttttgtttacgatgtggagaatcaggtcatgatatgtttggatgtgccaatgattatccacgcgatgatgttaaggtcagtattgttttctcatggagggatacttgcctaaggaaaaaaaaatctaactcaacatatctttaaagccacctctcacttttaatatgctgtggctacaatctaaatcctactgttaatgcaaactgtgctgcttcagaatatacctatgaatgaattgtggttttgtcatttacgttgatccagctttatgtgctattcacaagcttggttaggttttgtgagccagcttaattttacattaagccccttccttatccttctgtgttagttgaatacctgaatccacatgttttgtccacttaattaacatgcaatataatgcaagtcattctcttatgtagcacaaaagtcctgtagcagcgagtttgcattaattgaagtcatagtattatccaaacttattttccccctccatctactttgttggtctgtgcaggaaataaaatgctatgtgtgtaatcagaaaggtcatctatgttgcgccgacttctctgatatttgtccaaaagaagttagttgttataattgtgcccaacctggtcatactggtttggtaagtttagtggttattatggcttcctttgtttctatatgttacgtctcacaacagctgatcatggttatggcttcctttgtttctatgtgttacttctcacagcagctgatcaatgtcttctgaaacagggatgtgccaagcaacgtagggaagctagtaccgcggcaactccaactttgtgttacaaatgtggcgaggaaggccacttcgcacgtgggtgcacaaagaacaccaaggttgttagaagcatcttattaattgtctactgataagagttgcttggggtatttatcctgtgtacatcctgtttccctttctgcagtctgatcgtatgaacggtgaatcatctgcatatagtcggaaaaaaggcaaaggcaagaaagattttggcactagatcagctcctcatgatgctcgcaagacaagtaaaaggaaaagccccttatttgaggaaagaaggaactcatctcattttaagtccaaagctaggggtggttggattgcagacgatgcggatgaccagccatacaagaagtgcaaacccaatgtgtgggcttctccatctacccctaagaagcaatacaataaccatcagttctcttctggtggtgactactcaactcctcagtcttcaagatggcagaaacacggtttcgcatcgccgagcgcaacttactcaccaaacacaaggaagcatagcttttcatcgtcgagattcgccagcaacactcatgtccggtttggaagaagctagctggaagctagtttttgacatttttttgccgttctgtttacaaacacaattgatcatcacttgtgcctgcaagggctgtttctgtatcttaaattacacatgtggtgctgtcgtgctgctgctgctcagttccagcttccttgcttcccccttccagctccgagcacgctttccttgtgaaatctcgcggctgtggcgagcagatttattaccagacacttgcatgcgcgcctggtcttttgttatcgttgtgtgcagcctacatgggcaacctactctggagctctttgctgcatcgaatcttacctctcccaacgatggctcgcagtgtaggtatgcatccacaaggcttctcaaaactagcccagtcatcctaccaagtgcactcagtttgggttaaaaaaaatcactgcttccagaactgttaacagtgtgtttactgaaagttctctgcatgttttccatgtttagtaaattaattaattgtgcgctatcaatttttctcgtttctagtgctctggaaatcttgtcgaaatatactccccttcccataaaaaataaatctagtacaggatgtgctacatactagtactgtgaatctgatggccccattatttcgcttatccgtggaataagccaaatgacatatttacaaatgaaaagctacagcctcgtcgagcttgctctatgcagcctcatcgcgtcggagaccgaggagatgtgtgttagtggctgcatcattgagcttgagctctacggcctcctcgcgttggaggccgaggagagacacgccagcggtcatcgaggttggagaggctgggaggagccatgcgcaatgaccgtctacttgaactcgagctctgcagcatcctcgcgtcatccacgaggcgtgcacactactaggaaaacgttttttccgtgctgttgactctgattttcgcgtgcgggtgcatatgtcgcccgcacggaaaaatccggaaattttttttcaaaaatccggtggcggtgccgctcccggccgccgcctcctcgtcgtcgtcgtggtggtggtcggccgaggatgccgctcccgcactcgtcatcgtcggcggcggcctccgcgccgccggcctgagggaaggaagaggaggggaggggagctggatcctgcggggggaaggtggccggccgctggatctgtgctcccgctggcctccgggctcccttccggccgcaccgccgccaatgcccctcccctccgctggatttggggagggaaggaaggggaggggcggggaggggagcaggatctcgcaggtgagagggtggccggccgccggatcggtgcggggacggccgccactgctggatccgtgcgggggttggccgccacccgccggatcccgctcgccatcgttgcgctgccactgccgacgagttccgtcgcggccgccgcgcgtcgtcgttgccgccgccgtcatcgcgcgccgtcgggactcggggaggagaggacaggagatgacgaggaaaatgaggagaggagaaaaagagtagatgagggaagaaaaagatatagagaggagagatgagagagagagaagggcaattttaaagtggataggacggaaagggagggtgggtatttttgcgtgcggctctcttaatagatccgtacgtgaaaatatgcccatttttgcgtgcggtccatttaagaggaccgcacgaaaaaaccaattttttggtgcgatcctcttaaatggnccgcacgcgaaaatgagccctattttctcagacgcgaccagttatgtatggcctatttgcaattacaatgagtcactgtccaggaaaatcttttgtgtagtagtggcatagaggaaggggaggatgtcacctaaaggttctcaagatgacggcgtgaattctcacttcttgtggtaatgaaaagtgaaggtggaggttggctactatctctagtcctagaccatccaattctttgctgtggtgttgcgtcccttcgtgggtgatctagttgagtccatgctgcttgatttttggcgtgtccaccgttgtcacctcgggaccttcgccgttcttagagataggcggcgagagggtgagggaggaaggagggacaaggcggagaagatggtgtagatgtgttgatctggtagcaaattggtagcaaagtacgaagggtggtgtcgagctgacagctgcatcgacggcatcgagctggggctagaggcagattgctcttgtcctccatcttgccattatctcgaatgagggtaggtcagagactcagaggcgaagctcatcgtacttagtggagatgcgctcaatgagggcccgactcttgtcatatctgaaggagtctgaggcatcttcgatggcccctctcattgttggcgggtagaagccttaagcctatagtcacctggtcgcgccacttctaaccttgcctatcctagttgtaaggctcctggacgacgataagttgatgagcgagcatcccactctctcaggaggtagggaggtgcagataacactaatacgtggaacctattattactttaatcatgtaggacgagtaccgccttgaattttgttaggagggtaatttgtctgatttgaaaagtttaggcgtacaaaatgtatgaaagtttatggggcgatttagaccttttctatattcttctatacacacataaatgtgtgaattatgtattttgtaggtgatagctacaccgagttagcgtattaatattaaaattttcaatctctactagctagtggagtcgagcattcacgcaaccatgacctgtatggtatatgagcccatttacattatacactaatcgtacaactaaaataaatttatatcaagttttagctggtccatatgcaacaaagaacacattctgaatgagagtcctgaatagaactgtagcctaaacaatagaggttcatttatgcgtgaaattaaattccagtccaaactataatgttggtatggggtagcctaaacaataaatgttcatttgtgcacgaaattaaattccagtccaaacgataaaaaaaaaaattttcaataaagtcaaaggataacaagttcaatcgggcctaggatatatgcgaaagaaccagctgtcgctcaaaatacacatacagaatctcaagtgctcgctcggctcaggagagggtgtttcactcattggcgttcccggcctcaatatataagatggtgcaatgtttgttcagtaggcgaggtgggactaaaaggagagcttactagctcagtggcttcatcgtatgggcctcgaaactcggcaagcgaaagggccgcagcccatacgtgtggtcttcggctcttcgctgctgcagacgattttgaaattgattggttgtttgaatcttctaatcgcttacgatttgtctcatcgctacgatacgatgccccgccgccgcgaaccctccgcctccgcagccacacgaccgcagcgacggtggcgcaggggctctcccgccgcgccgtgcaacctgccgacggcgtgttccgggaggaggctgccggtgatcgtgccgttccacgggggcgcgttcgcgaggggcgcggccgacagcgacgccatcgtggtttcatcgcgctctgggcatccacggccgcgccgtccccggcgccatcggctgttggccccaccccggctgctgcggcggcggagctcctccgccgggtcgcggcgccc

SEQ ID NO: 3426 - DNA, 4144 bp, Oryza sativa
gggagcgggctcgaggcccgcgtcgacgcggcgaggctggtggagtcgctgctccgggacggcggcgaggatgatgaagtgcggcgggatgggcggcgcggaggcggcggtgtccgtgctgtgggcggtgtgccaccggtacagggaccggcgcgcggcggaggcggcggcggcgtccaagggcgggctgacgaagctgctcctgccgatgcagagcgggtgctcgccggcggcgaggcagatggcctcggagttccttaagatgttcaaggtgaacgccaagagctgcctcgccggccatcctgcaccgagacctcttcaacggcggtggcggcggcggaacgcgtgtgcgggcatggagcacgcgcacggcgaggacacccgagcgccacgccacgccgtgtcgtctcgtctgagcttgctgctgccgtcgccggtctggatgaggcggcggaggcggagacgtgcaccacaagacaagactgggcccccacattactggtgggccctgaccggacaaccagaccaaattccgccacctccgcttccgtcgcttctagaagccgacggttatttatacccccggctctttcttcattcctcgcctcgcctcgcctcgcctcgcctgagccccaagcccccaacctcaatcgcaccggcgaccggagctcgctccacccccaccccgctgccgccggcaagagggtggcgctctgctgcgacgtgcagagtccagctgccgacaacacggccgcgcgctcgctccgggagggcagggaggccaggcaaagaggccaagaacacgctcaaaaatcaagaacgcgtgacatcgatctgcgcatggcgacgccaccgccaccagctgttcaaaagatcaaggtagactaggtgtccataaccttgatataaaaaatagctgcttattaagcaaatgacttttccagttgtttaatggtgaaggcctatggcaagaccttttgcgaaataaatacttaaagggtaaacctctctctggtatgtccagtaagataggtatttctcagttctgggccggtttaatgaaagtcaaagaccaatttcttagatttggttcttttagatgtggcaatgggacaaacataagattttggaaagacacgtggttgggatcgcgtgctttcaaagatcaataccctacattatataatgtggctcgaaaaaagcagtatacagtggcagaggtcatgagcacaacgccgctaaatatctcttttagaagagctattgttggccaaaagctaatcgagtggaacgatttgatcctcaagctagctaatataactctgtcaaatgaaaaggactgctttgtatggtcgctccataagaatggtcaatttttcgtcaaatctatgtatgccgcgatcatgaactgtaatgttcggataaaaagagaattatgtgggacttgaaaattccactaaagatcaaggtctttatgtggtttcttcgtaagaaagtaattctaacaaaagataacctggctaaaaaaaaattgggggggggggagacaaacattgttctttctgctatgcacaagagacaatccatcatcttttctttgagtgtcatgtcgctcagtttgtttggagatgtgttttttttttgcttttaatatctccccaccccgtaacgccaaaaacattttcggtaattggcttagaggggtatctaggtccattaagaagatgattctaattggagctagcgctgtatgttggttaatttggcgttgtcgcaatgataaagtttttaatggtaaacaattatccaaccctatgtatgttatcttcatgtcttcctactggctccacttctggtctacaatgctaccacaggaggagcaggatactatgcacaatggtgttacactcttggaattggtagccaatggtctcttattccactatgggtggcgtagttctataagaattgctagctaaaatattttatgtgtttaacgctagtcaataatcaaggggagttggagatttgtcccatcaccttatttctcattttgatttacttttatcttacctttttattactattaaacttatggctgtgtgtcttatgacagaagccggagatgtaatccatttccattatctcaaaaagttggtagcttgaccaagattcactaattattctcagaaacgacatatcaagattcaaattcagattcaacctcagggctcagggtatagaagaagagagcgaagctatgccatgtcctcgctgatgtggcgtagaagctgtcctcgatggtcaattcacaggttccttaaatttgtcgaagctgtccgaaacgtcaaacagaacagaacggatgtaatataacatatacagtatgtggttgaaggggaagatgacaaaaaggaaaatggcgaggagattttgatcaagcactgtgaagttgttgtgttctctttttgacaggaaggggcttgctgttgctgacatgcgtctcctgggttgccagacaaggaataattcatcgtagtctgctagcttcagtaggatttagcttcaatagttcatccctccatttttgcagaatctgtcaatgtatttcagaacgcgaccacgcttccgtcttctgtcttcacgagatggaatcgtattccgtttgattcagagtcctattccgatccagagtttagatggaattctgttctgacgcaagcactgatgtttggtcggattccctcctgctcggattggggagctataaatatagggggatcaggtcacgttggttccaagattgcgagtttctcttcagaaatcacaacagaactagttcttccaggattgcaagagccaagagccagggttttactgtacaaactctgaactctgaagatttgccaacttttgcaaatccaattctgatccagagtttagacggaaatctgcccatgttctcatttaaccactgaagttggtgagatttcctcgtcctgctcgggttggggagctataaattcagagcgatcaggtcacattgcatcaaacattggagtcttttcttcagaaatcattccagtatagcaagacatccaccaagagccaggctctttttaacaggcaatatgggctgtacaatctccaaagttttcccaagttttgcagagaatttcttgaaaggggccaaggcaggaaattcactggagctgccgcaggatgtgctgatggagatctcggataaaattttttttaaatttttcaaaagtgtccgaggacaaaccaattcaatcgggccaagatgaatcaaggatgcacaataaagaaacccacgtgttcgacgtgctaggctcggctcaggggagggggtttcacgccgtggcaatccctgcctcagtatataagatggtgcaatgtgtgttcagtaagagaggtgggactaaaaggagagcttactagctcagtgactgcctcgtatgggcctcgaaacttggcaagcgaaagggagcccatacgccaccgtggtggccgtcgggtacctgctcaccccggcgctgaggtgcaacgcatgtaaaataataggaaaaagtacaccgaaggtccctcaacttgacatcaagttacaaaaacgtcctcaaaccgcaaaaccagatatccggtgccccttaactaatcaaaaccggtcactttaggtcctccggtggttttgactccggttttatcctacgtggcagctgagtcagcgtaggacccacgcagaccccacacgtcaggtgtccacgtcagcacctctctctttccctcttctctttctttgtttctcctctcgtgccagatctcaccgagaacgtggtcggcaccctgggtgcggcgcgttctcgctgccggtgagggcactggtgccgctgctctacacggtgcgccgcgtgttcgtcgtcgtggactgggtgtacatttgatggcacgaacatcactgggaggatcatgaacatcaccaaggaaatccacccgccatgacgcacctgcgtgaggacggcggcaaaggacatcccgagaggaagcgcgagatcacccggcagctggcgctagcggagcgggaggcgacacccaaccacacgctacggcgggtcatccaggcagg

SEQ ID NO: 3427 - DNA, 1853 bp, Oryza sativa
tgtcaagttgagggaccttcggcgtactttttccaaaataatatgcatgacgctacttcaacatgcgttctgccagtggagtggttagttacttttgtttgttgtcctcggcccacggttcgagtctcggttgtaccctctttttacagctccttatatcaatgggttaattggatccatgccattataaatatcagggttttgaaatatgctattaatattacctatttggattcatgccattataatttcacaccttttttagataatggaataaatatcccggcctttgctcattagagctatagccaattattacaaggaatcacacaaacaacgagtgaagttcaaataaaattaaacacacccaaagataaaaaaaccaaaccaagaaaaggagcacacatttattcaaatctatttgtgaatctccatccatggttcgcaaatatttgcataaccgtcgtctccagtttatggcatgcaaccttcataaactctccatcatcttcacacttttgcagctttgcccaaaaccggagccaatatgttgccttgaatattacctgcatatatgagatagatggtgatttgtcaaaaactatatcattcctactcaaccacagagcccaacaaatgacagatgctttaacaagtatgagtttactcatcttcttgtcaatccctaaaagccaacaatcaaacatattagatatggtactagggaggtttaaaccaaaagaaaactgtactactctccaaacaaattttgcaaaatgacagtcaagaaaaagatattgaatggtctcattttccatacagaaacaacatcttaacctgccattccaattccgtcttgccaaattgtccttagttagcaccagccctttaagcaagtaccacataaagatcttaatattaagtggcatcttaagcttccaaacaatcttatttctctcaatataaccattattaattagagcaagatacattgacataacagaaaatctaccattccgatgataattccatctaaaacaatcagaggattggttcaactgaatatgtataatggaagcacacaaatcatgccaatatataagattctgaccaactaaggatctcctgaaggaaacattaagtggaacagaactcataacattagcaatagtagaacttttccttcggacaatagagtataaagatggatatttatctttaaacgccaagtttcctagccatttatcttcccaaaaccttgtttgattcccatcattcacaatccaagaacccatatgtaagacagtatctttgaccttcattagacctgaccaaaaatgagaatcaccatgtttcctactttctctttaataaagtctgccaaacaccttcctcattaattaatttaaacaaccacttacttaagagacacttgttttgtatttccaaattgtggacccctaaaccaccctgatccttgggttgacaaactatatcccatctagtaagtctatactttttttttgtggtcatccctttgcccagaaaaaacgtgatctataataatcaattttttgaagaacccctttcggtatctcaaaaaatgaaatcataaacataactaaacttgaaagaacagagttaatcaaaaccagtctacccccaactgacaaatgttttcctttccaactacagagtttttcctcaattctttgctcaattacttcccaatctttattattcagcttcctataatgcatcgggataccaacatatttaacaggaaacgagccaagcttacaaccaaagatgttagaatactgatcataaaactcctttgcgtgaccaaaaca

SEQ ID NO: 3428 - DNA, 899 bp, Oryza sativa
ggcggcttcctcgacaccctcgcctccttcctcctactgaaggcgatgatgtcagcgatgccgccggagcggctaggctgtcgccccatccgtcgcagcatccggagccggacccccttacgctgccgatggcgagcgttcctcgaagaagcaggtgagccggacgacaaggcatccgcggccgtagccgccgctggcgaggagtaggaggatgacgctgctgtgtccatctcgcggcagcgactgacacgtgagatttgggggagaagaccccgtgatctggcatgctagctgcggccacgccgttcgggcggtccggcgtcctgccgccgcaggcgctcggccaccggcacgccgtcctccatcgtcatcgtcgccgccgaacccgcggacgctccgggaagccagctacttcttgggctccgtctcggcggctcgccgagacagctcgtctcgtcccttgagcgaaccggcagtagtagcagcaacatagccacgacgccaagaaccaccaaatcccccaccgctacgacggagacgaccaccacgacgccgtgtccagcgtcttctccgtggacgctggctcatggccgccgcctcctcgtccaactctttatgctcgaggcggcgcgagctcaagagtgggtctccgaccgcctcgcagccaatgacgcggtcgagctcgtcggccgcctaggggaagctcgcgagaacgaggaaggaaggagtgtaatagagaaagagaaacagaaggggggaaacaggaagagagaggtgctgacgtgggcacctgacattggggcccttgtggggctcatgctgactcagctgccatgtaggataaaaccggggtcacaaccaccggaggacctaaagtgaccggttttgattagttaagg

SEQ ID NO: 3429 - DNA, 948 bp, Oryza sativa
tacatctttagccctcttaattagtaaagtaagcatatcagctactatattaaaaagaattggtgacaaaggatcaccttgcctcaacccttatacgtttgaaaattattaccagtttgatcatttactttaataccaacatgacccccttgaataaaagaagctatccactcacaccatttaggagagaagcccttcatcctcaacgtctgttgtacaaaagaccatttaaccttatcataggatttttcaaaatcaatcttaaaaatcacaacacttttatttttacgatgtaattcatgcatagtttcatgcaaaataacaacaccttccataatatttctcctaggtataaaagcagtttgagtaggactaatcaccttttgagcaacactcattatcctatttcacacctatccattatataccactacttacccctttaacacattttccaagatattatgaccaaattacccatatattcttcttcatcggttcgtcccctcccctctctatcttgctcgtcgaacctgacatcctagcgaacgagacgaggtcacgggcgcaggggatgttcccacctggccggatgtgctcgcgctccgcctcacgcacttgctgctctctccggcgcaaccctccgtgcccatggctgccgtgctcctgcgctgtttcatttccgccagggtcacaggacacgggcctccacgtcggggatccccaagtccatttggaagaagctctcctactccaacaggaaaaggagcagcaggtgcaaccacctgctgcttgcttgcatccttcctaatgccatccaataggaagagtagtagcagctgcaaccaccggctgcttgaagggagaaggagatggaagatgaacatggtagagaactagagattggaagaggatgaggatgaagataaggacagggctgcaggaatt

SEQ ID NO: 3430 - DNA, 1466 bp, Oryza sativa
agtgttttcctcgttttccgtcggtggccgatgcctgaagaattcaagagcgaataactgaatatacctcctcaagactcaaagttaagaccctgtttagttcccagaaacttttcgtaaaaacaacacatcgaatttttggacacatgtatagagcattaaatatagataaaaagaaaaactaattgtatagtttgcatggaaatcgcgagacgaatcttttgagcctaattaatccatgattagctataagtgctacagtaacccacatgtgctaataacgatcgacttaattaggctcaaaagattcgtcttgcggttttcaggcgagttatgaaattagttttttcattcgtggccgaaaaccccttccgacattcggtcaaacgtccgatgtgacacctaaaaaattttcatttcaccaactaaacaggccctaagatcatatggtagactagtcttatgatatgtatctgaagttctgaacttctccatcgaaaaaatcgaacaagtttccgagcttcttcttgacagagttctgatttctgaaactctgaagtctgaacgcttatatgaaatgatccaccggtgatgttcctttcagacttgatagttggaagctagctggttgcaaacctgtgtcacacgtagtctgaaactggatgaaaggcaatcacatactcacatactcacacgtagtctgaacttctgatcgattatgcaaaatgaaggtaactggggaagttcatgacagtctgaactctgaaccaaagcaaagtaaatcatgtggaagatggatgatgatatttcatactcacccctacaaatgatcccgcacacaacaggtaaatatgaaccaagaaccgcagatgcacagcaacattcaatcctatatgcagcgtataatatatcaacggtgtgcagataccagaagctacggtagtttactctgcaaaacgattgtaagtatcccctccggttttttagatggcgtctttgacttttgaacatttttcttactaaaaaattacataaatatcacttatttagttgtgtttcggtttatgagtaaacacactttaagcatgacatatttttttcctgtttgcactttttttttagtttggatgaatggtcaaacatatgtcgagaaatcatcggcatcatctattaaaaaccggagtaaagtaccttttatcccaaaaaaataagtggtagtctactttcatcgcagtttcagatttcaggagaaggggagggtcaaaaaatagacaacaaccaccttgcctgacggaaagtatttttctatacctaggtgccacacctaggtgccatggcacctagatgtattcatgtaatttaaatagttgcataaaaattcattgaggaacctgatcagtaaccaggcagacagcaagctggtgaagttcagcattctagtttgatttcaccacaacatgcgagct

SEQ ID NO: 3431 - DNA, 978 bp, Oryza sativa
tgttatgtctctccatgtgtttgtttttatgtaaaaattctaattatgtcactaatcatcaggttgaactatccagtcccagtgctgaattgcgcttgttagaggtcttttaccacaagatatataaggtacttgtaccttagctttcagccttcaagagaaataaaataccatatgtcctgatgaattccctttttttttttaaaaaaacatctgtttataatttatggcatggctgctactaattatagtatttccatagatttttccactccatgagaagatagagaatattaatgatcagtacctggacactacgtgctgaggaggtatgtaatgttctttgtggttgcatttggtgctccatttcgtgaactgtaaagttgcaatctatttcatttcctgcttgtgtcaaaatgtgcgccttcattctatcctcatatctgcttctgcttattggtacagattccagaggaggagaaaaatctcggtccaaatgatcggttaattcatgttatcacttcatgaaagaccctcttcagaatcaggtagtgcacttcgatatgatcttcattcttgtctaattgagttgtattgggagttggctacttacaaaatatgctgaacattccattaatactgctttgatgactagcagcagattcagaactttggagatcctttttatcttgctatccgtgaaggtgagactttagcagaagtaaaggagcgcatacagaaaaaactccaagtccctgatgaggaattctgcaaggtgatccatctgttgaagtttcttatgaaagcgtggaattataacatgttttggcttgctctttatccttgtccaccttgggattatgctgatatataagtcagattcagagttttgaagtataccagtctagtggtttcttttactgtagggagctgagagttctcatattatactgcagtctaaaattttctcagtaattc

SEQ ID NO: 3432 - DNA, 1245 bp, Oryza sativa
catgaaccggcagattacctccaagattcagatgttgtatctgcccgtttccaggtaaattattgtttgttccctacaggcttctctagttgtgcccataaatttgttgtgttctatgatttacaaagttttctgttctgatttcttcagaggagagatgtctatggagcctgggagcagtatcttggtttggagcatgctgatactgcaccaaaaagggcctacacagccaatcaggtatgctgctgtctggttgtgaacttgtgaagcgagcatagcgaattcttgtgcctgttacttttacctttattctgtcactcggcttgggcatatctatgctatacttcgtttatcttgctacctgcacttcagctggtttacaccgtggtatttcttgcaatctttttaaactttcatcaaatgatctttcaaaatatttgggctcgcctgatgttttagagaattctgttttaatccctcttagttatacatgaaaccaataatccggaattttattactccatgactccgtcccaaaaaaacttctggagtttgaattgtcacaaaaaaaccaacttctaccatcctacctaccctcagcacataaaacaagaagttttatcccttaaataccctttacctacctatcaccattactaccttttccaataatgaggggcattttggtcatttttactccccactaattttaccttgggatgctaggaatggtctttttgtgggatggagggagtacatgctgagcaatttatatttaggcatttaggtgtttacagtatccttatacgcaactttgagatggctttgctgctactgaagaaagatcttgtagttaactttgggtttccccgcaaacatcttcgcacttcacatacatttttctgcactgtacttgcactgtactgtagcattccaatgctcttttcttttatatgcatattgctatggttgcaaggacctcatcttaacgaaattttgcttcttccttttttgtttctggcttcaactaatgtgcagaaccgtcacacctatgagaagccagtgagaatttacaattgaaatcacttctgactgtgctggccccttggtggtgtcaaatctgaaagcagcaacagagagatgtagtatggagaagttaaactcgaacagggaaaagcagcaacaagttttggccatttgggtgccgtggcctctattcctttctaccggtgctgttgggatgca

SEQ ID NO: 3433 - DNA, 7342 bp, Oryza sativa
tacataagattttggtaggggggcatatgtatacagggtatagttctgactcatatcgacttcttgtctttgtgtggatgtaacaatggaaaacatcataccaatcttgctgtatggctcaattttatcttcctttcgcagaaaaaattaaccagaattactgccgcagttagtgcggcgctgggttccgtgatagtaatagctgatgtaagcgtggatatgatgtaattcaccagaaatatgaaatatcccgatttccttcgagaaacaaatatgaaatatcattgaaatgtggtacttcttttttcctgctgcttcggaaatgagtatattttgatcttcggatggttgtctcgttgatttaccttcacatgtggaattagacaattagtgttagatttggtctaagatctgctatcctggaggaaaaagattttgaattggagttttaaacactactacattctcaacccgttattgtcgtacggagtatttctctgtaaaatcgttctcaaactgtcgactgtagggttgtacatttcgtattcaattttccgtcaatggagaactacatgaggccgtacatatgctcatcccagtgaattggttagattcagcgggtcaatccgtacttctggtagacacagccgtataaattttcgtcgtcaccacaatttcttttttccttttttttaagaaacatcgtataaatgcttgtcaaacatgtgccctgagattgggtcggtatattcggtatattttgagattactttaccacaaatatcttgttataagtgaatatatcataaatggattattgtccctcgagaggtcgagggacgtcccctcgttttgtgcatgtcgttcaaaatgttactaaattttttaaaatttttttgtcaagatagatcaatatatgatatatcttttcacaaacatgcgagttaaaattcgacttatacaattcaaaacaaaaagaataaatttgactgtgaattacacattcacttcatagtcaaatttgttatttttgtttttacttgtataagttgaatttaaatttgcatgtttgtgaagtaacatatcatatattggtctatcctaccaatttttttcaaattttttaatgactttttaagtgacatgtaaaaataagtggatattcccttaaaggatgatttgagtgttccgaatatatggagtgtagaacctaaacataacatgcaagttccactataaatctggatggacaaaagttccacttccaccacaagtaactcacatgtctaataatatgtaaaaaaaattcattggtgctcacaaaaatttgtaggtggacgtgtttatactttaatgtcataaactaggtgttctttgaaaattggagttttccaagatgcaaaaatatatattaaaaaatacagcacttaaagtgcatataaacttgatttcaggaaatttttgcatcaacttatatattgacaatattgtccaaaaaattatatctcatgtcgcgtataaaatttggagtcacgcgttcgatattcttctctcgtcactacgatctcaacaaagctccagtccacttaacactgcaactcccaacctcaccaatggacaacccgacgccgtcgtcgagctccggcggtggcggcgccgccgccgccgccaatgccagctccgacgagcaccgcaagacgtcgccggcgacggccgctgatttcttcgacgaggagcacaccttcgacgatatcctgctcccggtggacttgttcgacttcacgcacggactcgacgccggcgacggctgttacgtagacgatcaggctgcgattgggcagaagccgctgtcgccggcgccggagccggcggcagagcagcagccgtcgccggcgccggagcacggcgacgatgagcggctggtgatgtactaccaaggacaggagtacatcttcgaccccgtgcagccgcagaaggtatctcttggtcttgctgcacaatgtgcttgtttcttggtaactttctacgttttttttttcattctcttccttggaaatataattatgtttcttcattctttgatcctagctagtacttgatgagtttcggctttaatttgtttgcaagaatttggttagaaggttttgctcttgtataatgtggtatatttaatttgctcttggataatttgtttcggctttaatttcattttgatcctgaaaaataaggagctctgttcttacttcttgcatttcacctaggaaaattagtagatacgcactgaaggcttttgacttaaaaaaggatcagactgttattatctccccttttgcattgttttttttgagatcactctacctttcttttgcattgacactgttagatacagtacttatgagcaacatttgtggttgctttttttaatatttgtggctctctgttggattcttttgctatgttgagttggttatcctcctgttgcattgttatgtatgcatgagcttggcatgaccaattcaatgtttgtctcttagcttgtagctaatttagaacgcgttgcactaattcttgtttcatcttttttttctctgatcattattggatagaagcagaatttcaatcttaaaatgttcttcttcgatgacaaaatttgtagtgtagttttatttttgcgtagccgctcaacacgagtatagtacttactaactccattccaaaatacaagggattttgctcggaagtagtgcatgctatccatgattcttttcctaccatgtcatgcgctcaagtcttctctgcattcttgtttccagtgcaatattgaaaaacttcactatatttattatgtattgctacagtttaccacttaaatagttaaataacatcgtattacagcactgacaatattgtgatactgttacacagattgaaaatatcttccaccatctgaatggacaggagatgattccacagagcatcaggccacaacccactaacctggtaattaaatcatctgcatttttcacaaccatttgaaaaaaataactgcattgcagatcactctctgcagcagttgtcctagcagattacaacttctctgaacttttcatcaggtaagacccatcactgttcccgaggacttcgacaggtttgctgcgctgacgcggtatagggagaaaaagaggaacatcaagttcatcaagaaggcggattacagtgcccgaaaggaagtcgctttgcggtacgcatcaaaatcttcattccgaaatgttaatttggtccgcatttgctagtacttaacaaattttggttcttgtgaatttgctcattcaggatgaaacgcagcaaagggaaatttgcacctagggttcagacctctgaaaattccttggcacacagaaaggggataactttgtaagttcttttcaacagatatatacttctgattttctgaaaccttcattgcattattgcaatgtggatgctgcttgttgatcgtatactatttttaattcatgcagctgcaccaactgtggtgaaagcagcgacgccacacccatgatgcgccatgctcccaatggaaccaaatcattttgcaatgcttgtgggttgatgtgggcgaactcggttagtgtccacatattccattccttccccttatatatcttgaaattttttttgttgaagcaaatgtttgcttgaatgtttatatgggttactgaattttctaccttcacctgcagagaaaaataagaaagatcagaaacccaacttccggggagcaagaagatcaataatactcaggatcgtttcatttcatcgatggcattcttctttgattcgagtgcattccaatcgaagtttagatgaaacagaatatagaacaacgctgatagcagctatagagacgggagagactgagagagctttgttcttgtagtttacctccggtgtgctaggcaccaagtcaatgatagtgagtagtgatgtcgtaatttgaattttgtagaggataatttaatctttgtaattgaccctgaaacctctgaatattctggatttttttaaaaagaaaaaactggctgttttcgtagcagtgacgtagaaatagtcatgcgatgcacttactatgcgggttaagtgtatttgtggtggtgtatatgcgtgtgtgttcaatgcaatgttataaaggaaaaaaataacctatcagctatggatatgtgcatgctcatccatccatgaatcccactgagcttccactgcccaagggcctgtttgtttcagctacaacataccaattttaaattttagaactaattttagttttttgtttgtcgtttttagtaactttgcttttgcttttgaattgctaaggatagaaatggaaagtcctattaaaaatattattctatatcaatcacatatcttcggaatttagagacagtcacacaaattttcttcagttttaactagaggtttagtcataggattgattcctagataagttgtatctgcttttgagctggtgttgtttaagactattttctcatcattctcctagaaacctatagacttggttcagacaagacttttgcaaggggttgtagctccctgacatgtgagttcttacctcctaaatcaacgagtcaactacggtcaacctgacacgtcagtaaaaaccgcttcccaaaccatcgaaggagtctatttgcactgtttttaagataagaaagacgttatacccggttttgtggttgaggtaggcgattcaaacagtagtaagagatgaaatagacttgtattccaaaaagaaaaggactcatcatccaaaaaggccttccaacaaggccaaggcccaaatctcctagtcctacaagcccagtagaatgttcggcccagcagcagagatccccttcccgatttcttctccatttccgttctttttttccgcggaagtcgaacagtttcagtccacagcacccgcgcaatcccccgcccatggcgacctccgccgcgcgcgccgccaagcgcgccaggatcgccgccccgccgccgccgacgccgacgccgacgcatctgcggcgcggggacggcggctacgtgccggggaacatcgtcgagatcgagctctccaacttcatgacctaccaccgcctcgcctgccgcccaggcccccgcctcaacctcgtcctcggccccaacggctccggcaagagctccctcgtctgcgccatcgccctcgccctcgccgctgaccccggcgtacgtacacacctactgcctccttacatttcccgcggcaactgtttttttcccccctcttatgcgaatacgacggctaagtgtatgaacaaatgcgtgcgtgaacggaatgcaggttctcgggagggtggccagcgtcggggcgttcgtcaagaggggggaggagtccggccatgtcaagatttcactcgcgggaacacacccgaacacattatccgcatcacgaggaagatcgataccaagaacaagtccgagtggcagctcgatggtataacctcctcctcactgcctcaccttccgtactcccgttagcactgcttgttgtgtggtccttcattctgctgagctatatatatgttaatttaaagaattatgaaaatgaaggaggcgcgtcactaatatttatttcctgcaggcgccactgtgccaagaaaggaagttgttgatctcatcaagaaattcaatattcaagttaataacttaacacaggtgtaccttcagtttatgttaccgttccctttgtttacattcgttatcattttgctttgcatcttaatcaagaggagccacttatccatttgtcgtgaacctattcctgatttctgttttcctgctcaactgtgttcagcttgaccgatccttcagcgtgcccttaattcagtgacttaataggcttggcactaaaaacttatgctcgtgtgtatatatatgtatcttctgtgttctaaacgccacgtcagtgataagtagtactgtcgtccttacgctctgaacattctatatttcttttttgaaaaaaaaaaactggttgttttcattggcatttgcgtgtatatgcttgtgatgtgtgtatatgtgacggtgtacgtgcgaatgtctcttcaaagtaataaaaaataaatggaatttgtgatggatgtgcacactctatgcttttgtgtggagctcaaactgatcttgcttcaggggtttactaacgggtacttaagggttccaagcaggtcctgtttgaaagttaagatacgctgctgacataaaatggatatctatttgattaatatgataatttagctttcaaaaataaacataaaagaactagtgttctaagcaatatagtagaatataaagcttttgaaaggatagactggcatttaggatttagaagcacaccatttatgctttgttttgaaccaaaaaaaaaagcaggaaagggcggcgttgggacccaccaactctgatgctaaaaaggaaatcaatgcttaatgtgccctgcgctgcttcttggggagaaggatgcatgcatggggtagattggaacatctgacgtgaagtcagagagacgtggtgactgaaacgtgggtcccaatgctcgcgagcctacctgtcagtgatcatgtcagggagcagttcacgttagaggatccggtttctatgagatactggaaggagaccaggtggtatagatggctagataggttgcccggtctggtctggcctatacatgactaggcccacgaccgagagcagtcagaccggcacgatacgtcctaaacgagcgggtcaggacatgtcagccaggggccctaatgggcgatcagtcgtgccccccgcgtgggacacggtcagtttttgaccctctcatctctcctctctactatatgtatacatacatatatattttatatatatacgtataaactttgtatacgtatgtatataaagtatatattatgtatacatattgcatatatttatatttttttaatatgcatatattttttatatacaaaatttgtttatgtatatatacgaaatatatcaactttatatatgtttgtatatatgtgtaatataaaaattacacatatataaactttatatacacgtatataaactttatatacgtgtttaatacgtgcatattaaaaaagggaaaaactgacaaaaatacagaaagaaaaaaaaagtgcaaaaaaagaaaccagactaaaaagatacgaaaagaaaaaaacaaaaaaaaagtgcgtaaaaaaacgaaaagaaaaaagagaaaccgcgggcgccgccgccgcaccccccc

SEQ ID NO: 3434 - DNA, 3479 bp, Oryza sativa
  unsure (1)..(3479): unsure at all n locations
ggggtgccgggagcggccggcgaggcgatgggggatgcctcgtgcagccgctcggcaacctcctcctcctcgggggcggcggcaacctccgcgacgcggggctcggcgcgctccgcccgctccccgacgacgtcctcctcgacgtgctcggcctgctcgcggcgcgcgacctcgctaggctctccgcggcgtcgagggcgctctacatcgtcgcctcccacgacccgctctggcgggcgctcgtcctcgacgagctcggcggggacttcgccttctcgggctcgtggcgcgccacctacatcgccgccgcgtcgggcggccgcgcccacctccccccgcggggcctagagatcagggggttctactccgactacctcttccagagctggctctgcgccaacatggagatgcggccggagtggctccaccgggacaccatcgatcgccgccgcggcatgtccgtcgagcaattcgtctccgaattcgaggagcccaataggccggtgcttctggaaggctgcctcgagagctggccagcattgcagaagtggaccagggagcacttgctgaaggtctcggccgggaaggagttcgccgtcgggccggtgagcatgacgctggataggtacctccagtatgccgacaatgtgcaggaggagaggccattgtacctgttcgatgccaagttcaccgagaaggtgccggagatggggagggactatgaggtgccggcgtacttccgagaggacctattcggggtgcttggggaggaaaggccggaccaccgatgggttatcattgggccggcaggttcagggtcgtcgtttcatgttgatccaaactcgacatcggcgtggaatgctgtgatcaagggagccaagaagtgggtgatgttcccaccggaggtggtgccgccaggagttcatccaagtgcggatggagcagaagtcactagccctgtatctatcatggaatggttcatgaatttttatggggcatgtaagacctgggaaaagaggcctgttgagtgtatatgccgggctggagaggtggtttttgtgcctaatggatggtggcatttggttatcaatctggaggaatctattgcgattactcagaattatgtgagcaggttagagttcacatctcatgcttctgtgttgtttttattgtttcactagacgcaggactttgttgttagaaattaagcgaccatcaagaagtgctcttttatggccttctgtggtaatgaacataaaaaagggcatcaccatgccagtaataacagtgtatagaacaaattagaatctccagtacaaattcaaaataaaatccaatgttctaggcttgatgcttttaagcatatgttcattcacaaacaatctcagtggtgcacttatgcttttacttaattctatggatgttagctcttaagagattcaagtgtatgtatgttccttggtcgtttgtaggatttacaaatgacgatcaactgaagaaaagtttctgccaaataataattaatgtcaattgtctttctggttctaaaactatttaaggtcaacaaaggcttatttctatactttacaaatgatgccctcttcactcatcgagtcaaaattgactctgtgtgtaagcttcttaggagtagcaattaacaaaagtagtagctgggttctcctgatgatgccaggtgctaatggaagtatcgtgtagtgttgacgaaggtccctcctgatgatcctccttttgaaagaaggcatgaatcaggagagtgttctcatttcaatctgggttgctgtatagctttgatgtggaatcctcttgaatcttgtttaattgctgaacttgatgtgtccattagtctgcatgataactgttgcctaatcctgttacatctttataaatgacatgctatctcttcttttcccctttgaaatattcaggaggaatctgttgaatgttcttgactttctcaagaggcccaatgcaagtgaacttgtatcagggactacagacagggtaaacctgcatgacaagttccgcaatgccatcgatatgacttatcctgggatgattaaacagcttgaacttgaagctcagcagaaggctgctgctcgcaagaagaaagtctcgttctgggaatctgcggtagatgccaatactggaggattcaagttctcattctgatttcgtttctagcagctaggtctgtcagtctgatacttgattgctgttcttggtgaaagttcgacgattttgccattccatttaaatgctcaatcacatctgatttcctacctgaattcaggtttatgagcctatgcattgtctgaatctgtcttaactgtatcatcttaaattttggaggaatgtagtcccagacatgtatttcattgttgttgttgttgtaacatgtagcttacacaataataaattgatcattgaccttgtgcaatctcctatcttgtctgacttcccagatgtggcctctaatcttgtattctgatgtggcctctaatcttgtattcttagatgttagctttggtcctttggacgccttaagttgattagtggtacatctttttgctggtgaccgggcgccgctaagtatttgactctctgcggaatcttgcttcaaactgtatcatgattcatgacagggcaatgaattcacattaccaaaaggaatagagttgtatgtttcatatagacctagtttattggattaaacatccaaatcttagctaaaatacctccattctcttttaaatgcaggcaacattagtatctttcgaccaattacaaaagtactacgtattttcttttggccaattacagaagtacatgcctttgccttgtacataggttttacttagtttaatttgcttcgtaacattaggaggaagaacgctcctcaatcttcagaaggctgcaggtgtatctgactttgttctgttaaggcttacacatcatgtacagctgcatgtttgtaactctcaattgtcaacatgacaacatgggcatacaggagatactagtagattacaacaagttacatcatgtgtataaggctctaggtacatatatgcatccatattagtctttacgccttttgctcccaaataacaactgaaatctgtacaattattccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3435 - DNA, 1510 bp, Oryza sativa
  unsure (1)..(1510): unsure at all n locations
ttggataatgttcaaaagaaatttagcatgaatgtacttaaatatgatgaattattggaggtacactacaattagaaatagagcattgcctcgaggttaactaaaaaggtattcagatatgatcttcagtatcccatccagcttgaatcccatcctatactaactcgttgactcaaaaaagaaatattaactaaaacaacataataaataaataaaatatactactaacatggactctagccaccatgatttgaatcctgacaccaacatatattacacagatatagatgcacatttaatagaattttagagagctagggattttgctgctggtctttatcttttaaccatatgttgagagtacattcaggtgtatccgtgaaaaaaaagaacatccatgnaattgcattacgttatcaatatattaggtgattncgccgtgctttgcttgcggaaattactaagtaattttcaatatatattttctcgttacaatcaagataggggtaaagaaaacaaatgaaatatcagagcttatcagtatttatcatgaaacaaacaaataaaacccgctttaatgtggaacatattgataagtttattttaaatattatacaaatgatagatagatttgtaaaaatattgtggaaatgatgcgaggggtgatgattggatatgtttgcatgttgatttgtagaattaaataaattgtagatgatgttgcatgcttgcatgaggttgaatatataattattgctagtgggtgatgatttggcatggctgtatgttaagctttagagttagtgggttataactttatagaaagtatagattcattcatttgcacgcatgtggatggctgggtaccatgattattgccattcaccctctgtcttctttcgcataagaacatgttgtggaggaaaaaaaataaggtcaaaatttaaaaaactctatgaagctgttgatgcgaaaaacacgaggcctggaagatctgcttaactttagtgcaggtccaaaaattttgcttttaggttcgtgagcgtgccagttgatttgatcctgcaatcaacaagaaataaagacaaagaaacagcggttaaatccataaatgatagccgatcggccagccgccgatgacgtatcatttatctttgagtcgatgtcatatttgaatcgatcggcagttataaacaatcaagatacaactaaatctattcgatcggctgtagatattaatgatatataatctttctgtcggtgtatacttaaatcaagtgattgggagacaatataaatcacttagatcgaaatatacattaacaaggagattataagcattcatagcatagccgatcagatagatctagcatctatcggctaatactccgataccactctatattaagatattaaagcaaataaaatatatcgaacagaagcctaatatactttgttgtagtaagatcttaacataaaaggcagatctagcatatcaattaagcatgta

SEQ ID NO: 3436 - DNA, 2949 bp, Oryza sativa
ccgattcttgctctgtttccgaaacgatctctgtcttggattccgcttcaatttgatcttcatctctgatacctagattaccaattttggtcattaacagaagctacaatacaaaagtcatcctataatttctccatagatttaaatcttaataaaggcatggaatttaacgagaaaagtattggaaacaacagaataagcaataccaacaatgaagtaacagctcggttctacaggaatgacaacaacaggagcgacaacaacggtagcccatcattgtctgcccggaggatggttgcatgtcctacgaggatttaaaaagcagtgttaggaaagccaagcaaatcaatcgacgttgtatgtataagagcaagtataatagtgaaggagagaggtaacaagaaattaagggtgttggctttcatgcaagagctagcttaacacaagctccaagacaaatacattaaatgtataagtgagagatagagagaggagaagaaaattatagccaattttatagctactctatcggtaaatctaattggagaggcctagttttaaccagagacacccacgtgctagtactttaggagttttggttgctattagtatatccaatagtgcatatcttgttttcttcttatagaattttctcttaaactagttatctaatatacaatctgattacaccattacgttcgttgcaattaaatctttacaacaagatcttacatgattatattacgatgaaaaaaatatttatatttataaattacttttattatatacgtaagttacttttatcatatatatatataagttacttttagatttgactaaattacttctatacattcataatgctctaagttgattatttttattattgtttttagttaattctatattttgtggactttataaatcttctctatactttacttgtgaatctactctacatagtttcttatttcagctcactcacaatataattatttctactacagagagttactctctccgtttcataatgtaagtgtcattctaacattactcatattcatatagatgttaatgaatatagacatagttctatgtctagatgaactatgtctagatcattaacatctatatgaatgtaggcaatgctagaatgtcttacattatgaaacggaggaagtatttcaattgcataactaagttacttctgttgcatataattacttttactgcagaaagttatttctattgcatagataagttacttctattgtatagctaagttacttctgcaatttaaatacattacttttaaattaataaattatttgaatatatccaatatggatcttgcattatcatatgtagagtataatgatgcaaatagatcttaaaaataatacgtgatttaaaatatattagttattaaagagtttaaatctaaatgaaatttatgtatatgataaaaataacttacatatataataaaagttatatatatatatatatatatatatatatatatagaaaaactattctacacctgggtatagaatagctattctatacccccctccctaccaagggtcacacccacctccccctccttaccaaggcccaaaacccacctcccacctcggtcaaaggcccctcccaccggtcaaacccgcttactaactcccccccccacccacctcttctcagctctcgtcccaggacggtgcagtaacacgacgacctctgtgcagtaacactgtgtcttatgtgcagtaacaacgttaaaatatagttgaaatatagtcatgacggatctacttttgataagctctttttttctagcatcatggtgcaaacggttttaaaaaaccttacatcacttgagagatattgttcttcaaagcttgactttttgacaatttatctctctacaagtagtagtaatactatactattacttactattacttgttactacttgtctgttgtacgttactacaatcgcatcacgatgttactacactgcatattactgtattttttgggtagtgttactgcataaacacgtggtaacgtatacctttcatgcagtaacacttttacttttgtgtagtaacaagtataaggttagcatttgaggcttttaacctatatatttttgtttcaattcctgatttactgtaattcaccacaatattactgtcaaaagtgcagtaacgtcatatacatgcagtaacactatattggagggaggagaccgattttcttgagaagaggggggaagaacggtttcttgaagaggagagtacgtagatgcattttgaagtttaaccttccacatgcagtaacactatagcattatggtgggaacgattttaaaaaataatacatatcttgtgagatattgcttttcaaagattagcattttgaactttaaccctccacatgcaataacagaatgtgtaacttgcagtaacaaagacatatacatgcagtaacatggttttaccaaatgtataaaattgttcaaacaactcttacatcaatcagatctcgctcaaagccacctacaggctttacctatagcccacctattcgatcttcatctcgtaaaaatgacatagtaaaactataattatcgtgcagtaacatagctacttgaaagtggtaatatgcgcctattatgtagtaacacttctactttcgtgcagtaacaaatatatggttagcatgtgaggctttaacctatatattgttgctttgatttctgatctactacaattttactatgacgttactcgcagaagtgcagtatcctatgtgttatacaataacgtcacatgttactgtacttttacaacaatgttactactagagcatagtaacatgttatgagttttgatagtaaaagatattaaaattgataatcatattactttctcataaaattct

SEQ ID NO: 3437 - DNA, 4201 bp, Oryza sativa
atatatatatatatatatatatatatatatatatatatatatatatatatatatatatatatatatatatatatatataatcagaatataatcatgtaagattttgttgtaaagatttaattgcaacgaacacaacggtataatcggattataaatcgataagtaatttaagagaaacttctctaagaaaaaaattgagtgtactagtattagttttttttttttggaaagaagggtgtctctctttagcactattcagctagtgctctcgatgtagtcgcgtccctaatctatcatatatatattggctacgcacaactactctctgcaggtatcttttcgcttcaaatcaggatgaacggtgagtcgttcacagcagctgtagctcgtcggtggtgaaaataatctcatgcaccaccgttcgccgttcgcttgagttcgcatgtgttctctcgtaacgaaggtagggtcgttcccatctgtggtgattttttgttagatgatacagagatatgattcgtttgttacagtataaagcacgtacaatagtcagatggaatagtccgatgggctttaaatgtaccgtggtcagatgggtttaaagttggcccaacatggcctttaaatatatatagggggggagagagagaggcggtaaccgaagacgttgttaggatcgccgtgagtttgagaaagatgtggggtacaacacaactgtcgtgtcctgaattggttgccgatctctccatatatatggatgagatcatatatcttgtttcacaacataaaccatctaattttacacaacatggaaaaaacatgtctataataaaaagtcccataaaagggaaaaataaaaaatgcgccgtctgtgaaaaagttaaaaaacacctttttggaaaacaataaccatccgattctagaaaaaaaaagagacaaaaaacatgtaaaaaaaccgttccacagaataaacaaagtatgattcaaaacctccataaaaaaagtttcctccgaaaaaacgttttcgcgaaaagaacctgttccgtgcaatgttacgctctatatatttctatctctatcaaaagcgaaataataaatttcttcttcgcattggttctcgacgtacttgttaagaaactacgggtgaaactacgggtgatgttatccacccaaaaaaaaataggaacaatggttactaatctaaccggtagagaagaggagatagctcctctctctccctttggtgtccctgtcgacaaccgacgcgatgttcctaaagatcgcatccctacggttggcaccgcttcacattgtataattgtactgttgatcaatgagaaaatatccgctcattcgctctattgtatcattcaattctctctcgctccaatcaacttcatccactttcaacggtactttttttattttcattcgtgttaacctactttctgagtcccgtgggtgccccccgcacatcaccagattaatttacttcaggttttttcgcacgtatatatccagttcatgatcacaatttgatttgatccgtcttggtccattttgaattttttttttgtccgttggtagagatcacctccatcgctaaggatcgaccacgtcggtgccgatcaaatacgatgcttgcggcacacaaactttccttgagctgtatgtgccaaataaaagcagcaagcaaagtcttatggaaaaagtacaaattagccccctaactattttggtgaccgaattacccccataaactcgaaaatcagacattgctaaactttcaataccggataattacccccctcgaccgaatctagagcggttttatcctacgtggcgtacacgtggcaatctagtaagcattttattttttaaaatatagtgggacccactcgccataccttatcttcccctcttcttcttccttttcctctctctcgggttcagagtgtgcacggcgagcggcggcgcgcgggggcggatggtcggtcggcacgcggaggccagcgatggatagtgggcggcggcgtgctggggcggacgggcggttggcgcgcgtgggctagcggcggaatgcggagagggcacggcggaatgcggggagggcacggcgggcaacgggcggcgccgaggaggccaggagggtgttggaggcgacgggctacggcgacgagtcctcggctcaggcgggcgctgccgaggtcatccttcctgccggaggcagcggagagagaggtgcagagcctcttctctggttccgatgtggagtcggcgggatccacggcctccccccgtctctctctctctctctctcggctcaggcaggcggctggcgatgaatcctcctcggggagggcgcagcgagcggcgctcgtggcgcagagggcacggtgggtggcgccaaggagggcattggaggcggtgcgctacagcgacgagtaattcgctgcccatccacgtcgtccccatcgaccgtagtcgctgtcaaccggagccacacagccgcaccacacagcccaccgctgctcgccgccgctaaagatgccacctgattcttctgctgctcctggtgttccccgcttcgctgctgctcctgtaaaactccccgtcacaccggcaagcagcacacatctgtacatcctgtacatgcatgtacactgttcgtcgattcaatttctctcagaattcttccgtgacattgccacgggtagatcgcgtcattgccgcgagcagtgtgccagcgtccaccatgctgatgccaccctcgtccggtgggtggtgcgtgatggcgatgcccgagcgagctagccgagcagcgtcgccatgtgcaccgccgctcgctacccagctccgccctccgcctccgcatctcgcactgtggcggcgggtcttcgttgtgggaggagaggagcagcaggagacgcgcgagacgagggcggcgagaccggatgcgggccatgcggcctccacttccatcgacgtgccggagggcggcggggcagcagggggaagacgaagcagattgagcgccacttcaccgccttccgctcctgccacgacgccctccgccttgcaccctcgccaagtcgccgtcgccctctgccatggccagaccaggccgctgcttgtcgccgccgccatggatgaggctgctgctgtggcgcatggggcagatggaagggtcgacgaggatggacggccacgcgtttcaggtctgcaatttttccccttcccttctttgcttctctcgttgacgtggtggaggcggcgcacggtccgtcgtcctggtcgtcggcatcgtggccgtccaaccacgtccgccagcgaacgcagagcaagctcgggtgaccggcgatggaggcggcgagttcgggaggtcggcggtgggggcggaggcagagcgcgtcgtccttggctcaccgcagcggcatgctctctcctctgctcaccgagagagagagatagagaaggaggagagaaaaaaacgctgataagtgggccccactagttttttttattggggcaattgtgtttttacctttgctttacgtctcaattgtgattttacccttgctttttagggttttgtgattttgcccctgcttttttgaaacgaagcatccgtctgccccggtttggacggtagtttggtgggcccgggatttccaaattaaacgaagaaagaaaatgctattataatttgtgaatgactattctacccttgcttcaatgaaacaaccaaatccccaaaccttgctgtcccgatccaattgaaaaccctagcatgctgggttgcaagcggcggcggcggccgcttacgcgacaagcggcggcgcgcggcagggaggagtggcggctcgggccagcacgcgatggagtcgggcgcgggcaagcgcggcggctccgtcagcacggcggccccgcggccgaggagcggcggctccgtcggcgcgtcggcgtttgctcggctaaaaactctgggttattacatgctttccataagttgtgagagcaggctgcaaaaacaaatagggccagctttgaggtgatctggtgatgtggtcattacttcttccacgaaattgtatgatattgttgctgcttactgctcgatccgtcgatatagatttgagctcttccagagttctccagccagtttacatctgagaaggatgtggtcagatggacagatgat

SEQ ID NO: 3438 - DNA, 12709 bp, Oryza sativa
gtgtttttgcccttgctgtcaaaattttgtcaaaaatattgtgttctgacatcgtttataaactgtgttcaaattattgcgaaaattcttcaaaattgtccaaaatattgtgttatgtcaacttttataaaatttgtgaacatttaggtcccgtatgaaattcgcataaaattaacttgaaacatgtatcctgtgcaagccaaaacatgtccaggggtatatttgtccattcaccacacatttaacaccgttaccattagttaacagagtaggggcaggcaattgcttcgtttcaaaaaaacaggggcaaaatcacaaatcctaaaaaaacaggggtaaaatcacaattgagatgtaaagcaagggcagaaacacaattgccccttatttgtttttgctgactatatcgctacgtgtgtgccacgtaggatgaaaaccgcttcgaaccgtgttagggtggtaatttgtccggtattaagagtttggggtgttaaatgtcaggttttcgagtttagagggtaaatcagtcgaccgtaatagttagggggtaatttgtactttttccaagccttattggaacttaaactcctctcgtcacctagcttcttgctgctaccaagcagccaaacccaatcactgtgaatgcgacgtgctcttgacgatcgttcacgcaagatttgaggtgagagaaagtttccatgatttatccatatttttagattggttcaaccaaactacatgatatcaaacccaactagctctatatgtcgtctaaatagtgtcgagtctaaatttcagatctaacatattagagaggtccataatttaaaaaaaatcaattgctcttattacaatttcagatcaactagcgatattaatttgacttttgatattccatgcgtagtttgacataagtagctaaatgtggtgtagttactaattttgagtctctccggttctctcacttgcttttattgtagtcttattcacctttcacactttctctaactacctaggatttggtgtaccttttcccatagcaatgcacggacactttgctagttcaataaagaattgaataaaaggtgaaggatagaagaaaaatgatatatgtatttagatttggttaaaaattcagatccaaagttcaagatttgatttgagagaaagtggattaaatttgattagggttgatgtttgagcatgagtgatgattttgacacattttctcctgaaacatatacgacacattttctttttggtgctatatgacatatttgtaagacatgtttctgccacaatgcatggaagaacggctaacagcttctgcccacacgtcaacccacaagcatcaccatttcctctacagtttgtgcaggtgcacagagaaaattctacagagttagcaaggcaggatactatgacaaatgcagtttcagaattacacccctgaaaccatcaaatattttcagagttattccgcggttttctttccctggctctgtacagatgaagccaaaggagtcatccggactcctaatttcatcatgaataccaatcaaaccactttggtgtgctgcattccactgataacttgaaacaaactagcaatagaagcgcgctacgctgcgccgcccgaatcaattgaagtccaatatgttcgatgaataatatgcatctactattcacccatagcattggtttatgctttcgtctatatcccataaactacccttataaaaaaaatttgcacatacaaaaatagtgtataggctaaaggagaaaaccgaaaggtatcggaagtttgaataaatagaaaaaaagggcaaattacatgccaatttcaatgagtttacagaggtttcaatgctacccctttttcctctgtacgctagaatcacattggactattggatgctaaaaacagaagacctaaatgcctactggtggtccatattaaatatatgcaaagctaaaatgaacagatggaaaatgatgttttttaagtgcaacatgcaagtgcactactcaacaacaatcctccgttatgtgcagttagtgacatcagtacacctgaaaaaaaatatactacctccatcccaaaatatatcgcaattttgagctgtgtacctaaacatacctttcaagatatagggctagaagtttttacattttgggacaaaggtagtagaaaattttaatagtaatgttagtacagctaaaacagtatagtatcaaccacttatatagagagataatattttcagtttggcatcacaattctaaacacatgaaaccaatttttctaccaaaagttctagcttttttggagtggagtagtacaaagtgctgctaccacgtggcaaagtttatgagcgaaagcatgcataatcaattaaccaaagtatggatgcaataacataagccttatagttctacaatgcatatatacttcttcaggtaggttccatttttttcttccctgttccttttaagtagcaggcaaaatatacaatgtggaaacaaagagcttgtaaaagcacaacggcagcaggctacactacagtttgacgaaacagatcgactgcacaacttttaggatttaaaagtgtgctttcacaaataatgaaaaaacatgtgtaaaatagtctggtgaactaaacagtgaaataatctctctgagcacagacatgtaaaagcaaaccaactgaaagacaaaatataaaaaagattgactcatgatattgctttacctttgcatcgtaacggttaggatatgtctagcaaagcattcccattgaaccagttgatgcacccttcaaaagaaatttacgtccgtctcagatatgaacaggaaatcagctttccgtaatggatccaatccatccatgtctttttcgacctaataaaaaaagaacatagagatatgtgatgaagcatgaataaatgaaggtcattctcgagactgctaatgttttcatgactcaaaaatggaaccatacttcttttaaagaaaatgattgaggacatatcctaacagtgtgtatagtcataatcgactgataacattcttttggtgcctttcgtgcagtggcgggcccaggattttgaacttgtgtattcgaaatggcgagaggaaaaaattttgttcatacacctaaaaacctaataattggcttgtatagtatcacacactaataattatataatatatagcgtatataacataaaattgagcataagttgcacacattgatagaattgatcatcacgtgaaattgtttaacatatagaaatactaattgataaacatatcaaagtaccaacatatggaatacaaaaatgatagaaaatgataaattgggaagaaatcttacaatttagagattaacttttcgacgcttgatattttgaaaataatcgatgatgtccttgtcctggcttgcaaaaagaattccctttcaatgaatgtaaccaaacaatcattcaagcatttttgtcccatcttggttctcaacttgtttttgatgtagttcattgaagaaaagaccctctacaaactaagcaaccaagcaagtatactaaatcaatcaattgtagttcccaatcctaaaatttgcattgcaattattcaaaattcgtgcttttgattcaccgtgtgtatgtggcagtgtggtggcggcgtggcccgttggcgtcttcgcggcctcggtcgtcggcggaaggcgggaaggggaggaaggcggctcagcgcccagccacccacacggccatgccgtcgccagcacaccacacgggcacacaggccacagcccacagcacgccgcgtgggcgcgcggcccgtcgctggagccggcgacgccgagtcgacgacgtgccactacctgcttggccgacggccgctgccggcgctgcgccgcagctcgcgcctccgccggtgcgcccagccggcggccgccccttccatgctgtggtgctgctcccgcgcagccgcgctggcgcggtctccggctcgctgcgacgccgccgccgcacgccgcgcccgccgcccacgccacaacacacgccgccggctgtggctgtctccaagcaaaattagggttagggtcttagggaattggggattttgggaggaggagtggaaagggggaggggagtgtaaaatttaggtccaatacagcagaaatggtaaaacaaggcccaaatgagtagtttaactctttttctttatctttttcatacatatatgaactatagagtaaatatacctattttttatccaaaatcttaggtatacatctgaatacccttgaattatagctgggcccgcccctgccttcgtgttttgtagagatggcatgaaagatacacatcaatgctagtctaaaattccatctcaagtgaatcttagggataaatgtgaaacaataaaccttgatgaggtaactaaagtagaaattaaatatttgaaatgggtgtaactcaatcatcaatgacataatggagctactgaaatggtgagaatcatttcctccattagctacttaaaagaggctaacagagcatgaatactcaattcacatcatatcacactggaagaggcattggcaacacatggatgaaaaaattcttcgtactcggcaacaccaacagaaaaaatctcttcatgcaagcaagagaaagctttaaaaacgaattggtgagatcaaatagtagagacacgaaggctatcaaagtacaatgtatatatggaagaaatttcatcagagcatatgagagcagtataataacgccggttgttatgttaccaatgtaactcagaagttgtactggatggtctttacaaaaattaagctcaattatgtagttatgttgttatacaacaatttgtgtattattcagcagatgaaatgcaagatgcatgacgacgatatacataattaaccttaatcatagaatcattatcataagattaaagatcaagcaaaatagcaatatagtctatatggctctggggaacttgaacggagctggcaatatttttcccttacatatgcaagcagtgtaagtaacattttacacttgatggtgtaaatatccatgtctaaataattttttgtataaaaagaattagtaagaatagctaatcaggttgtactggtcgaaaaagaattaaaacaataacaggagcatctgtaatatagaaacctataaagggtgaaggagatgtaacaatgtaaaataccttcgatagctttgataataataactgcatgcaacacccactaaaagtatgatctaacattgttaacgttatgataggatactttgcatagagatgaagagatcaattaaagaacacatctcaacaatatatggatttagaatacttcaagggaatataaataactctgatgtggtgacatacatatagttcttatgtagctaaaaataggaaagcaacctaggtaagttaaaaatgcgaggcgactgatagagaggattttgacattgaactcataaatcccttccctaagaaatgtgccatcacttgctatatacttttttgcttgtctgatgcaccctactgacatttttatgatcatattagacataaaagactaatgaattaccttcagtcacttactgattgtactttgagataccggccgatcaatgcagtaaacatttacccaatcaagttaattaacatgtaaagcaaagcagaatgggtatctacatccaagtggtgtatgtgtatttgcaggaaaaggtattaattagcaaacagacttacatatgtgatcctttcgtttatgcttccaaaaataaatgcaggcctgcacataaaaaaagttttgaatcaacggaatatggccttctaacaatgaaatctgtgcttcgaaaaatagatgcaggcctgcacataaaaaggagttttgaatcaacgaaatatggccttctaacagtgaaatttcagaagcataatgcaggcaaagcatttataacctcatatcttcagacttattgaccatgcaccacagaaaaatcaagtagaggtttctgttagatagatctcccacccgtacggcccaacggcacaacggaccttgaccgcgccctaatcgggggcgtccagcccaatggctggtgggctgtcacgtcctgataaattcatcccgaaataaaaatcattccctaaaaggaataatagaattaattaaaattcaaaaagaaattgacaaacactaaaatacgtgccagaaagattcgaatgtggtccggagaatttttgttaaattctccttggtctaaaaggagccctcaaattttacttgaattttcagagcaccgaaaatatttattaaacaacaacaacaattaacaaagtttattaaaaagaaaaagctaaaaataatccccctcctccctttgggccaagtctggcccaaagtctccctctctccccctcggcccgcagtccaagtccctctcccctccctttgtttttctctctttcctcccggcagcccactccctcctcctccttcctcccggcctgcctcggcccagcagcccggcccaagccaggtcgagccgagccagccgcgtgcacgcgcgccgcgcgtgcgctgactgcgcgcgctgaccgcgtggggcccacgcgccggtcgtcttcctcctcccgcacggcctctctctctcccgtgaaaaccctagttcgttcctccctcgaatccgcgcgatttaagcgttggattccaaaattaattggggagaattaatcccctttccttcctctcccttttcccaataatctcccctttaatcgtgcactattttgaccggaacggctgcgccattcatggccgtcttccatggccgccgggcgccttttccgccgtcgttccccgctcctcccgtgctcggctcgcttccctccgctataaaacggaaccccctcgctccgttctctcgttttagccccctcccgcgccctccccgtggctgcaccacctctccccgcctcctccttctctttcctcggtgccggccaccctccagccgcccctaccgccttgcccgagcgccggtcggccgtgccggcgcctcctccagcgtcgcagccgcctcctctgcgccggcctgccctctgttgcccgcggaggcctccggaagtgcatccccgccggcaacagtggcgttgccgccactgttccgtcttcggccggctgctgttcatcgccggtacgccgaccgacgtcgccatctcctccgtcgacgtcgcagccgcctcctctcccccagtcagcccttcgtttcgcggggaaaccactggagacgcgtcctcaccggcaaaacagtggcgttgccgccactgtaccgcctgtgccgccttgccggtgcagcggctgtcgtcatcgccatcctccctcgacgtcgccgcgtcgccctccaccctggcctgccctcggtttcgccggaacgccgttgcccgcgtcggtctcgccctccgcctcgccggagttccttcggcaaccccttccgctgtgcccgtgcgccggccgacgtcgccatctcctcctccggcatcgcagcgtcaaggttgccctcggcctcgcctcccctccatccgaaccccgccggtgttcgttatcgtcgtctctgttcgtcctcgttgacgactcctccggtcggtcgttcgtcctcgccggctcgtcgtctcgctgcgccgccaccctcgtcgtcatcatagcggcgtgttccgcgccgtcctcgtctccgtgcagctgctgccggctgccctcatcgcctcctcgccggttcctgtcgttgtcctctcgtcgttcccggtcgtcgtggcattcgtccctccgtcaagccgttctcgtccgtcgtccgtgtccgtcaagtgtgccgctgcagccccgtcgttgtcttcgtcctcgcctccgcgtcgccaagcgttgcgccggccgcgtctcgccttcgtccaaggatcgccgccgaagtcgtcccctcgcctttcgtctccgtcattcccggccgtctccgccgcgcccgttcatcgttgtcgttccctcgcctcgtcgcgtggtggtaaggatctctccttcgctgccccgtcctcgtcctttcggtatcgcccgtgcccgttgtgcggttgtcgaccccggtacccgtgtaccggtgtcggtagttgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacgggatctgcttccgtcgacccgtggactgtctctgtgtactcggtctaccgcggtcctttaggttgacatgtggggtccgcatgtcaacggcgcagccttcctgtcttttccaggctagcgcttacacatgttttatagttgcaaaacctaattataataatccgcaaatctccatgtaacagcattaaacttcggatgatcatatcttggtcatacgagctctgaatcgatccgttcaagtctcctaatgtttgttataacctaaagaaccctgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttaagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggatactatggaatggttggcttatgttggaattggacacacacctccccctctattcaaaacccccaaaatggttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctgcctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagcctagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctcaatctttcccccccttcagtaagagaagctttagagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttccttggacggggattaatacactagcgttcgggaaaatgtatttttctcggtcgcgacatgggcccccgtcacactgcgccatataaaagaggggtggaggccggcacggcacaagggacgagattcaccgccgccgccaactccaccctacaaaccctaatccgatcgagaggggccgtagccagtgacgggaaatgccaccgccgcgccacgacctcgccgggatcgcccacgaccaccgctgttgcagccgtcatcgccgtcgacctcaccggcgccgcatccatgacaaccgagtgccaacgacgacgatggccggcacttcttcatcctccaacacctcaaccggtcggtctatctaaatcctctcccgttttcaatctctatagttcaaacatcaatcccaaatagaaccacccgactagatctaacctttttcccgcgcgcgccaaaaggccgtgggccaccgggaaaaagtttaaattaggtccctcggggggccgaaaaagaaaggaaaggaatagtagcatttttccttttaaattttgtcaatttttcatgcaaatttcaatagaattttgaatagatttttgcatgttttacctctgtttaaatttgaaccaacgggagaatttttacagagagtaaattacagagttttgctactgttcatatgatttttatatagtttttccgctgcaaatagataaaattgatgaaaattagtgtttctaaaattaaatttcgaaccaacgggagaatttaatttttggaacattaattatgtgctatgatattgtaattttctgaccaacgttgataattgcaatgttatagttatggttatatatgttatgtctaattctgcccaacggtgatataggcttaatgcataatattttaatgttaatgttgttctcaccgtacatgattattttaggtagctacttcttgatgggttgcattaaagatattccgaccctaaaaggagataactacgcagaatagaaaagaaaactcgaccttgctttcatcttgggagaggtggactgggtgttgactaccccatgtcctatagaacctgctgaacttatcagaggtgaaaatgagtcagatggtgactggcaaaagagacagagggacaatgctcctctcgtcatgtcgtatgacattgaacaaaagaaatggtccttagccaacaagaaatgtttggctatggtaaagaacacgattgagcctaccatattgggctcaatcccagagtgtgacgctgtctcagagtaccttgaaagaataaagaggcagtttactggctcttcaaagacttatgctacacagctgatcaagcagcttgtgaccgaaaggtaccatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgaaaaactcattgctaattgtgtgcaagaggaggagagaattaaagagtcaaatggtggttcaattaactatgttaaagataacaagaaaaagaaccacaagtctcccacctcaaaagctaaacagtctcagcatctgcctcagcaacaacagttcgctgttgagaaagatcagtgtctccattgcaagaagacgggacattacaagaaagactgtcctgacttcttgaaaatgatcatggcaaggaaaggtgagaacattgttacatttgtaaatgaatctcattatgttggttactctagatccacatggtggattgattctggagcaattattcatgcttgtaattgtttaaaggcattccgttcgacgaggactacgcaaagaagagaaagctccattagagttgccaatggagttgaaaaaaaagttgaagctgttggagatcttcctctagagctcgcgaatggcttcacacttttacttcgagatgtcttttatgttccttctttgcaaagaaacttaataagtttatcaaagttggattttgatggatatgattgccgctttggaagtggcaaatgtgaactatggtataataatgcatgtattggtcttgctgtgctgtgagacgagctttatttgttatctctttttgagaatgtgaatgttgtgtcctcgttgacaaaagaaaacaagaaaagaaagagaactcccgatgtctcatcgaaactatggcactgtcgtttgggccatatttcgagggggggaattgagagactagttaagaattaaattcttcctccattggagttctcagacttagaacaatgcattaaaggaaaatttgtaaagagcatcaaaaagggtgcaaaacgaagcacaggaattttagagatcattcatacagatattgggctgcaggaat

SEQ ID NO: 3439 - DNA, 5014 bp, Oryza sativa
aattcctgcagcccgtgcaaaacgaagcacaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggttgacatacgccttatgggcaagtccctggaccttttgcaaggttcttgctagagaatagaatagtagcccagtattcagcaccgggcgaacctcaacagaatggggtagctgaaaggcgtaaccgtacccttatggatatggtgcgcagcatgatgagctactccacactaccactgggtttatggatggaggcgttaaaaaccgctattcatattctcaacagagttccaagcaaatcggtgcccaaaacaccgtatgagctatggacaggaagcgtaccctcgatagctcacctccgtgtgtgggggagtcctgcagaggctaaagtatttaatccaaatattgggaagttggatcccaaaacagtcagttgccattttattggctatcctgaaagatcaaaaggctatcgtttctactgtccaaacagttatacaaagtttgtagaaacgagacacgccgtcttcttggaagacgaaatgattagggagagctcggtagttcgagaaattgatcttgaggagaggcgggtgtctgtacccgctccgtcgactcaggaacctttcttctctctacctgctgatgttgtgcctgcaatacctgtcattgaggtactggcacctgttgttacctctcctgtggcaacaatgaatgaaaatgataaacctgttatacaggattcaacagaaatggttgccacactaggaggagctgcaacagcctcaaatagataatgtgctagtacaggagactcaacaagagcctcaggtacaggatgtgccaaatgtgcaggcccctagaaggtctgaaagagtcaaaagatcggttatccgtgatgactataaagtttataatatagaagagtcgcatatggaggatgatcacacctcatatgaagaggccatgagaagcgctcgctcatctgaatggttggaagtcatgaaagatgaaatgaaattaatgaaactaaacaatgtttgggatttagaagaaattcctaaaggagacaaaacagtaggctgtaagtgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacgacatttctaaatggagatttggaggaaaaagtatacatggcgcaaccgaaaggttttgtcatgaaaggaaacggaaatatgggatgtcgtctaaagagatccatttatgaattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaatttttgtcctcaaactttgacatgaaagacctcggtgaggcttcatatgttttgggcatagagattcaccgagatagaacaaagtatgcattgggactttctcaaaagacatatatagaaaaggtgttgaagaaattcaatatgtacagatgcagtgctacacctgctcctatagtcaaaggggaaaagtatggggcatcgcaatgtcccagaaatcagtatgagctcaatgaaatgaaaacaaagccatatgcgtcagctataggaagcctagagtacgcgcaagtgtgcacacgacctaacttggcatttgttattgggttacttggcagatttcagagtaatctaggcccagagcactggaaattggtaaagaaagtcttgcattattttcaaggaacaaaaggcctcatgctgtcttatagaagatcagaatcgcttcagattatggggtattcagattctgattttacaaaagataatacaaagtcaacatcgggatatgtgttcaccctggcaggaggagctatttcatggaaaagctcaaaacagactatcactgcagggtctactatgtatgccgagtttatagcatgctatgaggcaacggggcaggtgaactggctaaagaagttcatactcagtttaaaggtggttgacagtattgagaaaccactaaagttatactgcgacaacgaacccgcagtaatgtacgctcacagcaatcagtcaagtggtgctgccaaacacattgacataaagtactatgttgtgaaggacaaagtccgggatcaaacaatcagtctcgagcacattagaacagaaaggatgctcgcggatccactcacgaaaggcctaccacccaacgtgttcaaggaacatgtagccggcatgggtttaagggaagccttatgaatcctggactacagggcccaaaagtaaagtatatgtttctgaatagagatgtgtatagtggctgtcgaatccatcggtgattgactgtgacgatgaaacatgctctattcacaaatctgtgatggaatagaaaaagctaaaagaaatagtgagatcaagggggagaatgttagatagatctcccacccatcgggcccaatggcataacggaccttgaccgcgccctgatcgggggcatccagcccaatggctggtgggcccccgtcacactgcgccatataaaagagaggtggaggccagcacggcacaagggacgagattcaccgccgccgccaactccaccctacaaaccctaatccgatcgagagggggcgcagccagtgacgggaaacgccaccgccgcgccatgacctcgccgggatcgcccacgaccaccgctgctgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaatcccaaatagaaccacccgactacatctaacctaggtgatcctagagcaaagtctaacagtttccaccagtcatataagcctgatatgaagaaagcatgagatgcaggactgtaaagagaactgagaaatcaatttgaggagtagtatcagcaggaggagatttggctgctgccacccatgtcgagtttcacctgttggttaccgcgtgcttgtaggcgctcgatgcggcacagatcttgcagaaccaagttcgcgtgggatggagaaagagacggtatggcggcgacagtggacatcgaacttgcaagaaggtggcagcagccgctgctagctcgctgggaagacgatgacggtaaccactggctccgcacggcggcagcaacggctggctcaacgagcttgagaggaaggcagcggctccggcttcgcgagctcgaggggaaggcggcagctggccacaggctccatgagaccatgagcaggcgtcggaggatttctgggaggggaaaacgtgagacaaaggaaaaaagaatgaccagacaaccatcgtcgccgagccgtggttgtcttcgtcgcagtcgtggccgagcctacgcagggtggtggcggcggcctgctgaccccgtctgggcagcggcggctctcacccctctttagggcatcggatccgctggtaccggcggttctcattcctttctctgggctgccggatccgccggcgaggagaacggggtcactggatccggcggccccggcctcctcacggggagatccggcgactcgttggtagggagcggcaatggtggcatggcgagtaggttgagggagtggaggagaagggaggctgcaatggcggcacgacgagtaggttgagggagtggaggaggagggagctgcggcggcgacgacgcacgcgagggaaggaggacggtgaggctgcggcgcgattggaggaggtgggcaaggcggcgtgcgtggggaggagaggacgggcggctagggtttgtactggctgaagaatccagaccatccgtttccaatccaacgatctgacgatggtggaagggtagtcatgctgggacacgtggacggtcaaatcggccttagcttgtgatccgacgggccacgttaacggggatgtacacgctattagcggaaagagcaagggtttttctgaaaaaaaaatgatgacgtggcgccctaatcctcagccattcccacggcttttaagtaaacaaattgctcatgttcatgtacttgattccatcatcttcagaatgtgttttaggttctcccttttctccctgtaatgcattggcgcagctagtttgaaattatgaatgttagtacctgacgtccctgtactgcatttgtgcagatagttacctgacaatgttctactaactgaatagcaatgtgctgtacttgacaaaagaaaagcctcaaacctgttctaagcaaatgagggggtgtttagatcaggggtgtaaagtttttgcgtgttacatcggatgtttcatgggatgtggcatggggtgttcggatactagtgacaaaactaattacagaactcgcaagtaaaccacgagacgaatttattaagcctaattaatccgtcattagcaatgtttactgtagcaccatattgtcaaatcatggagcaattaggcttaaaagattcgtctcgcaaaatagtcgcaaa

SEQ ID NO: 3440 - DNA, 1365 bp, Oryza sativa
tttccgcatcatagccacatctgccaccatcatcacctcttcttcccttccacatccctgggtttgtttggcaaacaaagaaacccttctaatcgcttcggataggtttggactgatggggatatagatattccctcatatccaaacaaacctaaggatataggctgagatccatccctctctctcgaaacagcaattctctcccaaatgccacccctcatcatcattgtttggataggaagagattagacccaattccttcagatagtgggaactttaattccatttatagcccatccaaaggcattaagcctaagccccaccaattcaaacaagcctttccatcagttaaaatggtaagaagtgggaccaactaaccacccatcgcggcttcctgcacccaccaaccaaccaaccaaccaacatgttttaataacccccagctcgtaaattccaattctcttctaccaatttcctcgagccaaaaaagccaagaaggtgatgtacaagccagagaaaaaaaaggcagacaactagatgacttaatctgggtgaagagaacatagaaccacaaacacaagtacatcaaaaatattaatagaagcaactatagagtagcagcataaatagatagtgtacaattagcttacagacaaaaatataaataacaaagaaataaacgccttgtacctacagtacaaagaattggaatcaagttgggaaatataagcaccatacctgcctattatgaacatactccagatacgaagggacatctggataacgcatttgagtgtcactatcaggtataggtgatttttggaaacagatgatgtccccatcttcaagctacaatatttggagcattttgcaaatcaataagtgtttaattcaaatttggcattccttaaccaaaagaaacatgttataaacctgactagcacggaaagtggcttttttgtcaatatgttcacacatcacatttggctcaaatttaatttcctgcatgtaccaatgaaacacaacataagtacagtcaacttggtaaggcagtcgatataaaacttagcaattgccactccaaagattgacacttaataatttgccactgaacgccagacagatatctggacctactcctagaacacgcctcaatggagtgacatatactagattatcccataaatatagcatcatgaatttagctcttgcctcgtagagctcaatttcttcatttggcacaaatccagccatttcatttagtttggtcaagatttctgagggttttcccaaggcctttacgaagagcctccccacaaaactgcaatcagtgaaagaatgttatgtgtcagccatttgtgaagg

SEQ ID NO: 3441 - DNA, 1554 bp, Oryza sativa
ttccaatgctacgaaccaagaacttgtttgcacaccttaccttgaaagtggtaaacagtaactgcttctgaattcggaagctacgaactttttcatggtccaccaggtcaaaatatatatccttgccaatttgctccttcaaattctcatctcgagccacctagatatatttgtccaaacagagcactatgagaaacagattcacagagaggttccagactgagatgaagtgatgaacataatagtagtcagatgctgacctttatgatggtataaagatgagcttcagccttctctttctttttgtgttctttctcttcttgttctttcttcaaccttacctgaaaatccacagtttatcatccaaactgtatcagaagtccatgacattaaaagggagaaaaccaggaaataccatcgtaaagatatgcagattgtaaaatatcaccacatatgagaatgacccatggggcctgggcccacgtgtgttgacacatgcgatggtattttccaatcgtggtatcgaggaaattggcccaaggaggagtgagaatgcaaacaacacatacccttaaatgctcagcaatgtccttctcatcaacattacacattattttgtccttatcactctcacggatgtagacaagcatgtaggcatttgaacacttcgtgaatttaaatggagcgttgttgaaaccaggatttatttgaggcaactgttcagcccaaaagagattaaattcgaaacaggcgacacgcaaaaagaggggggtaagtttcaaatatcctcatatcattcaatatccattatcaggtagaacacacctcttcctcacccccgtattgctcttcaagggccttcttagtatcttctttagttacacgctcatcatcaaatttatacctggtagacaggataacattttcaaaaatctataatgaattgggaactgtttgctaggatgtaaaattcaacaagcatagttcgacaaaaggcataatcattgtagaattaattataatgcgaggatattgcacttgtttccaggttcttcaacagaaatttgcatgaggtagcactaaacctaagaagatttattggcaactcatttgatgcctaatatatggtattcagctggtctatatgcaagttacctatattgttcagcgtggttactccttcctaaaagggaacttggcattcacttacaataaaagtgcataaggcatatgattttcctcctgtaatctcacaccacatacttcttttgataagtgataactgatgaccatcagcttgaaagaagttattgaagtccatgctagtcaggtgcttattagaaccaacacagaatcctataaccaactatattatgaaaaagtaacatgttgaacgtgacatgagggccttctgtccagttaagagaacttatgtaaatttgttagtgtgtaaaaacgtcccactaacattggctaactctagttgagatatgatattctcttgtgtagaaacacacactctaatatttttttggaaatctgcctcggaaatgc

SEQ ID NO: 3442 - DNA, 378 bp, Oryza sativa
gtctgggccatctacaagaactggtcaaataagtgggttccttcccgcagcactcgtggtactaagtatgctattggcaagatcgtcgactccactgaagctttcacattatttggttatctgactaaagttgatggttacatctctgtgttcaagcctgatgtacgaaggggaatactgaagattcctgtgaaagagagcctgaggttttctcatcgaataccatcgttttgtctgacaaaagagaaaggtggaaagctccatgactgctacgagctcgacccagctgctgttcctgacgtttttctacacaaggattgaaggaaaagaactcccacaaaaaaggactaatctgcagaaattaagagtgaagaaatc

SEQ ID NO: 3443 - DNA, 10506 bp, Oryza sativa
attcctgcagccctacttcatcgtagtcatctagtgacaaaaacacctcatctaagcatgaaagctcggtgccctcaccgtggaagctcacttgtgaaccgcagctcgattcgaacactcggcacagcacccagttgttggactcctgtaatgatcatgcataaattttagtattttgtgctccagttactccttatacgcaatttactgaactgttgactgctgatcgagcagcaagatagagaggatatgcatcacttaccatgcttgagtggcctctcttcctatgagacctcctgttagagctcgagctagtcaagttgctgctaccgccagcgacgcaatccccgtctagcagatggtactcatgcatgatccagttggttctgatgccttcagagggctctccaatggagaatagcagcgttttcttcaagccaacattgcggccgccgcttcttactgtttcatcaactccaatggggctccagtgcccattggatgaggtcctactttgtgttagatggcagaagaagtaccactggttcccagcttgcagtgctttgccttaaaattgcaatttctatcagcactcagcatgacttgtaagagaacaaattagtgaaatcatattgatcaatgcagttgcagacttaccattcagctcccatggattgtaccgatgcggaagcagcgtcgggatgatgtcagggtggcatgggaggagggagaccttgcgacggaggaaatggacgacgagctcttcatccgaggggaagaagtggaaacctggaggtaagtttgtagctcctcccatgctacaactacaagtgcaacttacaaactgcagtcaaatgcaacttggctgggatattgatgaatttgaaatgggaagcttgctgatcttggtgagcgagtgctacttatagggagcatatgtgtgtgattgtgtgaaagagtgagatgtagagagagagagagagagagagagagagagagagagacgtgcaagtcaaggagtgctgagtgctgatccgtaggaggatggcagccaagcgagggcgacattttgcgatgcttatattctatatatttctcttttcttctttggagggaaataatgatactatgaggagacatttgttggatcatggattcatgatgcactgctatgtacccgttggctgcagtagtgtgcagagatatatattagtttttcagaggggggcagaaataataattgaatcattccatagtacatgcatgataaaagtgttcatccagcagcctgtgatataattgatggccttaaggattgttggcttatattagatctcagctggtaggtatcagtacttttttgttgattagtcattacctcattgaattggattttctatcagcaatttctttaagcctgtattaattacttactgtatagattattatatcaagtgtttgaagttttatcaagtgataaggttttcacatgagctgattactacattgtgacaggcactccttaatgtacattccccaaaacctcagaacaaggtaatgtgacaggcaacatctctagtgcagtatttcttttcatgatcattgcgtatactatttgtttcccccctgaccattgcattcttgctcatgtcatgcaggcgtcacccttctcaagccatatgcaccttgaccacagccagccattatatacacgagtgccagcaagcaagttgcacattttttctggacctgtgtggcaaaagtacaagggcatcacttgaagaagaagcaacccagatgttgtcctcctgttgtatacattgctgcgtcagaggggtacactaatcattccaaattattcatgaatcaactggggaaaattcttatctgccttggcaggcacaataattatcaggagaggatcacctcacctgagagtgattaactagaaaaatgcccagttggtgaaaggactccatgccatcaagttgcatcgatctcaagtggtaagagtataagaccccccccccccccctccatctttcttggtagaaagtttaacaatctcatgatgaccacttgtgaagagatccatcaaaggaaactgtggttcgattcaatcccgattggtttcagatgcaagaagatgcttatctcgataagattaaccaaaatgagatcatgatggccgaatcttccaggaactctcacacaactcctctgtgctgctcccaggaaaagatcatggtggcctcatcattccaatggtgcggaggcagccccccctcgctgtcgctcgcacggtttctcttgagcctctatctttctagctcttggatctctttagtttttttttggctttggctttatcttttgggatcatatgcatgctgtgcttctttgtggcagggcatgtccgccactggaagccggtgctctgctgctgctgctgccggggggaatcaatggaacgccattgccgttgccagcacacgtgaggcaaaacctaacatctcctgagtcctgaggggggtggtgggccccacctgtcatgcagagcgtgggtgacccggccccaccacagcacctggtgctggtggtgatgacgtcgtgctgatgcagttcggtcgaggcgcgcacattggccgatgctgtgggggaggagaatgatggagatcctcattcttgttggcacatgctcaggtgcgcatgcaggcgtagtgtactgcctgcggttggttgtggcatgtatcatttgatcatcccaactctctagccttgtagcctcgaggtgatgttcttgacttcaaaaacccaacccaacctcgttctgctgattagtttcgcagatgtgaacatgatgacgatgatctattgatctagtgtgtgttaaagtaacatttggttggtgttttgcaggacgcagtagttcttctgtctgaatgagcaagattgcactgcactgttcattggtcaatatcagatttgcaattaccatcagattgatcaagtgggagtaaaaaggtggctggcacaccttggatgcttactgctggtggtgaaggatgagaaagaggagggcatacgaggccacattctgccaatggcacctgagctatgcaaaatatgccgctcgtgggcaatgtgaggcacacattttgcatcccgcattcctgcctcatcggatagggcggaacggaagggatagaaatggttggatggatggataataccttgtggcagtcagtgttgctgctgcagcagcagcagccttcctccacttccaccaccggcgccacaagaaaagacgacgacgaccgacgccgacgccgacgcgtgcggcaccagccgacgatcgacgaggtgataccgagcttggtgcggtggtgatggcgaattgggtggagaacgaacgaacgaacgggagagacccaaccacgaggatagtaactactactactgtctttcacctgttgccttgcagggtaaaaaaggggctcttcatccgttggctagtttctccagctactgcgtgtctacatcaccagtgacgcatgccaatgcagtgcactccagtagtctcctacgctgctcttgtgcaaacttatttgctgctgctacgacggaccacatcggtttgcagatttccttgaattgaagtactcgactagcgcatccatcatctcgacgttgtggcgaatcgaatgaatggagttagctcctcttcaactattgctttagccggttgctgtgttcttgtttttcttgtctcttgcgtgcatcggtgcatggtgttcttgcatcatcagatcatctccatagtgtttgctatgctagcttgttccggctgcttcaaatggttccaatactccaatccactggcctcaccaccacccaatggtaaagctgctctgcccactcgctgagttttcttttttttttaaccattttgcaacgcacgcgcaaaatgtaccaagcacattattgttatctgctcaaatggaccatcctcatacggcgcttgacattcagcactctcaggcacattattgttccatcagattttccttttgtcgccttcttcaaatgccttgtgaagctgtgatggacgaagtaaagtagaacgagtactccaaaattcttttgcaaatcctcctaataaaaaaggcattaaatgtaacatgggcgtaatcttcccaagttgcatgccattgatagactgaactagacatatatatatatgccttcatgcttgtcaattgccaattgacgacaacatattcttcaactccgatctgaatcatccactgcaaaattcagtcaaacttcgcacacaaaaattatattatatatgtactctgaacgttcaataacaaagactacaaattacaaagagtggaaagctgaagacttctatcctaccaccttcccaaatccaaatatacgatcatcgtggcaaagattggaaatcaacacctctattgcagaggggggaaaatgagtaaatgactcagtagttgattcttcaaactcacaaattgagctggatcaggcaattgtaaagctctgccgaggcaatggcccaaagttctggactctgaatttgtcctgtcagttgtcatcttcaagtgaaaaattgatccttcaggatgccaagttccaaacgaatcaaaatcgtacgagtttatttgtgattgcaatctcaaagaaacacaataaccacattttggactctgacgctcctttgcagcatccttgaaacacaccaccaatctgccataccaaggatgctgaaggcaaatcagtgggcttcatccctcatgcctgagaccaatggccttgttcttgcaatgctaaagcaattgtttcattccagaggatgtatctttcagcacaaaacaaaattgccatgcttgtcctcaacattaccccgagcacgtgatgaaaaagcttgtccagcatctcatatatttcatttgcgtcacagtgagatgtgttagcagcgacaaacaagtgtttttctctctgcacctctatccaactataagctcctcaacattaccccctataatgaacatgtgatgaaaaagcttgtccagcatctcatatatttcattcgcctcatggtgagatgtgtcatcggcgacgaacatgtgttttgctctctgcacctctatccaactataagcttggtccttcctcaatcctttccccttcatgagagccctgacctggcgggcatcgtcccactgtcctgctgctgagtatatgtttgacaacatgacataccgaccactgttctcaggctccaactggaacagggcctcggcaacttcttccgcgatctcaatattgccatgaacatgacatgcaccaaggagggccccccatgacccagttgtacccagaccgatcttggaggacaagcctttgatgaactcacttgcttcttccagctggcgattccgaccaagagcatcaatgaaagcggcgtagtgttcagctcttggttcaacaccatggtcctgcattgattcaagaatccggcggccatcagagactagaccagcatggctgcaagctgtgaggacagcgagaaaagtgacataggttggttgtacttcatctttaagcatcctctcaaacactgcaagtgactgctttccctggccattgtgcgagaaccctgtcaccatggagttccaagagatgatgtccctctcaagcatcctgtcaaacaccgccatggccgctaccatgtcgccacacttggaatacatgtcaataagggcattgtggatgaaaacgttgaaagggtctgaaccgatgctcctgcgcaagatgaagccatgcacttccttccctcgggcgacaagaccaaccttggcgcacgcacccagacatgacacgagggcaaagggggttggcactaccccctcacctgtcatcctttcaaaaagctcgagagcgatctcctcctccccattctgctcatgcccagagatgagtgctgtccatgctatggcgtcctgcgctggcatcatgtcgaatacttgcacagcatcgtcaagcatgcttgcccggcaataccctgcaatcatcgatgtccaagaaaccgagtcacggatggtcatctggtcgaataccccccgtgcatcctccaccctcccggccttgctgtaggcgtccaccattgcgttggccatgatgacagtcacctccatacccgacaccaccaccgcgccatgcaactcgcggaggtgcctcgcatcccggagccccgcgcacgcgctcgcggcgctgaccaccgtgaaccggtcgatggccacctgctgctgccccaggcccctgtccctggccagctgggcgaacacgcggagcgcctcagactcgcggccgtgacgcgcgagcgacgagatgacggtgttgtaggagacgacgttgcgggaggcgggcggcattccgtcgagcaggcggagggcgtcggggagggtgccgcggccccgggccagcgccgccagaagggagttgtacgagtgcgcgttcttgtgcgggaggtcgtcgaaggcggcgagcgatgccgccggggtggggagcagcgcgtagagcgcgacgaggcggttggagaggagggtgtggtgggtgagcgccgtcttgacgaggagcgcgtgcaccgccgcgccgaggcggcgcacgtcccccgcggagatcgcgcgctccagcagggccagcaccgcctctactgtgacggcggaggcggcggcggcgctggccggagcagccgccgccgccgccggccatggcggagtgagaaggcggcgcatgcgcttgcaacgagcagccgcgacgacccagaaaagagctaaagcccaccactgtgccgttgtccgtgggcctcgagctgtgggctctgggccgtgggccgtcaaagcaatcgaagagtttatattttgtgggccaagtaaagccgtctcgtcttgctgttctagaagatttctcttcgcgtcgccggcgctgacaccgccgccgccaccgccatctccggcgaaaaccctacctgcacccgtccagcgagcgccaggaggtaggctctaccgggcggaggatggtgttcgggcaggtggtgatcgggccgccgggctccggcaagacgacctactgcaacgggatgtcccagttcctctccctcgtcggcaggtgagtagctcgtgcttctgctgctccaaccctcgcaagctactcccttcgtgctcgcggttccggtgctaggtgtttgtttgtttgtttgttccaaatttctggtcggccttgcgttctgttggttgcagaagcgtattgcttacctcctgggcatggactcgctatgcagttcgggtaggaatttgtggaaagcaagaactaggtcgcttgattcagatagtaggtagatttcgaattgagtatgccggctttatgccgatagagagagaaggttgggagagtgaggggagatgggcaattttctcccatggaggcagggagcttgctcatggaaggtttccccaacttgcaaatttgcaattatgctaaatgttttgacttatgtgcttcactgttgcgttgcaggaaagttgcggttatcaatctcgatcctgcgaatgatgtgttgccgtatcctctgcactttgagctctgaaatgctccatttgccatattatcttgtttcacttgttggattgttgttctgcagttaaacctgaaatgtatccttgacagcggtgattaagatatgaatgcgccataaacattgaggacctcataaaactgagtgatgtcatgtctgagcattcgcttggtccaaatggaggtttggcccagagccccagacttcaggaatcaaacctgttatttcttttgtatgttcgcttatggtatgctgttgaaatttgtgtcaggccttgtgtattgcatggattacttggagaagaatatcgactggcttgaggaaaagttgaaacctcttattgaaggtcggtataggctggctttctttattaaaaccatatccatgagctgcagcctggaagatctataaaatggagatcttctatagaagtcatgatctcatcgatattgttcgcacagctgataaaaaaattgttgttatggtgcattcagagaaaaatgtaatatttggtcaatttcaattatttccttttcaaaatggtttactcacaactgtttgtttggtctgaagtcttaactttttgcagttctagaaaagtaggacccaattaaagttatagattttgaacaattagagctcctgggttccattattctgaggattgtgtttcagtttgttcacaagtacaccttttgtttgttgagctagttctgaaagatcatagtaggggttactaaaatacctatacagatactgctttattgtcatgatttcctatgtgatttgctcaatggtggtgatgatttctgcagatcactatctgttatttgatttcccgggtcaagtggaacttttctttctacactcaaatgcgaggagtattatttacaaacttatcaaaaagctaaacttgcgggtacaactgtgttaaatcctatccagagttcattgattatgtaatgaattgcgttgcccacaatatttcttggtattctacagctgactgccgtgcaccttattgatgctcatttgtgctgtgatcctgggaagtatgtgagtgcattgcttctttcactgtcaacaatgctacacatggagctgccacacatcaatgttttgtcaaagattgacctcattgagaactatggaaacttaggtactgctttacctgcagcagaatttagttgattattacatgtttctatttactcatcttttttgttggcagcattcaacctcaacttctacactgatgtcgaggatctgtcttatttgcaacgccatctagatcaagatcctcgttctgccaagtacaggtaaaacataaaaatccaagcagcaaatacataactttactgcctcaaaaagtcatgcatatgcagtccagcatacttgcatagttacattgcacttattgaaaccttgttacttgatcaaattagatgtaattaagcaggcatttccagttctcttgggaatattgtgaaatgtgtgtgcagtagcagtacccttttgtccatttctttgtttattgagaaaccaaaggttgcaactaatatatttgtgcaaaaaatccgatgctcaacctgtttaagattaagaatatgtacttgggtaaagttgaaaaaccaaacacaggagttgtgaatgcatctattgtttttgcttcttggggattgatagacgatcatcctaaatcaatgtctgttaacatagcagtgtgacctgttatgaagtgagatgcagtaaccctgggaatcatttaattattcaaatcaaaatctctgataatgttgctcttatgcttggatttcacctttgtaattatttttattgcttgggttatttataatatttttgttccatctgcttaaggaaacttactaaggagctgtgcgatgtgattgacgattttggcttggtcaattttacaactttggacatccaggtacttacttgaaagattcagttatttcaattaagatccctgtgaacttggtcttacaagttgtttttgcctctaggacaaggaaagcgtcggcaatcttgtgaaattgattgacaaaagcaatggctatatattttcatctatagacagcagtgtcgttgagttcagtaaaattgcagcagcgccacttgactgggattactacagatatcctttactgtctcttctagcacctagcttattcaaacaaatatctttactctcataccttaagttattttcagtgttctagaagcactctattcaaatcacccctctggcacgtacaggcataaattattacaatatggaacaacactagaatggaacagcactagaccaccttacatagcaaatttatggctgtgcaacttgccaattttcacatggagcctgtagtatttgtggcaatgttggtattccagactggtatttggatttactagtgcttacccttgaaggcaattcgcatgcctgctgtatgatccttggatgctgctttactgttttttttttctttctcttgtccatgaaatacatcactattatagcccccttgcacctttccacatttccttttgttccttgacatgtgactacaacagcagaggtgcaggagaagtacatgaaagacgacgaattcgtgcagaagacaagcaagacgcgatgaaactgaatttgtttgtaatgcttgacatgtgaccttgctatgcttgaatgagagctccatttgcccccatgccgctcaggtagggatgtaacatgttgtgacatgcaaactggaactgagaaatgtactctctccattttaaaatgtttgacaccattgactttttagcacatgtttgaccgt

SEQ ID NO: 3444 - DNA, 23894 bp, Oryza sativa
ctgtcacatcgttctaatttcaatcaaactttcaattttagcgtgaactaaacacaccactagtaagtcggatctggtcttgccaccccaccagtttccaccagggtttgtatttcggacgacaaccgatcaaaaaccacgaaagtagatacccagtgaaatttcaagtggtttttgataattcaattttgaaacagtaaattttagctaaattttcgatcaatactgggtgttagagatctcacctggttaccacaaagtatcataaagcacacaagattacaggcagtttttgcaatggtataaacaagagtacaagacaagattacaagcaggcagtttttgcaaggttttttgcaatggtataaacgagacaagattacaagcagtttttgcaaagatttaaacaaggggatcatgatccccaatcttcaaagtcatgtaactttatcattgacatgtggatccgatgaaccattgactcatatgtcaataactttaaatatagaggatcttaatccattggatccacatgtcataacaaaagcatagtaactttaaatgtagaggatctaaattcatcggatccacatgcaaaagcatagtaactttaaacgtagaggatctaaattcatcggatccacatgcagtaacaaaagcgatctaaatccatcggatccacatgtcagtaacaaaagcacagtgactttaaacgtacaggatcttaatccggaacaaagtggcacagctattttgtctgctctgatccggagcttctgacctgtgctcaccaccagagttttaaaatggaaagcttgcatcaggccacgtggcgttgacaaagaaccaatcccaatgtggccacgagccccggccacgccgccgccgccgccatggccatcaaaacctagtgccgcctcgcgcagcgcgctgcgtcgtttggatctcgacgacggccggcgccaaggcacggagggagaagaaaaccacgcgcctcttctgtgttctccggcgatggcgagctccacggcatttgcagcggcatttgcgctgctgctgctagcgtcgtcggcggcggcggagggggaggcggtgctgacgctggacgccggcaacttcacggaggtggtgggggcgcacgacttcatcgtcgtcgagttctacgccccatggtacgtacattgtacaggcaaaccccattcctcgccgccggttcggcgccatggcgccttgctgattttgaccttgagctcagctgaccaaatcctcttcgccgccgccgcaggtgtggccactgcaaccagcttgctccggagtacgaggcggccgccgccgccctgcgctcgcacgacccgccggtcgtcctcgccaaggtcgacgccagcgccgacctgaaccggggcctcgccggcgagcacggcgtgcagggctaccccaccatcaggatcctccgggaccgcggcgccaggtcgcacaactacgccgggccccgggacgccgccggcatcgtcgcctacctcaagaggcaggccggcccggcctccgtcgagatcgctgcctccgcctcgccgccagcggccgactccatcgccaacgacggcgtggtcgtcgtgagtttgacctcctcttctctctgcatcagctgtttatgcttatacttacaagctaaaggctctcattggatggcctaaatagtcaaagaataagtcaaattttaaattttcaaacttaaatttaagattgattttaagatatttttaacgtaatttcttttttaatattggcttttaagtcatcaagaacatatatatatatatgaaagttttatctataaatttatttttatcccctaataagctgttttggcttattagggaaagagccaaacgatgggagactaaaatttaattttacatttgaatttttggttttttattataaatagcatttacttttttaagtacatttgattttttgttttttaattataaatagcatttacttttttatatgtatatataaaagttttactcacaaataatatttttatttacaaataaagtgattcggataaacatacaaataagcgaaacaatgacccgatgcatcagtcaaatactcttgctgatgcaggtcggagttttccccgaacttagcggcagcgagttcgagagtttcatggcggtggcggagaagatgagggccgactacgatttccggcacacgacggacgccggcgtcctcccacggggtgatcggacggtgagggggcctctcgtccgcctcttcaagcccttcgacgagctcttcgttgactcgcaggtacactagctgaaaattaatgctacagagatactctgctctgttttgatccctccaggggaggggtatctctgtattcttgtttgcttaaaatcatccaagtagttatgattcatgaaaatttctgtaaaaagttgacagcgttcgtacaaatacatataccacctctaaaaaaatgtaagatccaaactcaacttacacattgatatataaaaaacataaattcggtatatgaataatagggtagtggtagtgtccatacccgaatttatctttttttttcaaggtgcatgtcaaatttaaacttaatttctggtgaatcgataaatatcattatactttatattgccaattttttcaaaaaaatttacagctatttacaataaatttggaacaaaaatatacacgaggggatatgaatatcctccaagggattagctagtagtagctcacattttggataagaaatggacagaaatttggattgcttcttgtttttatttttcaggattttgatagagatgcgttggagaagtttatcgagtcttctggtttccctacagtggttacctttgacactagtccggcaaaccagaaataccttctgaaatacttcgacaatgccggcaccaaagtaaggacagacaattggttgacttctcactctgtttgcctacactggactgtttagcttgttgtttaggccatgattgcctcttatcatgtgcacacgattttcactgtctctcatgttttatttcaatgtgctgctggaatccataattgagaatgcaactcttgtctcacttggtctgatcatctgttctttctgaacctgattttgagcgtgcaggcgatgcttttcctgagcttcagtgatgacagagcagaggaattcagaactcagttccatgaagctgcaaatcaatacagcgcaaacaacataagctttctgattggtgatgtcactgcctctcagggtgctttccaggtaatcttttgccttcttttttccataacaatctttattagtacattgctttgccccaacatttcgtataaaaacaatgtccaagagttgaaaatgcctgctgtctgaccatttttgaatgcacaatgttccagtattttgggcttaaagagagtgaagtgcccctcgttttcatactagcatcgaagtcgaagtatatcaaaccaactgtggagcctgatcagatcttgccctacctgaaggaatttacagtaagccaatttctgaactgacgctattatcctcttcctcgtttactaattccctgatatatattctgtgggttctttaagtcgcttgcgtgatatttagtctcactattttatactagggactatgaaggttacttattattagtactacctctttttttaatttctgatgctgttaaatttttgggataagtttgaccatcgtcttattcaaaaaatttatgtaattattatttatttttattatgacttgatttatcatcaaatgttctttatgcatgatttaaatgttttcatatttgcataaaaaaatttaaataaaacgaatggtcaaacattgataaaaggttaattacgtcatacattaaaaaccggagaaagtttcgctacgtgcttagtcagtttgccttgattttctttatgcaggaaggaacattggcaccccatgttaaatcagaacccattccggaggttaacgatcagcctgttaagaccgttgttgctgacaatcttcgagaggtggttttcaactccggcaaaaacggtatgttcttggctacttgcttgaagaacttgtattaattaccactcgacctgttacagaatgcaagatgttttggtttttgttacaagcaattttttttcaagtttaaccgagtacatagaaaatgtagcaacatttataacaccacattaatttcattaaatctagcgttgaatatatttttgtaatatatttttttagtgctgaaaatgatgttacgtttttcttaaacctggtcaaactttgacttggataaaatcaaaacaccttatattaaagtggaggaggtagatatttgtttaagttatgccctgcatgcctgatgcctgcttcgtcgtcaacatcttaaccattttgttaatttgtttgctcaagctgtcaaaacataagttcggtctctgttttttttttttcaaattccttttgcagttctgctcgagttctatgctccatggtgtggacattgtcagaagctggccccgatcttggaagaggttgcagtttcattgaaagatgatgaagacgtcgtcatagcaaagatggtaatctaccctacctatgagctctctccattgcttggtccatgctggccttgtcaaagatatgattgaaaaatgccttcatagcatgcatccataaaccatctgatctatttatttcttaaaaaaacaaaacaaaacaatcagactgattcattttattttttttagaaaaaaagcaaccatcaaattcacatgtcatgcctggggaaaaaaaagactcaagtttgacattttttttgcctcaaattcaacaaaccagattattatcagaacacgcgcgtttctcaccgttcacctcttgaccaattcgtttgccctgaattgcaggatggtactgccaacgatgtaccgtcagatttcgcggtggaggggtacccaagcatgtacttctactcgtctggggggaacctcctgccctacgacgggaggacagccgaggagatcatcgatttcatcaccaagaacaagggctccaggcctggggaagcaaccacgactgaatctgtcaaggatgaactgtgatggccacttggtcagtgattcagcgactccaagttttttttttttgtttctttaccaaaagagagctgcattttgcaaaacactgatttattcaggatgaattgcaatctaaaatcatctttgtattattttttgtagggggagtggggagcttcaggttaggaggtgcagtgcagctgacagcttgaggacatagctcagtactgaatttaatcttgtattcgagttccaggtttccaagtacatgtagcattaccaatggtttcatacatacatgtccccccccttttttttttttgcaccgctgaaatctgttattgtaacatcattacactacatcgaataatccccattttagcttgccaaacgagtaactaaaatccctgtgtttctgaaccgaataatcttaccaaactgaaccaaaaaaaaaaaaggacagcatcaaatgtccctgcctttctgaatctctgctgctccagagtggttggcgttagataagctctctcgttacagccatcctgtcctaacaaagtaattaagcatgtaaactttgttcctttcttctttttttttttgtgtgtgtgtgtgtgttgtcaaaagctatcatcctaacataatgtgaggtcccatggatgatgattgtccacaaggttggtggcgatcgatgctgcactgcaatttgcaaagccgtgagagagatgagatgagagaatcaaagccgtacgcgcggctccgctgttgcaatcaggttggtcgttggctgtccctctcctttttctctcctctctctctctgctgatctgctgccttttggacagtgcatctctgcatgcgagctcagcactagcagcagagcagcaaggctttgcacttgcaagctttttttttttttttgggagaacttgcacttgcaagctgctctccctttctatctccactacttctcactttccaaatttccatatcaatgtgaatgatagtaataataactaattgcattgtctggttgagctatctgccacctaatttaatgaccaaatggtccgctttattaatcgactgcgagtacactgttgcactgtcgcactgttacatatatatatccagatttttaacattagtaacttttgttagtggtaaggtactaaggtcttgccttttattattatttttttctttctcttcagttaattcgattttatattcctagtctttagatatgtgatctggtatgtggaaaatgccacttgaaggatgtaaacaaacatgtacatactgctagcgtgcaacttacaaatggggaaacaaaagcaataattttcctcttacccagaaaaaacaaaaccaagaactcctcaacatttataactgaatttaaatcctaatgttgactgtacgatcgattatgcatacatggtgtgcatttaattttgaaaaggaaaaaaaaaacactgagctgagctccagaagatgcttttaattacacacagtaggttaattaattactttgccgcgaatgtatgtgcggcgagagaatagtaattaagagtaagctagcgctaatcatggcacgtagatgctcccgtggcggcgatggtggtggcggcacggcggcgccggcgacggcgacgacttgtcgacggcgaacagcttccggaagagcctcagcagcagctcccaccccgtcgtcgccctgctcccgccgccgccgccacggcggccgccgtagaactggcccacggcgcccgcccgcgacgacgccctcagcatcgtcggcgcgcacccgtacagccctcctcctcctcccggtggggacgacgacggcgtctcctcgtcgtcgtcgtcgtcggccgccgccgcgggtgacggtgacggtgacggcggcgtcccggccgccgcgcgctgctgctggcggcgccggagctgaagcaggagctcgtcgttgaagtcctcccacagcaggtccatcctctcctcgtcgccggcgcgcgcgtcgcggtcgcgctcccacagctggtccatccgctcctcctcctcctcctcgtcgacgcgccgtgctgctgctaccggcgccgtcgccgccaccgcctggccgcccgacgccgcgtcgtcgtcgtccgccgtagccatcgtggatgagaatggccagaggaggccgccctggctgctcggtgccagcgacgacgtcgccgccgccgccaccgccgtcgccgtcgccgtcgccgccggcgcggggaacgtgaagtcgtcgtcgtcgtcctccatggacgaggcgaggcgaggcgatcgagctgctactgttgcgctctgacactagacactgctaagtctcgcgctgggtttgtgtattgaagtgatgataaggttagagagtggaatagtacgtggacgcgattgggtacccttgccttgtgttgttgtggagttgggcaggtgacaggtagctagcgccagtaatgctagatttggattgtagttagggagagaatatatgtatacgtatgggtggtattaattactcccccgtatctaaatatttgcgttgatttttttaaacatatttaatcgttcgttttatttaaaaacttttgtaaaatatgtaaaactatatgtataaataaaagtatattaaacaataaatcaaatgataggaaaggaattgataattacttaaaatttttaaataatatgaacggtcaaacatattttaaaaaaagtcaacgacgtcaaatatttaaggacggagggagtataatacagattttatttcatttttcgtgttttcgttagcaactttaatttttttttcaaacttttaaattgtatgtttcgtatgaaagattttttaataaaaattaatttaaaatatcaaataaatttatttttaaagtttttaataattaaaatttagctttcttgttttatgtgttacaacattattttcatcttactagcaaaaatacttgtgtgcaacacgtgaagacaattttcacgattgataaaaactctatcaatttaaatgacaaatcctaacgagacgaacaaaataatggtaaaacaaaatcagaaatcatatattatagcattgaacccggctgtatttatagcattgaacccggttgttgcgcttgcttcatacgtcatcacacgaataatctcttacgtacagctttccataacctcacaaatcaatcgggtggccattccataaatcgatacctgggtattttactatgcctcatcgaccatatattgaaatttttattatttagttagtgaaagtttttttactgtagattgaaagcatttataaagtaacaaacttgccacatatacaccttaaacaatgataactttaagaaaaatattgatgagaagagaattttgaaagagaaaaggaaaggaaaaaaagagaaaaggatgagaaaacagaagagggggaggagagggagaggttcatgatgatggagaaaagaaaaggagaaaaagaaaaaaaagagagaaaaaaacgtcgatcgaggcaggggtgcacggaacggggtgccggtgggatggtgtgggacggttgggttgggctaggaggaggaggggatgtacaatagttgttctacttatgtcgaattaggtacgggtgatgtacaaccaactcaaaaattaactcaagcacggattacgtaccaaaattctgacaaaaacgtcatcaatttctataatactagaaaaaaaatactcgtgtgttgcaacaggtgaagtctattttaatcttattattgttatatggtttagttaagatgaaattcacgatcttaaaaaccgactcaaatacggatatgtatttccaaaagcaatcaaacttaaaaaccgacccatacacgaatgacgtaccaaaataccggtaaaaacatcttcatttttataatagtagagaagagatatagattaaaaccaaaacataaaattaaaaccgactcaaacacggatgatgaactacggaaatatcttcaatttttataaccggctcaaacacggatgacggaccacgaaaatatacttaatttttataatagtagagatttgaaaagaagaagacgaccatactatagcaccaacagtatatgatatatcgagagggctatttgcgcttgacggagcgtggggctcctcaccgggagaccgcgcaggccccctttgccggttcggccgggggcgctaagtgaggttcttcgccctcgatctgaggaacgtccgcgagagaggaaatgcacaagacacgggcgacgtagacaggttcgggccgctgagaagcgtaacaccctactcctgtgttctggtggatctgtgcgtgaaggaatacagagagccggagagcgagagagagttcaggctctagcaccccttcgccagagtcccaaacctccttcctcttttctctcctctccctttctctcctaggcctgggcctcctttttatctggtcaggggtcaccacaagggcctacagctacctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcattattccgacgggacggggcgaggcgtgtgacaggccgcctgttgccacctaacccgcgatctgaccggtctgcgaccggtcacacaccgcgaccggtctcggaccggataagcgcgcgctgcgccgcattaaatgcggcgtggcgcgctcgtccaacctgctataaatgcggttaggtgagcccgctgtgctcacctaacccacacacgtggcgccaaaaccacagggggtcggggcgccccagccctcggggccgaaacgggagcggtccgacccctcggggagacagagggaggggtggccacgtcatcctcgggcccgacccccccccccccgagggggtcaggccacgtgggtgaccgcggctacccaagcctctagtcacgatacccccggccccatgtcaccgacagcgctattggcacactcttcccttcctttgtggacgaaatgttttccttttcagatgaaagtttcaagttttatgccaaagcacacaatatataatactgcagcacgacaaccattgttctgccaagattacctatataatacttggttttgcatatcatatactccctccgtcccataatgttgcaaccgaggatgggtactaggtctacgaatctgtccagtccaggacagattcgtagtcctaggatggttgcaacattatgggacggagggagtataaacagaagaagtctagagtggatctcgatctacgcacgtctactcttggccctcgtgtcttctcttggttcgggatttaacgcacggaaggcagttcataccattccgctcccatgatgaaaccaacagcaacagatgcaacggtgacaagtatggtcatcacattctcttttctgatcttgtcgaggtgctccctatcaaaaggatgtttgcgtatactcactccttcctaaatgtttggcgccgttgacttttttaaacacgtttgaccgttcatcttattcaaaaacttttgtgaaatatataaaactatatgtatgcataaaaataaatcaagcgatagaaaaataattaataattacttaaattttttaaataagactaacgggtcaaacatttttaaaaaaagtcaacggcgtcaaacattttgggatggagggagtataatgcatgaatgttaggatcgttttcatttgagtaaaaattaatgaaataaatcgtagcgcctccaaattaattaattacctcgccagcttcatctctaattctagctatcccatcatcaataatactagctatcttgccatctatctccactcccttattttctaattttgccaacagatgatcaacctccttcgtcttcctggcaacatcagctctagctcctttggcggatccaccctgctagtaggattaattagagaaatatatatagttagttgaaatggtaatgcataagctaaaaacagctagccatgcatgttagtggatgctaatgatcagagagcaatggctgcaattggctaacggtggtcctttcagagattgtactactaaacttacaaaagtttgacgaccagcatatgtccgactatatgaaatttatattactatacttgtttttggaaatgctttaataacagtacaatatagaaaataattgatatagaagcactaaaacggataccctcatctcaatcgggcggtaagccccatctcaatcgggcacggcgtccgtcacaggctagaagtcactgatgtgaagagttatctcaatcgggcaaacggccgtcacggatgaacccgccaccgatagctttgacccagacgaccagtcaaactatagcccatcacagatgacctatctcaatcgggccacaactagcgcccgtcacagatgactactaacctcaatcgggcctacactagagcacatcacagatgatactcatctcaatcgggtctaaactagagcccgtcacagatgactacttacctcaatcgggcctaaactagaacccgtcacagatgatactcatctcaatcgggcattaagtacggcccgtcacagatgaccatcatctcaatcgggcatttagttatgtcccgtcacagatgactataatgcacaaaaaaataaattttgttttttggctagcctcaggcctttgctagccatgccagctgcaaaaataacagaaacaaacatagatatacaatatgcagtcgtttggacaagcgtgaattctacggacttctaaccccagtggacacagaacctattttgcttcgtatgtcgtctcgggcaatgtgttctcagcaagaagcatagccttcaaaatttctaaaagatctgtgaaactcttgtctgtctatccattacttgtcttcaacttcattaggtccaaggtaactgacaacttagtgtgctttgctttgcatccagcgtacagaggcgtctcggaatcactgaccaacctactgaacttcatggaatctctctcattctgggctgggtcctcaacgtcatgtaacatgtcttgcagcagatcgtgatccacatcaaacatttcaccgcctaatggagaaggtataaacatgtcatgctcatcttcatcttcctaattatgcgcaccacttctgtctgctgctgctccacttcctgattcttgcttccatgtttcacccaatatgtatagcccttcatgaatcctcgttgtatcagatgaccgtgtacatcctctccgctatcaaacatattctcattcttacaatctgcacatggacaacacatgtaatcgttgtttcttcttttcctatcctcctccgcatcgttcataaaatttattacaccatttctgtactccggaaaatgatgtttcacaatttcgcatacatccaacttcgatcaattgctacaaaataaaaaaaataaattagaggcacatcttataagatcagtattgttaaagtaagacgtgatgaaattgctcaattaatgattaatattactcacttgattgctccattttgatcacttttgggaattttctgttttccttggaaaaaagacaaagaatcgccccctacagcctcctaccaaaatagtgaacagtgggatacagttacactaggtggtggagggtatttatactgtgcaacaaatatctgtaacggtcctaaaacaatcaaccatgacgggcatacaagtaatctctatcgggccttaataaaagcccataaaaaaagagtgtcatctgtgacgggcattaaacttatcttaatcgagtctttagttggagcccgtcacagatgaccctcatatgtgacaggcttcttttagggcccgattgagatatggcaccctcatctcaatcgggcctcaactatggcccgtcacagataagtgtcatccgtgacgggctctagttttatgccgatctaccatggctgtgcgaccatatctcaatcagacgaaactttggactgattgagattacttccttgtgacggcccgcaaattccaatcttgttaggggtcgtcacagatggaaggatctggactagtgaagctatatataaagtagtggcaaagttatgtttcgagaaacacaaaaatcacaaaggccttattcggtttagaagggattgaggaagaataatttcacattataataggtgtggaataaatttcctctaattcctccctcatagggattaaccgaaccaggcttgagaaaaaaaaataaaatatggggatagaatactcttctttgcccccaccatatccacgtgtactcaatgcggactacactacaaattgattaagaaaaaaactgattgtcaccgctttctttcaagcaaaagtaacaagtttagcacatatctttgcatagacctcctctgcaatctggcacttattgtgcatatttaattaattggcaatattcatcattagcggtcaaattacagaactcctctgataacaagggtctgaattgaactaggtaattgcatcaaacccctatatttgttattgtctcggggaagataacaaaaaacagttaatttgatcgtggcctgcaggttaattcgctgatagactcgtcagaaccagggagtcgacagctagctagctatagtaggtagatggatcgaacaagagcggaactagtacctgatcaggggtgggatcaggaagggagttcgccggcggcgaatcatgagagtgcatcgccatgacaccgagacgccggaggaatctggaggaggggggcgcgccggttagggtttgggttctctcaacttaatttgttgcctttgcctgtccgagactgagagatccatgggctaggccatccggcctcttggacctgcgtgacccccaacgacagacgaccaacagcggaataagttcattggaggtcccttaacttgtcgacgaatccgattttcgtaagtccttcaattgaaaaaccagatacaacaggtccctcaactgtcaaaaccgatgcaaaataagctgacgtggctaatttgaatcaatcatcattggatgtggcgcttacgtggcaatttaatttggaaaataataaaaactgtgggcccacatgccagttccacaaaaaaaattaaaaatggtgggggccacgtgggccccacatgtcattatcaccccctcctcttattcctcctctctccctatctcccctctcttcatctctctcccctactcccctctcctctatccaggcatggcagggaagcagccggtgggaaaaggaggggtgcgcggtggccgggagcggcgcacggtggcaggggaggccgctacggcgaaggtgaccatgacgacagtggtgaaggcggctatggtgggggcaaccgcgtctatggcgtctgtggcgtgggaggtggccacaggtgccgtgccgccaccgccgaacctcgtcccttgctgccatggtaggggaggttgaggaggtggtagtggtggtgcctccctctgtcccttgtaggctgttttcgtcgtcatgccaccggagagggagtttgatgctgacataggagcggagagggatgaggagggaaggatgactgttgcgcatcgatgttgaaagtggtgacgacgatgtggttgagcattggggtgcgaccatggccactgtatgtctgccccgtggcagtgaagacgatgaagcgttgctccctactacccatctccgttctcccccgcagcggtgaagacgatgagatgggtgctgctagatccagcaagcagcaggtcggcagagaggagaaggatggtgccggagaggatgaagaggacaccataaactccaaatcaacgcgacagaggcttgttgcgccgatgatccctccgatttcttgaccacagccatcgtcgcttccactcccacaatccgccggtttgcatcgccgtcggggagttggcagcccgccacgctgatctgccccaccccgtgccatgcaaaatcgaggccgtcggtgccaagtgctattccaccagccgccgctctggtctaaaaatgtggttattttttatgtttgcttatgtggtcacatcagcaccccatcagctaaaaccaccttcaatattgagactacatttgcatcgtttaggaagatgagggatgtgttataccccggttttgtggttgaagaatgtaattaagtcaaactcgacgtctagatgaagaacctaaagtgaacttattccacgaacagcacactacaacaatgtgggcctgagtgttcagaagcccacaacgcaacataagccgaaaatcctacccatcttccgcagaaagctacccgtccatcccacaagcaaacctacaactgaattgactaacatgaatttgtttaactcggttgctatacatacgacatccaatgcatctcgtactattatcagggcatgcggctatgggcaagggattaatctacgttggagatgcatcgtcgtacgtctcagtcggatgaagcggtcgtttgtgtagtgtaattcatgtccaatctaatagtaagttgctcctatattttatgcctgagtgagtaactatggttgacacgttttccgatcaccatgatgaatcaccgaaagccctacgatgttaaccggagtcgtcaaccatcttgatctagaaaactctaaaccaatatgggtttagaagaatgaaaaccaactagcataaatagcacaacaattatcagacaacataaatagattttgcataccatagttagcttagaatgttttaccaagattactaacttggtcgtacataccataaacagagttgacctacaagccctaggctatttaaccaaaaaagattttcttgcacactgccgcacggagggcacatttgcaccattctgctcccaagacgaaaccaccactaatacatgtaagagcgtgcactatcgtcttcacattctctcttgtgttattgacgtgccccctatcaaaaggatgtgcgtaatgcatgaatgttaggatcgtttcatttgatcagtaaaaatgaaataagttgtagcgcctccaagtaattaattacctcgatgcttcagcttgaattctagctacctaatcttcaataatactagctatcttgccatttatctccactccctcattttctaattttgccaatagatgatcaacctccttcatcttcctagcaacatcagctctagctccattgccagatccaccctgctaggattaattagagaaatatagttggaatggtaatgcataagctaattaaaacagctattcatgcatgttagtggatgctaatgagagagcatggctgcaattagctaaaggtagtcctttgagaaattatacgaccaaacttacaaaagtttgaccaccagtatgtctgactgtatgaaatttatatttactatacttgtttttggatatgctttaataacagtacaatatagaaaaatcattgttatataagctacaaagtagtggcaaaattatatttcgagaaacacaaaaggtcactaagggaaaaaaaataaaatgaggatagaatactcttcttcgccccaagtaaatcaaacgcccatatatcatggaattaggctgcattccaaagtgttgcgtggagtatcagaaataatctaaattactgcagccgcatgtcagggcttgcagcagctgcacactttgaaaaattgaatagcggctgatgacggttgccgttggagctgagggacggcgactgttggacctgatggatggctgtcgcaggcacggcgtcacgtatggaggagataacggtggggaaaagaaaattaaagctagaagcacacgcgcattgcacttagaaattaatgctgcagattaggattagctaacggcctggcgaaatttgagttttttttttctgctgacaaagcacaacaattaaagtgaaacaaatattgcacataaatgcgtccgatacataaatagttttcgatggaaggaaggagacataaatagtaggatacatatccatttcgaaaatggatgttaaaataaatattgaacatacacttctacccgtggtacatctgattcgcaatagtctcacgataagtcgacatagcttcctcgctgttggggggagtcgtaccaactgcggaggggtggcgcctgtggcacacgggggtacccgttgtacaaagggttctgtgtcatgaagtgggggtcattactatcagtcataaagttgtggagagcaaaagtagcaactataatcttcgtctgagcagcttcctctccatataaaggaattccccgcaggactctccactgactcttgatcaccccaaaatctctttcaactgtattacgcatggcagagtgcatgtagttgaaagtctcttcctttccaaccggtggtggagcttcgttgccttcgaaatcatcaacatggtatctaacatttgtttacggtggtaggaaaccgtacctactgggatagccagagtcaacaagcagatatttccctgaaatataaataattggaagtgttactagtcgacacaaatgaaaatttgtaattatgaaaactataacacaagcttagttagatcactgtactaaccccatggcaaccgtggaaaagcaaatggatagcggcgaactgcctccgatagaactctttggtcgtgtactgaaccaggccaaccaacatctacaaacataactcgttcgtcccaaccaatgatggttagcacatttctagaagtttcattgtggcggttcctatgtggaattgaattatctctacgcacaagaagcggtacgtgcgtcccatctattgctcctacaacaccagcaaagggaaggaatgcatcatcttgggcaagccggtaatgctgcgggaagttgtttggatcaacttgtttgatgatgtcggctgccatctcattgacagcattcaacaccctgtgaaaatatctattcatagtagcgttgcaacgaaccatcctattgttgacgctcctcacggaatgaccacctgccatggcgtacaaaaacattccaattgcttccataggacatacctcataggtaccatgcaagtggtacctacctgctcacaaggagattgtagagagcgtgaatctggtccgctctcatccgaaacatgttatggcactgctctgggttgttcattgtttccataacccattgcatgcccgactgctgaggtacccgtcttggtgctcgtgtgcttacattcctttgaaaagcatcagccaacaactccataattgtttcatcctcctcgcttgtgtatccatctttagaccctgaagtgttccctgaggtggtgctcatcttggtaggtcatgaaatggaaagttgttgtagcatgtacaaaaaaaatcatatctctgatgttcataacataaacagtgtaatacaagtgcaaactgagataatgttgtcgttagtgtatgtgaaaggaacaaaaaatgcacaatatgaaaataaaagttagataataatctgagaggtgcagtgactgtacaataaatgaaacacaagtttataacttaacaaaaaatattgcacattagcagtgagtgtaaaataaattattccattagaacaaccaacttagattaatacgcaacgtgtgccgaattgttcttacatcaatacaaatcaacctgcatataacataactatgttcgatttaaaaatcgaacacattatttcactaacataacgatggaataaaaaggcagagcaaccaacttcagcttcagtcgcaccagcagcagcaaaacttagcagcagtcactcagtagcaactcacagaggcacacacagcacggccataacacacagctagcacacaacagcacacaatagcactagcagaagcaccatacccactcaacacactgcagctccgtcggctcccccagcaccatcatccccagggtccccccatcacccccatcaaaccgtgtaccaccaggtggaaaccaaccccctgagcaagatggtggagggaaaaatcctccaccattaggaaacttcatggcatagtggaacctaatgtagtactcacgcatctccggggtaatggcatcacctaggaagaactcgcaaaagtatgggtcactaaagagcaaaacccccatgtggtaaacatctgagctaaataagtgcccatcagacttgaccaactcaatgcatgcacgagcactcatagcctcacgttctcgctgcttttgtgccttactctcactagacttaaccctcagatcagcgagcctatgcaaagcctcaccggtggagtcactgcgggtccttttggaacccctagacccactagccggtgttgccacccttttgcccctacccctggttggccttgaccgtgatggtggatcaggtgactgtggcgcatctggcacgtcgacaaggtcctcaacatcgaggagttctgcgttggctggctgcaactgctgttccagttcagtgcctgggacacttgaacggttgccgacaacacacctccccctgaagacagcatggtgctcagcaatgaatctgagaggtgcattcctgaaagacctagcacattttctcatctgcatttcagcaaaagagaaacaaactagagtgaacaagaagtacacatgcatatatgtattgcataaagtacagaagctaccaaactacaagcacacaggcatatatgtattgcataaagtacagtacgatgcacacagcaagcacacatggaatggctgcaacctaactgcccataatattagcaacaacatagcttatcaagtggttgcaattattatcaagtggtaagttaaataacaagccgacattttcagataattacgattgctattgcaatattaataaaacaacatcagcagggaagtattaatttcaatttgcttcagcttcatgtaaatatgcaaatgtcatgtgttatccaggcagtagtactactccacaagcactcaccacagctgtgaacaagtctcatatgattcactaaattataccacatgtcatacattcacaacactgaatataactactgcaaagtccatttagctgccaaattaatatggaaaatgctttcagagtatttaaaacatcaaagtgtgcatatgcatattacagatttgaccaaatattgcttagcgcaaagtattgtaaaatcagcaaggacaatataactgagtatttgggtataacaatcaatttttttggtggtaagcaaatgtagttgttacagccattgttttatttcactaaggtggtacttaacattatacatgcagtgagaagtgaaggtggtgttcagttaatgagatgaaagtagaggtatgtactattgaaatatattagcaacttttggaatgttgttaacaacacttgtactctagttggtactactatatcatctttcattttataaattaccaaaggtatcatcaaagggatgtctaagttcttaacaatataattgctcactacaaattatgtcctgacagaatcccaagcatgcatatgtgaatccatttgatgtgcactagggttcctgatcttccgaaaggttctgataaacaacgatttgggtggagtcgcgacacaaatcgatccggcttcttgaacgcgcacgctcttgagccccgcaatcgcagcaccacatctcctctggttatcacccttgtcgaaacgcggatgacctcaccgagaaggctaatccctgtttgccaatcgaagaacacaaacaagaacgagatagaaaacaaccaaaattgcatatgaatgattaagctcacgagttggggtcttacaaaccgatctaacagcgaaactgctctcgacagaataatctaagcaaaacccaaaaacctaaagatggcggcggtactgatatatagagtttagggtcgtgcaaccccctctcgatacaaccctaatgggttccaacacgatacatggcccaaaggcccaaatacggtgacgcagcaccgggacagattctggacgtcaacttgttcggtcgattcccattgactcggaaagaatttgggcgtgggaccagaaccattggaaatgttatcttcttagctttccatccatataaagaacgccccaatgcgagcacgtatgcgacctgggcgcctgttttagtgcagactggtcctggactccgaattgcacccgaggtcaaattggtttgggcctccaccttgacttggacgtcctcgtgttgacgaaaaaatcgaacacaccggcctgggagatctgcttaactcctgtgcatgtccaaagattgatgagatgcgagcgtgccagttagtttgatcctgcaactgacaagatatgcaaatagtagatcaaaatagccgatcggctgacaagccgatggagtagttccagccgatagccgataatagccgatgccgataccagccgatagcgatagggattaagcaattggctatatgtccaatgtggataatgatatattggcaatctgccgatgatgatataataaaataacaatataatccagtataaaccaatcggctagcaatgatatgataaataagtatcgatccgaaggttaaagcacacatcggctggaggtccgatgtcatgaaatccacaagattagattaaacagtgaaacctttgttgtcatcggctaaatccaacttatatgtatatgcaatccttatgagccgatgcaacgtccagataactcaccggctaaaaccccgatgaaacccttattggcaatcaagaagcaggctagagattatggttctaagcacgacttagtagatcaaacttaactgatgcagcactaagtatgaaaagaaacataatatctagacaatcaagccgttgactgagttttcagggtggtagatgtctaagctaatctaatctagcaatgtgatttaaccgataccggcagaaaccctaaaacgagaagcagccgatagagctaaattgatatgctaagactagattaacaaagacatatgataaataggtaggcaaatatatcatccaaaccagagcaatccaagaggtcgaatgtactgatgcagccttgaacgacaccgacgtaaacgatataattacctgggccgacggaacattggacttaccccttagccagagatcgaacaccgatgcagccccgcatcaggtgccaagtcccttcggacgataaaataaagtagaaaaggtaaaaggtggcgatgcgccgaattgtattgatcgtgaagatagattacatagaccccgagtgtacatatttatacctatgggttgatacaagtccttgtcggacaagaaagaaactttcctaaagataaaaggaaaagataaagtccttataggacactaaacacactttcctaaagataaaagaaaactaacaaactattcctaattaatagataacttgtcatgccgcattctctttgaactcggtctcttctggataagcttcctttagtagatcaatttccttaaccgaatatagcaagaatccgacaactgacgacttgacaactctcatcggctaatctcaggacttcgaagccgatgctgactctaagccgatgactactccaggcttaccaaatttcactgtgaacacctcgataatcctccatggctctaagtctttctccaagtgtctccttgtcccctccattgttactaatcacaatataatcattcggtagcaatctattcttgaattcatacaaagaagaacataggaacgagctcacctctaaatttaattgtcgcgcacgagctcttgatatcggtttttgaatgaccgttggaggattgttgtatgtatccgaggtagtgatgtccacatcaccatttgtacttatcaacatgatgacccagctaaaaaatggtaaataagaaataatcccttttgcaatgattctaacacattgtgaggttaccaattaaatggatgtaatacacttgacaactgacatgtttgtgtacttatcattgcaatctccatgtgtacttctcattggaaaaaggcacatttgtacagcacacttgctaacttaacaaattgacaagcttacatctgaaatattgaatacagctatttaaaatatctatgtgactatgtaacttgcaaaactaagttgccatgtacataatactaggtttgaacatttgcatctaaaactaagttggcatgtgcatctaatgctaaaatctgaacatttgcatctcaaagcaagtttcaaaactaagttgccatgtgcatgtaatactaagatctaaatatttacatgtcaaactaagttaacatttgcagcactatttgttctgaaactaagtctgaacacatggtttcggtaaagcaaaaaggaagagaaagggaggactaacccct

SEQ ID NO: 3445 - DNA, 5170 bp, Oryza sativa
tcccctcgatgcggtctccaagagcctgctcacgagttgtcgatgtcgatcggctgtacggcacctatggcaaggagcagcggccgctgctccgcacggcacgccgatgctctcctcctccgcctcgacgactgccggtccgtgctgtgcactcttacgggaaagggaatggggtgaactgctggacaatggggtgagctgccccttgcgtcgacttcacaacatagggaggaaggagaagaccggtgacggacggctgccgtaaggttcacatcaacaacggcgtcaaactcccacacctacatctacaggaagcattgagcccaagacaacattagtctagagtgacgactccagtagcccatccaagcccattgaactatgcactttagaacgcagccttatccgttcatcgtatccgcgtgtagtcaatgtgcgcggtggaggctgtcacatcctgaaaaattcaaaatatataaattgttgtttaattggaatttttagaaatgattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtctcttttggctttgggccgaaagtcggcccaaacctcttctctctctcctcggcccaagccggcccagtccgccgccgcgcgcgcgcgcgtccgcctgctgacaggtggggcccgtctgtcagtcttcgtcttcctcgcgtcggccgccgcccgaaaccctaaccgagcgccgccgccgtttccttccaaatccggccgctcctttccttctccggccgaattgatagaggggaaatgatcctagggatctcctctaccttttcccctttggaaacatcggctaattcgttttggaagttcgtggaatcgagttcgattcggatcggcctctttccttcgaaccccgaagtttccttctcgtcgccggccgccgtgggccttcgtcgccgcctccgagcccctttaaaaggttccccgagctctcctctacccgccgccaccctcgccttcgcctctcgtcgtccgtagtgctctagcgccgtgtgacctagcgccgtcgttgccgccgtcgctccagccgtgcgctgccgccgttccggtcatcgccgttgctcgggaagaccgccgtcatggtcgccaagtcgccgccgtccttgtctgccgcttcgccgtcgccgaagatcgtcggagcaccgccgtcaccgtcgacccgaagaccgccgccgcttcaacctcgtcgccgtcgccgtccgttggtcttccgccgctcctttggtcaccggtgagttcgccgcgtcgcgctctacccgttggtgccttccgttcgcgccgccgtgccgtcgttcgccggcgagcatgcgcgcccaagccgccgagccgccgccgccggtggtgacgtcatcgctgacgtcatcgtcgccctctcccgtgagccgccgtggacccgatcgatctcgaccgtccgttttggatggattgatctcggccgtccgttcacgtgaaccgtcgcccgtgcgcccggtccaccgaaaccctagccgctgacgcaataaatcccctttttcttttcaaaaataattcattattgcgtcataattcaattaaaatccatataagtgttttaatccgatttaatcttcaaaaattcataactaattcatcttagctcggatttagttggtccaagtctctaaatttttctaaaattgagatctacatgttaaaaatatccacatgtactgttcatgcttgtttatgtgctgttttggtgtttttgctcttttctgtttagattccgacatttccggagagtccgttttcgcagcagaagaatttgaagagttccaaggccagcaaggcaagtcacacagattccaaacaaccctttgagcatgttgatcctatttaaagctattgtttctattcaactattgcatttattttcgaatgtcattgggtggaattaacctattctttgttatagcccttttgttcttgattactttattccttgataccttgggttattataatttgactagttgagctctatatgttggttcaactagatgtattagatataattgcttagccctgcttagaaacattagcacattattgggataacttatgactcactattatttcatgatggcttaatgataattcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaaccgtgccaaccacaagccagcatgggcaacggctttatcttttatatagcatggttcattgcggggcaccagactgagaagtggcggagataagcccacgggggtcgctggggagtccataccttgtttataagggggtgattatgatccaggaaaggtgcgctgtagtggattgtgttatgcaaggggtattgtcacaactcctttccgaggtaccgtggtggtgttgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccataataaaaggtgctttaattggtaataatttgattagctcctggtttggaatggtacattcctagtttggagatagaactgttcagccgggatggttgttcagaatggttgggcctatgcaacagagtatgttgtatagtgttggattaatattgattaattatttactccactgtttttcttctcttaaatgtttgctaaacgctgcttttgcaaatgagccctatactatgccattctttggtatccttgtgcacttgcatatttgctgcgtgacttgctgagtatgtcatatactcaccttgcaatcattcatcagaggaagagttctacagtgaagctgatggtgtggaggattaggtgtagccttggtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagaggcagggattatggcccctacaccccactagacaacaagttgcttcagtaaaaattacttcctccgtttcacaatgtaagtcattccaccattttctacattcatattgatgttaatgaatctagatcgatatatgtttagatttattaacatcaatattaatgtaaaaaatgctagaatgacttacattgtgaaacggagtgagtaattgtcaccacttattttctttcgagcaatagtaacaaggttagcacatatctttacgtatacctcctctacaatctagcacttattgtgcattttttttgggagtagctatacttatggcgctatatttttcaccaaaaaatagtcaccatgtatttacattgtaagtccctaaattacatatgtaattttagtgtacttacaatgtaagtttcaaaattacatatgtaagtttctaaattacatatgtaagtttaatgtaattacaatgtaagtgcaagacaacgtctatattttgcattgtagattacatatatttatatactatgcagatacatatgagtagaaccatcaaaagcttaaactaatgaagcatgttaagttttaattaattgtgtaatgacagccgagaaatactaaggacctgagtggactgaacaacatctgacggtcagaaattcgactgtaatcagccataaaatatggcgacatcattttagcaaatccgttttttgtttgcgttgcgagttgagctatagcgctggctttgcctctatgtgagcctgtcatgggcctcttgggcctgcgtgactccaaaacagcacgctttttgtttgcaaaaggaataagttcactggaggtctctcaacttaacaacgagattttttttcccttaaccacgaaaccagaaatgtatacccctaaactcacacaaaccgttcaataccacgagaagagtgggagagagaagagggaagagtggggaaggatttttttttttacatgtgggtgccaaatagacctcacattacccaaaaccggtttcaatactagggcatcagcaatgtgctcgcaaaccgggtagtaagcaataaatacactcttactacctggtattaagcattgtggggctagtacataactacaaccgggtcatacccctactgccggaagcaaggaaatagaatatgcatgtacacagtgttttctgacagcaaaagcattgcttctcccaaccgttgcatgcatgctctgtccttgctacgatttttattaccccatggaccccaccttactgccaactcacagatataagcaatgtggagcacgtctccctctattaccgcctgtcatctgggcccacgctaataccgatgtggatagcaaacattgctgatgcccttaggactagggatgcctcgtacgcggttttgcggttaagggatgcgattggaacttgaggatgcaaatttcccccagttccctgatcaatgatgggctgcttcaagtgggccgagcccatccggcccatacagctccctccctctatcccccttggctggctggcatacacagctacacacggaaacggccgccgaacaaagcgaacaactactagtcgtctcgtcgtgctgcgcactcgccccatcgacgagagatcgcctccgcctcgcacccgccggcgccggcgccgcctcctcctcctcctcccgccgttccaccgccgcgcctcttccccgc

SEQ ID NO: 3446 - DNA, 5338 bp, Oryza sativa
attcctgcagcccgcaaattttttgccgtaatgcgtccccttttaagtaatactgtttctggctactgtaatttctgcgatttgtcagttagctcgattcccagcttgcgcgatcctcatctgatctctctttctcccaaatcgtcaacctataggagcagtatccaggcattcggatccctcatggcccccgagatctccgctctgatgctagccgcagcttagggggtccgatggctgcctgtgctgctcctccatctacaggccgccttcgatccgcgcttccgcctcgcgaggagcctcgtttcggtggctggatgcagggctgcaggagatctccctctttaagtttcccgcagaatcatgtttccaccggtgcccccaacgatcttttgccctgcaccattacgcgcagcttgtttagccaccaatgcggccgtagccatctcgcagtcatgagggctgaaggttcacattatatattttttatttccatgaaggatgttagcctggagcttatttctataatttctttccataaaaattgtttgttatctatctctggttatttctaatgtctagggacatataagctgtgggtgtggctaatatgtttatcccttgtcatcccagtatcttgacactatccataatacatattatatagatcaaagccattaacctattagtttctggccctttgatttttcattacacttcagtttgctaattctattattatttatatcagggcattcctccatgggtggggcaaatgactcaagtccatcctctaaacttcacacaagactgagactatgggagttcccagaccgctatgtatttgagccgattgatggtcttgctgacttgtatctgtcagctaaccgttctgatggttcaatgaatctagttgaagagttgccaccacgtgactcttctacaaaaccaaaatgtcaaacagtgtatggtgtgataggagttctcaagctttcagttggatcatattttttagtgataacaggccgtgattgtgtgggatcctacttgggacatgcaatttttaaagtgacaggactaaaagttctcccctgcagtaactcacgtagcacttctggcaatcaggtcaagcaatacttatgccttcacagttttatatagcttccatctatttttcaattagtgatttgagtaagctgttggcagagtaaaatggaaacagaattttcagaactcctgcatgctgcagagaagactataggcctgtacttctcatatgatatcaacttaacacttacgtgagtatccttcttgtcaaacatagtcacattctagtgtcttatagtcaaagcttacaacctcttgttgcatacttgcattgaggatttccagcatagtatgcaattctatgcatggggttcttctattttagtagatggcattctctatttatttttacagtccacctgtgctatcatctttcatttaattctcttcttctgtttttggcttattgcaacagcatgcttatctatgtttccttctattgcagtttgcagaggctacataatcttggtgatgagttcaaatcacttccgctttggagacaggtttgctgccttcaccatttggaaccttttagttctagagtttgtttatacccatagggtctgagctttctccattgttcttgtaatccctgatcttttgctgcctatactttactgctgtggtgccaaaagctacttcttgttcacttcatctttagctatcagtttacacatctgatgtagaaatatggacataaactaaaccagtctgatttttaattccaattcccagacacaatttgtaatggttgattattttgacatttatgaaaaagggaaattaattaacaaagaagtcagaagaggttgcatattggccacttgtatttatgtgttttgccatcatggttcaagaaggcgctaggcactagagggtcagcagggcgcgccctaggcgtcacttagctagcatctaggtccaacatgacttgtgaaatccaagcaattagccagcatattacatataaatgttagacagtaggacattaaattagcagctaaaggagcccacatggatggttagccgcccaaggccactcccaatgggagtttcattctcactaaatagagtgccatgtcaatattttttatgatgtggcaaggaattgatgaagagattaagggcctgtttgggggagctttagattctgagaagcagctgtttggtagccagcttctgcgaatctggaaaagctctgaaacccagcttctccagcttctggcttcttagctcatttttcagaatctgtaactacagattctcagaagctgtggactgtttggggcagcttttaggaaaagctgcagctgggacaagctcccccaaacagggcctaagagagaggtggaatgggtttcatcaagatgaaactatgtgtacactatgtccaatatctgttgtctcttgcatttattgcctaggaaacaacaaaatgaaaaaaatgcatcgtatgggctgtttccaccatcaactaagggtatgtttggatgctcaggtaagtttagctatagctcgaatgggcaaactagctcattttagctatgctcatttcaactagctcatttcagctattgctgctcttgcccaagcaccatatttggtttccttgcttttaccccacgttgagaaacggctatcagtttttcccctcacgtatgcacttcttgccgatgagagagagccaattcggttctcatggctgagcaaggtttttcttgcccatcaaggctagcttgtccctcaaagctagcttgtccctcaaagctaggatatttcatcggtaccaaacaccaagcctggctaggctaggctagaaaatctttagccaaggatccaaacacgggggatgctagtgcgcgcgtgcgcgccagggaaaggagccggcgcgtgcgccagctgcgtccctacacgtttcttttttttttctagatctcctattttaacgtcacttttttgtttccttttttaaaccgcttctttttttctagatttttttaatcgcttctttcttttccacactcgcgcatgatttttttgtgatattttataaattcaatctttcaccttcaatatcagttgagagttttgaatttgagttgaaaagtttctaaaatttaagtttaatgttttgaattttgagatgaaagttttcaaattttgtcaaatattttgaattttgaggtgaaagcttttaaatttgagctaaaagttttcaaacctcagttaagttttcaaatcttgacttgaattttttaaatttgaattgaaagtttcaaatctttagttgaaagttttcaagtccgagttgaaagttttcaaatccgagttgaacattttcaaatccaagttgaaagtttttaaatccgagttgaaagttttcaaatctgagttaaaagtttttaaatcttgacttgaaagttttcaaatattgactcctactcttagacgcgtgtggtagttaacggccaaaaaaaaaagaaagaaagaaacacggctgttgcgcctaccgaaaaaaaaggaaaaaaaaagaaaaaagaagcacgcaggcttggtcgtaggaggacccgccatgtggcacgctcgcgacttggagaagtcgcgtgtacgcgcgaattaggattctgtccaaacgcaccctaaatgttttgttgcttatttggcattcttggaaacataaaactgaaaccttccactagtaatgatctaatgcctaattcaggtggctacctggcacctagagccgatttgtataacactgtttgccatttgagcgcctggaattttatttttgcttctgctgcttctatagtccagtaattgctgcacaattatcttgccatctaggaaaacatagatcccatctaggaacattggagctttaatagcatttgttttaaagacctgtcttgtccccaaaaagtagcatgctgtggcttaagttaaaactttcagtagttaagcatgaaaaatgtaaagagtgctaaatttttacagagtaacatactacagtactttttttccactggggagttaagtactgttgaattaacattttatactgtgaaacatccatcttgcactgtccttttccacaaaggctcaaaatgggtcatatgtgacaataattctgtaaatatctccttttttaatcatataccatatgtattttactttcaagactggggcaattccttattttgaattttaaatttataagctatgccttgaacttgtatacagtagcttcttaaagcaacaacatagtgctgctatgtcaaaagttgctcgtgctaaatgcctaaaagcacaacagattaaacatgtaaacaaaaaattcctgtgccttttcaaatctatattgcacaggtgaaataattacattctttacaggcagaaccaagatttctatggaacagttacttgctggaacctctaattgagaacaaggcaagaattaaatttgaagcttactgatttcatagttttgaagaattaaataactgatacttgcaaaatgtattgattgtttctttcttccttaacagctggaccagtacttgttgccagtcattcaaggcagtatcctttgtttgtcatatgacatttcaatttggtcactgtcagaaatgcaatataataatatattattatttgaacttgagtcaccttccctagggtcatatgtcaatataagtcgcagacacttaactgaatatcaggctttcagaatatccatgcagaagttggatcggagaaggtaaatgtgaccctgattgcacgtaggtgcacacggaggataggtgagaatcatcagtgatcagaataagttcacatgttctcttctgcttattgtcacttgaaaatatttttttatatgtatttgattattttttctaatttttattacatcctggctccttatttttgagaaactcactggcatatgagtagatttaattacagttgatgagtttttttttaactaaaaggtacacgaatgtggagacgtggagctgacccagagggttatgctgccaactttgttgaatcagagcagataatggaatcaaaagggttcacagcatcctatgtacaagtaagtttcttaggatagtttaaaaccaaccaatctgcctttctatcaatttgtgagttgcaatttcatcagtaggttattactattttatttttaccacattctagtaccttgacaaattaatgtgctttt

SEQ ID NO: 3447 - DNA, 739 bp, Oryza sativa
agtttctcttccttcttgggagatctgtgtggaagacaatgtttttttaaataagtggcattgctctttttttagactattacaaacctagatgtgctgccagatagatctacaacctgagttaacttgtcattttgcagtgggttgtctcattggatttatctaaatcaaatccaaactgttggacttaatatatattgatgtacccttaaggactggcttgagttactttgatttgctggttgatgtattctagaacagaacctattgactgatgtagtaagatcacatgcctcaaagggaaaagccacttcagttactcctaagtatctaattgcagtcaagtagactaggttaacttcaaagtataatacttaatacttatccatcgtttatttatgtcttatttccccctcttccgtggagttttcactttaccagaattctgattatcaatatgatgactaaacagagcatgattggaggaaagatactagaaaaccaacttcagcgaataggggttctcggtgttaatgatacgataagcaaccatccagcttttgatgcaaaatacaaagtttgtgagttgttcatgttcactaaccctggttcttcttgtttgtattcctcatgcttgtttgtatctcctatgcttcttcttgatgcaaaatactcttgttcagtatgggccaaccatggagattcaataagcactcagtactctggaactccggcattg

SEQ ID NO: 3448 - DNA, 2330 bp, Oryza sativa
tatgggaagagaagtacccagggaattctgaatgatctgtggaattcacttgctagatactacttgaataactttgcagatggcactaaacaggtaaatgactgactttgcatgaaaatcaataaatcagatgaccaaaacaatgaaccccattcaccgctaatatgccagcttattttcttgtgaatttctcacttaatcgtgatagaccattagtcatgcaaacatcctcaagcaatagtaagcattgcttttggatattggtagtgcattggaatgttttacgtggtcactcatttgccatttcaccagccctagaaaaatttaaaccaagctagagcattgccttattatttttctgttgttttttataggatgccatggatctacttcaaggacattacattatatctgttagccgcgacatggcaggtccaagcaaagcaggacttctagagaattatgcggtgggtacatttttgctgtagtgtataattgctcttttatactgacacatgaattgctactgggaaagccttctttgttaccctgtcaaacacttacgactaggcacatgtgcgtaggaacttactctatggtctgtatgtatgagaaactgttggatcagttatggactgtattttgtatctttctccaatgggataaagctcttaattgcacaattcttattttgcagtccttccgccttgcttttgcattggttatgggagctcttatgttcatgatgatgtcactaagacaaggtaagatttctgtgactgttgaagcagacacagtggagtatatttaacaattgttttcttaacagatatttttcttaggtttatttgcaccgtgtcaggcagcatttcctctgctctctgtgcatattacattacacaaagaactctctcttacaattcttggttcctttaggttcacccatctgcaaaataattttgctatatattgttgccagttttttagtatgcaaccttttcttcgctctgatgtcatgcccagtgcgatttgcaaggcatagttgtgcacgaaagatgggagactttgtccaggtcctgactcctgacaaggagtgacattgctggtaatcaagaagtaacagaaaaaaagcaagtacaaagagagatgcacttaggcagttaggaatggaggaggacaagtgacaaggatatacatatttcttccttaatttattgatggtcactgatccttgtttaggatcacacttccaagcccaaacatggatacctaacacaagtcccatttctggtcgtaactcacctaatatatcccactttcctatatctcaaaaactcaaactcagtaaacaagatagctagtcataaaattcaaatccaagttacttggatttctgctgatatgatgctatgctacgcttgtaaaactgaaaaaaagtaaagttgcataggctaatactgctgggtgctgactattttttcttcttttgcatgttgcaaaacatgagaggtaaggtggtttagaacgttggggcttatttacattggttttgatagcatgactgaaatttgaaccgctcttataattgaggatggcattggacatgtatcacagttgagtaaaataaatttgtttcaagttataaccatccgaatacatatgtactttctcaaagaagattttggagtcacattctatttttactatataatgggaatatatgtgcagctaattaactgcttcaatatctctgcagccaggaatgatgttcgccatttagtgttgtcacttctatgggctggtctttgcattggcatcacacattttgtcagagccaatggtcgggtgttcaccaacagacctcgtttttatcagtcgcgccattgaagcaaaacaaccactttacacggacactgagctgcctcataggttatcatttttcatcagacagtcagcaccttgtttcatatgaagatatattggtcgcattttttgctgggaatttgaccctcccctatattgtaatgagttttattttccatttttgtaacaagtttttttttccttttccttctcattgttttgatttccagccatcttttggggcatcacgttcacgattctgtttgacttagcagtatataattcaatacacctcctgtacactgtttcatcgacaacaactatatttgacatatttttcttgcaaggattaattatgttcaaattccagaatggattactgatcagtaaaaaatatgttggcacagtttttcaagatccagagattttgtggtatctgcacctgtgcccccctttttacataattc

SEQ ID NO: 3449 - DNA, 1533 bp, Oryza sativa
tttcccaacaaaatttcttcggaaatcccgcgttccaatcggaattgtgagttttgactctttcatctaattggagtgagctttgtgactctttggtgtgttctttctatgagcaaagctcatgtttggtttctgaacaagttggttggcaggaggtatgccaatttttaaagaaatattatggtttttgtcagcccaggcaaccaaatttgtgggagtatcacagctactgatgaaatgccaaacaaattaagctaaaatatcacagataattcatacataacatagcttagtttgcaatgccaagcagaataataaactgactgatttttttcccatggtgatacctatgacagtccatagttactcatactgtcatacatgaccaacctcactgtgaataatatcactgattattttaagaaatgaaaaggcaacacactaattaaagactgggcagcatatgtcataagatggtagaggataaatgctgccccaaggttattatatgtatatatgatgctaattctaaggttaactaatagaggatatcaagtggaagaagagcactggatcgtatatgttgctgaatcagacgcgcatcctcttcacatctccttggggcacatgagtctctgttccattgccagcagggatgccttttccagcctaagaacaggaaattgcagaatgatatatccatcagtctgaatgttgttgattgcaaagaattaatgttcagtccattggtgtggcggtggagtcgtgaggtatatgactccatccaacagggttcaaatcgtggtgtcaagaaatacggttgcgtgcatggtgcagaggccggaagttatacttcctttatccaacaagaatgttcagcccaatgtgagagtgttttttttttaatttatttttcttctttttgaaagcaaaacatgaactcaccttctcatccggcacgatggcatatcgctctgatggcgagacccaaactttagctgaaaaacaggattatatgatgtaagttctctgaatgaatgactgaagaattgcatgagcagagagacctgccagtagaagctgaaaaaaggcatgatgtgatgcattgcatatatttacctgacattgggacggcttttgatgattccagctgcttgcaagctgatccatccgagctcaaggcatcgatcatcttgggtatgttccttcaccaacagaaatattttcttgattcagttaccgcgcattaaacctggattttttttttttgcaaatgcgcaaatccttcgggtgcgagaaattacctatcaactatttcaccatggccaagctgtccactggtgccccttccccatgagaaaacatttttggcttctgtcagggcaagagtgtgcctccatccacaagcaacttgaacaactttctgcagttgagtggcatatgatacaaatgagactgaaactgaaaatgcgaaacttataacgtcaactgagaggaatccttcttcagatggagcggtgaaatagccttggt

SEQ ID NO: 3450 - DNA, 5587 bp, Oryza sativa
atgtagtacaccttactcgagactcaaaattgtcggagtatcgacgtggtttcacaaactcttatttcgccagaggcatgtcgttttcaagatatttatgccaatagaggcatccaaattgaacatacatgttgaattgaactgcatatactaatcaattcactgaaatatgaattactatagagtggtcacatatcattcatactccgaaaatcaagctgacaagtggggtttggtagtggtgtttggtggattggtgaaacacttggtacctaaaagtggaggttgtagtggtagtatggtgccctggaggaacagggaaaacggttgctatctgctgctgtgagatttttctttttccagatcaagacacttggctcttctagttccattgtgtcttaaagaacactgaatgtcattcttcagaaatgttttaagatttagtattcatcaacatataagaacatgttcagagcaagattggtgccttgttcccatcagcaattaatcaaacaaggggagtaggcaattcaccaatcaccttgttccatccccatccatagagtttcccatctgctgcaagtgccattgtatgcctccacccacctgaaatcttcatcacccaaaaaaaaaaagatcaactctacagcttcttcctattgaaaaaaacagtgtcacaaatagaatttcgacagattgctatattacaaaattcatagcaaaaggctatccatttatacttgagatattttttagataatatttatacttgagatatagtagtatccttcaatgcttccaacttgggtggaaccaggtgatcctcaaaatcaccatgccctagctgaccatacttgctccatccatatgtgtagatgctaccggaggaggacacggtgatggtatggcgccacccgcacgctacaagcaccatcttttgaccctggaaaatcaacgaaaagggtagttttatcatccttgagaatgtaccgcaatgtatcccatcttctagtgtaaacttgatactttcagttgctatgcttcgaggtatcaaaatttttagtgtaaatttttcacacctacttgtactttctttgagtaccgtaaaatttctccatgaaaaaaatgatgatgtagaacataaatgataactgcaataagagtcagagacaaccaagagtaagattactgacattcacagaagaaactttttctgggattaagcggtcatcgcgatcgcctagtcccaagttgccataccgaccccagccccaaccgtagagatcaccatcttctgttacagcagcggtgtgctcggcaccagcagcaatcatttttacacggacaccctgaatccacacagtcttgttgttaattagagcaagtattgttcctaacagcctcaatgtgctgtttctgaattttagaggtgtcattctagatatttgaagaattttgcccatcaatgttgctattgtcacaaagcaaaaatgtttcctttattattattttattctttggtgatctcatgcgcaaatcgtgaagtacattgaaggcttgattgcgaccactcactgctcaacttctgatggtatagcttaattattttgcgtgatttcgaaattgtggcatcagttcatgaatacttcgtggtccatggttggggggctcatggatgttattattggcactcatagcctcggccaagaaaatcgtcaggtggaatacatttgtactccctcggtccctccctttatttttagatataaggcgtattttgactataaaattaagtctgcaagactaaactctgaccattaatttctcgtaatatatttttttaataggaacaaaaccaatattacgtggaagctctttgaaatacaaaatctataggtataactttaaacactaaaaaatatatttgtatgcttaataatgcgctcgtcaaaatcttcaaagtttgtccgtttcgaaatcaaaataagccttatagaagtgaatggagggagtagagtacataaagatatttcccgcggatgctgctatcattttcacttattcttttggtctattttgccttaccctgttccaacaaacagagctagatgaagacgttttgatacctcaaaagcttgaatcttttgtgggagcaaggagtcctcggtgtttccgaggccaagctgaccattttgattgcgtccccagctgaaatcaatcaaccagcacacaagaacactttgattatagggatagattaaatataattagaaacaaaattagcaaatagctcaaaaaataaatggtctaaggaatacaatacagtagaagaaagtttattaagaaaacgtatttttcgagacgcgtactaaataatcgtcggtaataatccaataaagttgctgaaaagaaatagcgatttctacgtaacatcactacctttcctctactccgagaaaccctatcttttctcaaaaggtagttttcctctcttaataaaagactagacatttcgctactcaaaaaaaagaatggtatttgggctcgcctgttcgaggggactccgctcaagggataacatcgctctggtctcacctactgtagagcagtagcgatcctataaagtcttaccaagatcacagaaccctgggtagatgattcaatcctagtttaatttacgcgatgttaattaagtatatcactcaataattagatatcactgataatttttatgataggtttgtcactgccgtcgttgagtccgatatcctcgggtaaacgcttgggcaagtcgtaatacatgaaagagttattttcattttaaactcagcaaggtgtatttgtattaaaggagagggaaacaatgtacaatagtcttaagactaggagattacatcaaacaaaagaaaaagaaagcgggtttgggagggtgtcgtaatacatgaaagagtagaggtacctgtggacatggccggcgacggtgacggcgaggcagtggctgtcgccgcaggcgatctgggtgatccggacgccctggagcgcctggatgggctgcgggttgaacacgtcgctggagttgccgtgacccagcctcccgaagtcgcccctgcaacggcggcggatcgaattctcagttcgcttcacggcggcggcggcgagatgatcgatcgatcaagcgcaagtgcgtaccatccccagctgtagagctgcagctcctcgtcggagtaggcggtggtgtggtcggcgccgcagatgacgacggaggcgacgccccccggcgcgtcgtcgaacgccgccgtcagcaccgtcggcaccggccggtcctccgcgtcgccgtgccccagctgcccgtcctcgccgcgcccccacgagcacaccaccccgccgcctacacgccatgtcaatccgtcaagtcagataattaaccaccgcctaggcgctatctctctctcgcgcggcttactgagcagggcgacggagtggctggcgccggcggagatgaggacgacggaccgctccggcgcctccgggaccgcctcgtcgtcgccggcgacctccacctccatctccatgccggtcgaatgcatggtagtagcagacagaagagaacgagagcagagtgagcaagtgtgtagatacggctggtttaagtagccgtagactagcagcggctgatgggatgggcaacccgccaaaataatggcgccaattattcacactaagctactattttcgttttatattataagtcgtttgacttttttaagttaaagttctttatatttgaacaagttaaaaaatagcaatatttacaatatcaaattagtttaattaatttagcattaaatatgttttgatataatgtttgtttcgtattacaaatattactatgttttactgtaaacttgattaaactttaaactttaagaagtttgactaataagaaaaaatcaaacaacttaaaatatgaaacggagagaatatttctgactagctataccttaattaaaagaacagattttataattcaatacctacaagatctagcgtcagtgacgaacccagagattttatggagtatggacggaacaaaccatggctgctagactttggcatcgtcaatcatcgctgggatgaaatacttttttttattttttttttacttatggcatgacatacttgcaaattgcaattctactatgagttggcgagcttggagcttggacggctgcctagagttgttgcccttatgcatgtttcttcccgtgtatgatgtgtagggggtatttgtatggttagatttattctgcagcagtttaattgttagttttaaattgtactcccataatatatgtataatttgacaatgtctcgtctttttttttcccgaagcccatagctccatcctttggcctttgctatacagcttaatagcaaaggagttgattttgatttttttttttactttattttttatattggttattaatttgctaaaaacacatcaaattctttttgtcaataaaaatactacagcttataattagcagtagacgaaacgatgggactgtcatgtttgaagcgtgtgcgatgaagtggattatttaaatttatctaaacccttaccacacaacatctccccgcgttcaattagcatgcatattttctatgcttgaacatgggtactactgttcactttatgttgatgatgtaacaaatctatttataaattagatgaatatgtttaattcgtccattaattcgagcttgtgttgaaaaaggatatgtcacctattcaatcacgactgcaacaacattcatcagttaccgatggcagaggaggcaaaataagatgggaaagtgactggtgtacaaatcaatcaaactcatttttcgataattacttgaaaaatgctaaaagaaatggaaatggttctaggtaggaggaaggaacgagctccataaattgtagaggatagctagtgcagcggggcccggcgtatgtacgcgcgacggcgacgccgcctgcatcactgcgcctgcatgatcactgcatctgcatcatataagaagagattaatgcttgattgtaacccgtcctagtgattaagatgcttggaactttgtatagttgaaggcacgcgcaacaccaataaatgagaggcgcgttgagaaataccggtggtgcgatggtaatgtagttggttctgtttagttcgcgaaaaaaaaattagtatgacatcagatgattgaccgaatgtcggaaggagtttttgacacgaataaaaaaactaactcgcttggaaaccgcgagacgaacatgttaaggatgtactcgtgactgtgtataaaaccgcgagacgaacatgttaaggatgtactcgtgactgtgtatggtggtgtgcacgtgtacatgtcttttatgtaacagaaaaacaaataaatagggaatctttcacaagaaacatttttcatttgattgcaaataactaatggaatttcaaagggaaaaaatcagctaaacactcagaaagaatagttatcctttatatcctagaagttctgccaaattcccattaaatttatg

SEQ ID NO: 3451 - DNA, 821 bp, Oryza sativa
cctccatgcagctttccaagaacgcatggagttcgtcctcagtccagtgagtgtgacctccgccggccatctaagcacacaaattgagcataccaaaataatcatgaggaaacacaaatagagcaaggtattacctttcttagtttgtccgattcgaggaggtcctagtccagcgagcgtgcaaccttctccggggtgaggcggcggatgaactgccggacggcttcgggggacttcgcagctacggaggagagtgcacgagtgacaagctccacatcgtcttgtgcagtggctccggatgcagcgtcgaagaggtaagatttggtcgaatcttcgctcaattccagctccacggactcctctcccagcttaccgacgtcgatgggcgacgccgaagaaggggaggagcagatcagaggttcagcggcctcaaatttcctcttggttcctcttgcagccatttgcgaccgaggggtctctaaaataggaggcctcggctcttcaatggcgcattttcgaaatgaatgtggccgtcgtcgatgcagacccactgtattgcatgagatcgatgcagcgattgatcaaatcatcctgcaaggcttcacgagcgcagcaggaatcgatgcctcgatgcccaatgcctcgtcgatgcagactgtcttccacgagatcgacgcagcgattgatcaaaacaaccttcaaggctgcatgaccgcagcaggaatcaatgccgcgtagcccggacgcggctggaatcgctgccgctactgggcacgccgcgcccctttgcactcgatgcggtatccgattcccctcgatgc

SEQ ID NO: 3452 - DNA, 8766 bp, Oryza sativa
  unsure (1)..(8766): unsure at all n locations
agagtggagaatcaatttactggttcttcaaaggcctatgccagcaccctcattaagagcttagtaaccatgaagtacactggcagaggggttagagagcacattttgaagatgagtgatatcacttcaaagctcaagaagatggacttggtgctccctgataagtttctagttcaccttatttttgcctccttgccttcagattttgaggcttttgttgtcaactacaactcacagccagaaaactgggacattgagaagctcattgccatatgtgtgcaagaagaggatagacccaaggctcgtggtgattccgccaactatgtgaagcacaacaagaagaggaacaactacaaccagaatgttgcctctcctaaggcacaaggaaaggcaccacaaagtgatccacatccacgaccaagcaatgtagaagtggacaaggacacttgcaagtggtgcaagaagaaggggcactattagaaagattgccctgatttcctaaagcatctcataaagaaaggtgaggacattattacatttgaagatgaatcactgtacataagttatttaaaatccacttggtgggttgattcaggtgcgatcattcatgttgcaaattcattacagcgattccatatgaggaggatgctaacaagaggagaaagatgcattagagtggcaaatggagtcgaggctgaagttgaagcaattggagaacatccattagaattgaataatagcttcacacttcatttgcacaatgttctctatgtaccctttttgagtagaaatttggtttatgtttcatgtttagcggatgatggatataattgctttttcgatcaacaattatgttcaattatattcaagaataagtgtgtgggtcttgccatataacaaggccagctttatatgttgcctaaacatgagaatgagaatgttgtatgcaatggagagaatgttgcgtgcaatagtatgtcttccccgtctacgaatgtaagaaataagcgcaaacgatgcaatgacgaaacatctgcgaaattgtggcactgtcatttaggccacatttcgaaggggataattgaacgattaattaaagaagaaattttgtatccgttagactttatggattccgaatattgcatcgattgtattaaaggaaagtatgttaaacaaataaagaaaggagccatacgaagtctaggatccatggcttacgggaaagcctatgatccttggcttaaaagggcctagtgtttatttcgaaatagggaggtattgtagttgttgcgtctgatggctcagtggtgactgtcatgatgaagcgtgctctatacatcaatctatttagaagtgaatattgagtatgagaagtaagaaaggcggagatcaaaggggagaatgttagttgcaatctcctggggaatcaggaaaccgattccccactccgcactcacacgccctgatctggggcgccagccgtacgatggctgtggtccctctcacgcagtgccaaataaaaaggggggagtggccggcacactaaaagaaacgtttgacggcgcacacgcactccccacaaaaccctagaaccctccgatccgggaaggcgttgaagtggggggattcctcacagccgcaccaccaccaccgccatcgtccacaccgacgccgccacaccgtcgccatggccgcatcaagctcaaagaccgacgccggtatgtctctctctctccccttccccgttcactccctaagtcaatcatctttatctccatgaggtagttcaacccctagatccgcaccgaatgatattagaatcctaacaacagttgcccattacggtgtgcacagtcaagttatctagcttacgccttgacattatggacctgtactttccactggaagggctgtaacagtgcttcctaatgtgcttgagggcaatgcatcaactacctgagtgtttaaagttaattagctgcaacaatcattggccattgtcctcttgttgcgaagaaatttggtggtttggcctctttatcgtggaatcgtgtgctgcaacaagaaccatgaatactggcaaccacttgaaatgatggacaataaaatcgattgcagagatggagtatcaatggcaccatcaagaaccatccacacaattggcagcctatatgcacctcatggcatagggtccttgagcagcaatcagcaagaatccagtaaaaacaattaggagttgaggacaaggaaacacaggccccgcatgagcaggggccattgccagagcctctgaactggtatttctttgttaaggacagccatattgctgcttactccatggtatatgtggtgttatatcaagtccgatactggttactgatcacgaatttttgaaacctaagttcaagataaacctctacacctcccatttccaaatctgaatgtatttggctatttgcaattccgttatagctggtgctacagggcaatactgtcatgttgggaagagatcatggtgttgcaaagatttggccacgccactcgcaatgatgtggagcatggcagcacacgattgccatgccaccttgtgtggtgtaggaagaaggttcatttagaaaaggatacccccgtaactttattttagaaaaatgatttcaaaaggtatagaaataatttcttacaataaaagaagggcaagaacacattggcatgaaaataaaaaggttacatgtgaaagagaactcaccgccataggtaaattttgatagcagttcagcttcagttgccctcttcaaaggataaatgaaaccaatcaaatttatatcaataacgattacttatagggtcagaaaaacaagcaacactatggaactatgaccttgccctcataacatggaaaaacttaccttgccctcataataaccttgcaacaagtagttcacaaaaccaaagtccgctgctgacacatacacaaatctcttaatacctgcaggtagagcatgatgtggaagcagttaagtcccaaccaaaaataatgtgcatcagcatagacttaattttactttgccatatcatatgaaataattgatcaaaaatgaaagatttggagtgattcctgccttcggcctaagcaagcaccgggcagtatatgcaactctagtgactagatgtcatgcatcgtcactgtccaagcagtccaagctacagtacatggctgaatggtacctctccactttttgtgtacgacagacaagcccaatatgcaaggaagtaaagtgcatgtttctagataattattcttccagagataactttgtgaagtactagtaagaaattgtatttatttatttttttggaaattatgacacaagagttagtattctgacatttacccttttgctttaattgatctgatcataagaactacacactatactgactaaaggagattacaaactagtggggagaatcatatcaatacatgtgaaaaagagcatattgatgaattgacagaaactgcaaacataacatagaaaatgaatatggtgctgcaacaatatgttctcaaacataaatacctttctcagctgcaacactgatggcattgatgtttgcagttccattaattttgtacatgtaagaatntgagccaaagcctccaacacatgatacctatagcaatttctctcatatgagtaatgtttcaagattcataaattcatgttagcataaagcagttactacttatatgttataccttattagagtatcggtgcataataaatttanaaggtatcaacggtgttccagggatgatgataaaaggtttaacacgaagtggaaatatttccatcatactaattaatccagtgctcatagaacctagatagtatgacccaataatccanaattatctgcaggcaagggaagtggcagggatggatttgaaaacctaagtgataacaatttaaaaagatggcctgtaaaaaaccatttccacgctagatcaaccaagagttatgagcaatttgagccaagggagtgcaacggatggagcttggaaactaaatgatattaattgagaaggatggattttagaaactaaaagatattaacctacaagactgtacagatccaccagatactcattggtgccgacatgtatggagtaaaggcatcagatacctcttggtagtttcaagtctagtagtctaatgaatggtacctttaattagatttccatgacaataacagcagaaaacagtcataataatgcgcatacaaaataacaaaaaccctaaccccaacccaatcactaataaggatttgaacaaagaaggtagcaataagttagtatttgatgcttgaggtgcccaatatatcatttcagaatcatatattaacttagtacaatatcctgcagttgtttcggcatcatgtaaagaccagacaagtgagtctgtttcaactttcaagagacttgccaaagatccaggaaagtacaagggtaaaaaaaaaaaaaaaagaggaaagcataaatgcaagaatgcagttttcagtacaaaaatgtgcaccaagttaacaaattcgaaaataaaagtgtaaacataccacagcagaaacaccttccataatatccttcagggaatcaggttcaagtagattgcctgcccaataaaagagacattaagcaacataatcatttataagcacaataaatttatctcactagcaaataacctttgttccatataactttgtcagcccaagattcacttattgatggctttccagatctgttaaagtcaaaaatcaagagaatggtaagtcattgattgaaaataaagattgatgattttgaagtatataaagtctgatatttgtttgtctgataatacatcagatgtgtcaataaggaaattatgaattcaataaagcttcaattatctaaaaataataaaaatttaggaaattcaatgcaagactacagctactgaacagcaataagtacattcataaattacatgagtattgctctcagaatacaccattgacacccccttgaaaacactcacagaagaataagatgaaaaagaaaagatcaaactaactctgattatatttttacattgttaacaaacttctagaatcgaaatctaatatgagtagaaacagcttcacacagttctgttcagtgaccacaatagaggaacaaaaggagaatgagagtctcccatgaattttttctaaagctaaaggcatcaacacaaacttaagagaaccatataaagttatctacagttagattagaggattcagagtatccattgctcttccatatcagatatcagggcaaaaacgtgtttaagtttcaatagacatacagcctctgtagcaatagtttatttatgattttggctagttacaaaaaaaaataaaaaaatatatctcaaaatcaaacagtctgacaacaaaatgagaatgaacatgtcaacagatacagcttacagaaatacctattaagactagcaacagtaaatcctttgtccaaagcctccttgcaaacatgtgaaccaacaaaaccatttccacctagcacaagaagctatgtcgacatatatgtcagtagcaattcagtaatcttcaccaaatggaaagcataaagaataactccatagaaaaatgtacataatttatctaaaagctcgaataacacgtagttagctgttaatattaaacaatacatttccaaaaatatattaattgctgttaaacctgcaggaacaccattcaaaacagaatacttgttataatatttttatcggtctgtaatatattgctcaggataatgaagataagaaaacattggaaataggctaagcacttgtctacatgaatattttagttatatatgacctttctgttggaaatgaagaattgctttcccttgaagataagcacactatagagatttaaatatcataaagcaggatgtatccgtgacatattcagggaaatattttgggaaatgcttaatgcaaaaacacaatatgctgcacaaagggaaaaaagaggtttccatatcaaatcaatctgaagatctggtaaaataacattgtcggtgtagtgaacttacagggcttatgtagataacatttcaagtctaactgtttcaacattgagagcaatgacaatgaaatagttccgataaaacagcacaaaagaaaggcgagatgaaagaaaagggaatatgttagcattcgaatcaaactagcacgtttatgtttcctctaatgcattttcagttcgaaggactacatcgagattatcgaattcattttgcaacttttcagttacgtaactgatggctgcactggatatctccccaacagccaacatgtccattctatgacaataatctacatcagatacaaccgcataaaccaaaattcatcccgctgatagtttaaaatgaatacactaggtcactagcccactatgatagattgctcattcagaaaaaaaaaaaagaaagggaacaatgcaccttataatatatgggtaagaaaaggataaaacgactgctaccaagaatgactgccaaacaagctaaacacaagaaaaagtcttaaactagtgcattttacgcaaactagtaataatcacattaattataattaccttgtccggggaaggcggtggcaccttcacggtttctgcttcctccaccttgaaaggctcctccacacgcttggaagcatcctcgctcaagaaagccttcccattattgttctttaacaagtttgcggcgctgttggcatcatcggtcacacaaggtagaacagaacaccactaatttagcatcataataaaatccacaataatcataacaaaatccccctattgtggtggataagccaacgaggaggtaaatgcggctcctaattccccatcctaacgaagcacgcgcacctttgcacgccatctcatctcatctcatctgaatttaagggtttattgtttatctcttcccaaaaacttgggggatgtttcgacggcgggcgcgcgcggggaggggctcacctgagacgggagggcgagactacgggggacgaggaacggatcaggcgggtcatggccgacctcatcgccgccgacgatgccgccgccgccgccgtactactcctttcctcgcgatctatcgagagcggaagcaaagaatacgcacgcgacgcgaatggtctttttttcctcttgcgagtttgtttgtaggcgagaaaaaggtgaaaagcggtggcagatggcaccgctacgtgttaaggctggcaggctgccacgtgatagggttggcaatggggcgggccgggtgcggccctggccctggccccgcttttctacgggctcgctcggccctagtccagcacaaagaacaatctcgcaccggccctagcccccgcaggactcgtcaccggatcggggcctcacacgaggtgactcttgtctccgagaatgtgaacggcgactagcgctcccgacgtgggtggtggcatgggaatagcgactagcgccaatggcacgattggagaagaggatggtaggtggtgcatcgttgtagcagacagttgaggaatcgccaaagctacagcgacaataacaatgtggattggatggagtcgtaggagcggttaagcggagagacatgatgagaacatattgtgtgtttctcaatgcatcttcctctattaggtttattgaacagtttttagaaagaaaaaatctcaattctcctctcacctctatttatctatgaaaatcatatgtggcacctattctcattcttatgccattatttatgctcttacttatctcaattgaaacatgactatatgggaaggcatatatggttcacatgcatacaaacaaaacgaataccttatcccctctcccacatgttcccctcgctcccatggcatcacagcaccactacccttatagtgcctttgcttaatgccacaagtaaaaaccacgcccttatctattttcctcctccaacgagctctccactcctactctgttcctattttcccaggagtagatggtacgtacaatggtgaggcaaggtgggcttggttgaggtcacgagtgaggcgatgattaggctggtggcgacaactccaatgtgcatgaggggccttcttcatcctccctgacaaggcaacgcgtggccaaaatctcatttttcttcctcccctaattatgtgtcgggccactagtgagtggtggttagaagtttatgatttgaaatagaaaggttcacatatccggttggaaaaaaaaatctatttttgagcaaacaattccaaagattgttgaaagttaatgattttgaatagaaagttttggcgttttttagttcatttgaaatttcatgtgcacaactttctatattgacaagttctttttatgtataaagcttatagactgaaagttcatatgtacaaaaaaagtttataaatcaaaagttcctcaatgtattacatttatacattggaagtttatgtaaagtttatagattgaaaacctctggattgaactcgaacatccatctattccatgcataaataaataccaggaaaggtgtttaggtgcgtcaaaaagagaggacaaccaattggcactccgagcacatgtgactgaacgttcactcattagggtttttgatagctccaagcttccactaacaagcgaaataggggctgcaggaat

SEQ ID NO: 3453 - DNA, 2540 bp, Oryza sativa
taagtggggtattatccttatatatttttgtattttttaaacgtggtctatttatataaaaaagatgaaaaggataactacaatagaagacaaaaaaatactttagtagtaaacatttctagaactaaatacataggagaaaatggttgtatgttaataccagaaccattatgtgggaacaaaattttcttactgctttgaaaccgagaacttcgtataaaccacaatattaaccacaatattaagtaccacaattgatggggtcgccgaacaactttggcgtcagaatcttcacgcacactaagggggtgtttagattcataggtgtaaaattttggcgtgttacatcgtatatactgacacatatttgaaatattaaacgtaaactaatcacaaaacaaattacatattccgcctgtaaactattagatgaagttattaaacataattaatccgtcattagcaaatatttaatatagcatcacattgtcaaatcatagagcaattagacttaaaaaattcgtcttgcaaattagtcacaatctatacaattaattattttttaaaacttatatttaatattccatacatgtgtccaaacattcgacgtgagggtgaaaaattttatcaggtgatcagccctaatagaaaggccagcaatgaatggattttgtgctacactcggtacgacttcgaatatttctatgtaaattatcctttccaattcctattatttggcatgaacgtctccaagattactctttctaccattttatttcgtgtctaaccggagtgttttgtcgaatagtttgcaagaattgaggaatgtgcctctgtttgaaagcgtcggaaatgggtgtgtgcgcaggaaatcagttcagacatttgtcatccaggcttatcaagccttccctggctgcttcgatcaattcattcagccaattcgtcagaattgtcacccagcctcttactaaaattcctgcaaaatactgaactcatactacaaattcaggtcctaacattcaggtattatgctaaattcatactaaaattcagttaaaggatgtgtttagttcctaaaagaagttgaaagtttgaaaaaaattgggagtttggaaaaaaaaagttgaaaattcatgtgtaggaaagtttttttatgtgatatgatgtgatgaaaagttaagaatagtgggatactaaacatggcctaagttctaaatactagtaaaattaaatccaggagaggtcctagtccacatgttaaatccaggagaggtcctagttcacacgcaggttcttcacgttgataggaatcatttggcaaagtagccaggtatgaggtatcccccgaatctgctttaggcgatgactgcttttggcaatgacaactgttctgtaattgtttggcaatgacaactattctgtaattattcattaaagttcgcaattatttcacaggttgtatttagcagttttataccatgcaccagaaaaggataaattcagacattacacgcagctaccggactgaaacgaaaccaaaaagaaactgttttagaatggaggatttgtgggacaaagaaccatcagcggcaattagatttgacctcaaggaaatattcagtccgcatcatggttggatcgccaaatggcaaacccacatcatttggttcttcccattatttttatccacaatgcacaaaacagaaaatgcaggagaacaggaaaacaatcgtccctgctcatccaagaacaagagaacaagaaacagaaaaggcagcaattttgtttcttcaggtgaatgagatgaacaggctcagattgataatgggtagtaagtctgcttgtcagcaagaacaggagagagatctctcccgagttcagagtggtgcatgactagttcctcatcatcgccatctcgaatctcgatccaagaaaaacaacatccacaaattgaaaggaaaagaaaaacagccaagcaggatgaatcgaaaaccccccaagaacccaaaaccagacgagacgcgagatcgaatcaaaccgcaggaagcgtaagaacgagagggatcctcggatccacgaagcggaggagggagagggggagagattcgtcgcggcggcggaggcatcgcaggaggggttcgactatttatgggcaaatcctcctctagctagggtttccttctcctaattcggaccgacgagaggctgacaggcctggcccaacaacccgagcctttctcagctagctttgcccggcccggttgcaggagatgggccgagctatacaaatggcccatgtgccaagcccatctagcccatgattcccttttattattatttttttttgaaaaaagagggagcccacgccaaccatgtgggactgacacgtgagcctagctactcgttaagagaatttaggcggtcttcggcaccatttttcccaacctccaggcgtgtacgtttttcaaacggcaaaatagtgtgttttttgcaaaaaaaaaaaaaacttctatacgaaagttactttaaaaaaatta

SEQ ID NO: 3454 - DNA, 10342 bp, Oryza sativa
  unsure (1)..(10342): unsure at all n locations
catatgcccttctcctcccttcttccttcagcattgcgtgagtttctttgtttttttgaaagctatttatataataggctttttgtttgatcttttcttttcctcctaggtcaaggtgttctagttcttatccaattaattatttattgtgtttaatttcaaagtaatatattaggccaacacacattagatgatgacgctaacgtatacgtcgtacttgtagtgttggttataaatatttttttctcctaccttcttactaagaacaactttgggtttgttcgggggtccagtctgcggcaacgctgtgactgggttgtagcagtaaaagacaaaaaaaaaagttcatgctggttttctgctgcagcccgcccagccgcaaggtagccgaacggagccttttgcatccaaagctatgggttttttttgtgccatttaaaggccatcatcggtcatattactatatacctccaatcacttgccataagatgccaattgatgaagtgaaagagagaagtgaggagagagagaagaatgcacccattatgaagggacaagatctatataaactctaatataattatgagagtattagagttatttggatttatatgttagagataactatttatgtgttgttgtctcttagtctataagtagatgagataaataaaattagatgtagtagtcatggtaacatggtgttcatctatatatgatcttcgatatggtataaaagtttgagtactcatacactatggattttcattgttgttaatataaattatatatttatgtataaataactatgaaaataaaaggtttatatataggtaccacacaaaatggaggttttcatataggttttgataatgcctccattttgcatgagaaataaatgttagataaaatagattatcccttatttatcaaattccaatgcaattatttcttattttatctactctcaatgcatttattttctactctcacaaacttcaatttaataactacttaaaaataaacttattttgggagaaactggataagctaaaaatgaactcgtttcaggaaggagggagtatatttttagcatcacatttttttaatttctttttacgttgtaaattgtaagtagttatattgtaattacaccatacttactacaaattttaataggtgtaattctttaattactttgttatatgagatatggaactaaaaaataattataattgtgtagtagtatcagtatcctaagattgggtttttttttaatacggagggagtagttatactatctatgcagattaacaaataaagtaaaaaaacaaaagcaaaaacaggagagagaggccaaggcgcccggcccgtgcacacgatgttcaatcaagggcatttgaaccgttaagatctgactagtcccaaaatgtagcgacacctttttagcaaatccatttgatcaaatagactaatttaaagctgatgacatcaattattgttttcacacagagctaacgctgacgatgagaacgcgtccattgaatcttttcagtttctcgacgtcctttctcttaggaaaaatccggcaagcagttacgggttgacccctacagttattagtacaaaatgagactaaagatcattttctacatggagcttattctaaatttccaatctaggcgacaatagaccaacatcagttacccttaggcaggaagatagagctagtactccctccgtttctaaatatttgacgccgttaacttttttaaatatgtttgatcattcgttttatttaaaaaaattaagttattattaattcttttcctatcatttgattcattgttaaacatatttatatgtatacatatagttttacatatttcacagaagtttttgaataaaacgaacggtcaaatatttagaaacggatggagtagctttttatcctcctgaaaagcttacaaagacattgcagccaacaatccaacataagctgaagtttcaccaaacagggttctacttttcctttggaacggaggaattttgttggagaaattttgaagaaaacgaattacttgaaaaatccaataaaattccatgtgtgaaatgtattcattggcatagtgataggtgcatgtgtgcgattttaaccccaagatccccgtgttcagctcttaacacgctcacactgtattcttaattattcgacaccaaaattctccttggttaccaaacgttctcagtggctgtgatataaaatccacatgtgtttgcccttaattgattctccagtagcgtgtttggaactgggaaataacaacatgtgttcccttggttagatggatatcactgtcttggccagattctgacgtcttgttcttggttagttaggaccatccactgatccgtggtgacaaattgacaaactgaccacttctcacgtcaagaaacccccttccttttacttctacgtgtcgctgcaggcaagagatttcagagtaagcagcagcacgcgcgtcagagaaggagaagaggacaggtcaaaggaaagggagcagttgggaacagatgcatgcagaaaaacctgagctatctcttgatttcctgcaccctcaggtaagcaaaagcaaagcgaagcaaaggagttttgaactctttttttttttttgcctacctccatctggaagcaaagtaagacctgttccgttaatcaacatcatgcatgcccacaaaatataatcttttcatgttcatactcaccatacacatacacaacattgtctttctttggccttaaaaaaaattaacatatgccaattgatggtggctatactgttatagtagtgttttttttttttttggataatggaattcaatccggtctctgcatcgaagatgtacacggccacataatagagcaataactctggatagttggtgtttcagagatttccatggaatagtattcttcatgcttcacctaaaacattggatggctcactttggttgcaggtagccttcaaactattaggcctactggttgaatcgtagtcaaatcaagattcctcctctcttttcttttcttttcttttttctgtcctggtttttgtgtgctgtgctgtgttgtgtctgccttttcaccacattcacttactcgcttatgtagtaaccttctttgtaagcttcattttagcagtttacctaaagcaatttcagattcagtcatcccttgggtgcaaaggcactgcacattttttttgcttcaggtccaaccaaactcttcccagttgatcagttgggtttggtgaacgtcagagcttctcctgcttgtgtatatggtagccaatctacattggaagtacaggaaaagaacctctgtttcttttagttttcttttctgttcatgtctactcttccattcacctgtaccaagaaaatgtcccttgttgatcatacattactgaattatcatccagaatgattgagtagaagtagtatgtagtacagttctgcttgttcttcagttgtgtacatctctgtcagagttgcacaccaactctgtctttgcatataacataagtaaggtcacacctgaagcaaaaggaatgttaagagagtgagtgagatgaaatgaaaacacgcatgcgaccaaaggaagacaaatggaaacaactgaacaacccttattcagacaggactgtgtcttaggtttgtagtaggatttttgggactgattgctccctacatatgcactcacctttttgcaggccaaggattaatatcctgtgaattaaattaatgtgattggttgcgtgcatcttagttatgtagaggttgagaaacgctcaggggtcttccggctagctccacaaggtggtgggctagccggcctaggttcgaagccttacccccttctatttatttgatactagatccttccctaatacctgtgttttcttttttagttatgtagaggttaagagtgttcttagtacggttgtatcaccttgatgtaaattggctaagttcaataaagcttccttatcttaaaaaacaataaattaatgtgatctgttccaaaaactagtgacaaggaccaggtctccaacagttcctgcaggaacttgtcaaacaaggggttgttcttctggtcacagctctcctgccaaatctataagttgctctctctctttgcctaggtttggagctctcatcatcttttgctgtcaagccatgcattccattgcctcctgagaacctccttgataaacatctcatctttctttgtacataaaccctctctgcaagtgtgttgtctcccttgcttcttgctgttcagctgttctatctctcaaaaacagttcaaattttcgactcgatatcgagctaccagagttgatataggaggaagataggaagatttatcaatcttcagagtttacggaaagtggaggtttatcagcaaagttcttcagagagctgggccacctgaagaagggtgattacatactaggattcaatttggagtagtgttttttttttgcataaaaggatgagaggttttgcttgtgctcatcatgcagagaagaggcaccgtcttgacagaactctgtgagtcttttcttccctccagtagttatagcaaacttgcttcctctgcatatttttgctaaatatttagcaaacacagctaaaatctagataaacctggctaaaatttacatatttagaatctcaggttcccagtgaaaacttaatgttatcttcacccgagcataatgcataacggcgcctatgattccttgagcaccgaacattttgaattccatccatgcatctatccagtatttaatcttgtccatgtaaacttgtttacatcgttgcatattcatcatcgacaatgatacgcttggtgataaatactatgcatgatcttaagtttacctgctatcaagttttaatcctgtttaaatacggttcttagcgtgttttcgtggtcatgttcctgagcccatggaaaaggttacatgaccacgtatgttagcaatgcaaaatggtcgttttgaagtcaatatttgcgagtatttttataacatagagtagttattaactaccaacaaaattgcagttttttccaatcacagtacaaaagtacgtcatcctggtgactttagcagagaaaaattactccctgaagtagttttttttttccaccaatagaaaccagaagtgatgtgcccaacaaaccaatttgaattaatcctcctaatttcgtgtgctctgaaccaagagagcccaattctccaaagtttggcgagctctgctaatcaaaattcctacctttaggtgagctaacagtccaataaaagattaatttatagtaaatcacgtcgtaggaagttacatatatagctagcaacctgcagtttcaccaactccgtttgcaacttctgaagaagaaaaagtcacaatggcgtcacgagttctgaagaagtctctcttcaatctgcatgccaaattgccaatttggatggaagaaaagaaaactgtgttctgaaattaacagaatggtgaaaacaaataggttcatgtaagaatagagtcaaaggtagaaaaaaagaaaaataataaggaacaaagctattagggattaaagcgataatgaagagggaattggcacgatgatggagacgatgactagttgtagatgtaagcctggaccgttgaagcatggaactgactgttcttgatgacttcttacaagaggagatgaagaaagagagccattcctttaaaaaaaacaagaagaaagaaagaaagctatgacacatatgactttctggtcttggtctgaaagtaatagaggagatgttatgaaattggtcgtttgaagaaaagtagaaaatgaccaaatgcagaaatagtgattgctgatcacatattggtaaaagccaaagaaaacttaacacctaagttttttttaaaaaaaaccaacaccttagtaaagactgacaagtaattttagttacaggtaatgatttggtcacaaggggcaatcttgttcagttcaaccatatgatttgtgacctttgttagaacttttgaagccctcaactgcacatgctatcgttttctacatatggtctaaatagttatgcaatattctgaagaaaatcgcaaccggattatgaactaattgtgattatttacccgtgttaatttcagcaacagcctgagcaagaggggatacataggaagctaccactacgagaaggatgccaagtacaggccattcagtgcactgctccctgagggttcaaaccccaagatgctctatgtcaagctcgtcctcatcatcctcatgtgtggctccttcgtcagcctcctcaactcgccatctatccatcacaacgatgatcaccacacagagtaagaaaaaaaaaccatacaaaattcatgtttttattcgcaagatttttttaaaaagcaataagttgtaacaaatatttcttttgaaaagataaaggttacgatcattaccacaaagctaccaaattatgtaacataaaatgtagtaccgtttggtgtcttgtaccaggagataccatatttcacaataaaatgtagcacatctttgtatctcctcaaatattataaaattactctttgaaaaaatgattttaatgtcgttgaggaggtagtgaaatgtaccaattttttaagccaagggtcataaaatccgtcttgcagccccattgtttggctgataagaggaaataacgaaacaacacatttgcaaacgaaaaataatttgtgaataaaatttttatatgcgtgttcttaataatctaaaaacaaaggttgaaaaataaactacgatgggaaaaaaatcccaaaatcaactctaaatttaagcataaacgaaaagatgaggccgttgatacgatggtcagtgattaatcctttgcttcgtctgaacttgaaacgcgcaggtcatcagctggagtgccgagagtgagctacgagccggatgataccaggtacgtgtcggacgtgacggtggactggccaaagatctccaaggcgatgcagctggtcgccggagcggaacacggcggcggcgcgagggtggcgctgctcaacttcgacgacggcgaggtgcagcaatggaggacggcgctgccacagacggccgccgcggtggcgcgcctcgagcgcgccgggagcaacgtgacgtgggagcacctgtacccggagtggatcgacgaggaggagttgtaccacgcgccgacgtgccccgacctgccggagccggcggtggacgccgacggcgacggcgaggaggtggccgtgttcgacgtcgtcgcggtgaagctgccgtgccggcgcgggggtggctggtccaagaacgtggcccggctgcacctgcagctcgccgcggcgcgcctcgccgccacgcgcgggcgcggcggcgccgccgcgcacgtgctcgtggtgagcgcgagccggtgcttcccgatcccgaacctgttccggtgcagggacgaggtggcgccgcgcgacggcgacgtgtggctgtaccggccggacgccgacgcgctccgccgggatctcgccctccccgtcggctcctgcaggctcgccatgccgttcagcgcgctggcggcgccgcacgtcgcggcggcgtcggcgccgccgccgcggcgggaggcgtacgcgacgatcctccactcggaggagctgtacgcgtgcggcgcgctagtggcggcgcagagcatccggatggcctcccctccggggcgccgtcggagccggagcgcgacatggtggcgctcgtggacgagacgatcagcgcgcgccaccgcggcgcgctggaggcggccgggtggaaggtgcgcgcgatccggcgcgtccgcaacccgcgcgcggcggcggacgcgtacaacgagtggaactacagcaagttctggctgtggtcgctgacggagtacgaccgcgtcgtcttcctcgacgccgacctgctggtgcagcgccccatgtcccgctcttcgccatgcccgaggtgagcgcgacggcgaaccacggcacgctgttcaactccggcgtgatggtggtggagccgtgcggctgcacgctccgcctgctcatggaccacatcgccgacatcgactcctacaacggcggcgaccaggggtacctcaacgaggtcttctcgtggtggcaccgcctcccgtcgcacgccaacttcatgaagcacttctgggagggggactccggcgagcggctcgccgccgccaggcgcgccgtgctcgccgcggagcccgccgtggccctcgccgtccacttcgtcgggatgaagccgtggttctgcttccgcgactacgactgcaactggaactcgccgcagctcaggcagttcgccagcgacgaggcgcacgcgcggtggtggcgcgcgcacgacgccatgccggcggcgctccaggggttctgcctgctcgacgagcgccagaaggcgctgctccggtgggacgccgccgaggcgagggcggccaacttctccgacggccactggagggtccccatcgccgaccctcgccggaacatctgcgccaccgccgccggcgacggcgaggcggcggcggcgtgcgtcgagagggagatcgagaacaggcgggtggaagggaatagggtgaccacgtcgtacgccaagctcatcgacaacttctgacgtgggtgcatccggagccgttggattttgagatcggacggtgagatcgaggccgttagggatgggtgacgtgttcaccaatttttggtctctcgtgcattgcattgctatgcaatgcaagcgtgccaccggggatgttgcgtggtagcgtatggccgaaatttctttattacaatgatgagaaaagtagctgtgaataatttaggtatttgctttcgtaaaatacttagaatttttttgaagagtctatgttttccaaccgtaacattgcaaatatgtcatgtttgctatgttaatcctttaaatatgatgatactagtgcataacaacaaaattcattttaaaaatggattgtcataaatcattgacacatggagccttaggttagtttcttcgtttctcatgctcactcggtcacttccttagttccttacatgtccaagcaaanattcacgcttagcttgcccttttgtatataccactcacatccttacatgggctcttttttattgatcaaatatacattgtaatgtgtgtttttttagaaaaaaaagaacaccttacttacatgggccttcttttggttctagataaaagaaacaccttcctttccagaggagttatgtgcacatgatttcgtcgaaatgcaaatcttacactattacaaaataattttcgtggctcttggtattatttttcactgacagaccaaaaggaataatatctatgaaaacgtttgaggccgtcttggggtaacaaaccacgaaaacctattttccgggtgggtccttaaggaaaatcgcatgtgaaaatatatctaatttcgtatgcggttttcctaaagagccatatgtgcaaatcatgaatttatgaggtggtttgttaagaaaatgaccacatgtaaaaatggggtaatttttaccggcgattctcttagaaaaaatacatgtaaaaaatacaatttcatgggcgattctcttaatgaaccacccttagaaatatgagcactactatttcaaaaaaaataaaacgcacccttccatataaaatcagatgacaacgaactctatatgaaacttagagcatcctcattgtctaaacccctccaacggtactaaccaagtctacatagaaataaaggctgagagatactctccccgtccaaaaaaatataagggattttggatgaatgagataattttaacccttatattttagacagatggagtttacgtgcagtgtgtaaagagtacttcaacactatagtgggaccacaaccatgtagaatttatgtttctctctcccgtattggctcttggccaactgttgctgccatttttgtaaaatgtgatatttattttatttggagtgttcgctcccatgggaagagtcgatttgctatatgcttggaagagacatgttgcctgcaatgtgtagtgccgcgaaaatattcctttaggccatgttcggttatacaaggatttaatccggaccgggaatgataagtatagtaagaaatttatgatagatacaacgagagaccgggattcattctgggccgggaaccaatttactcatgatagggacaataagagactggaaatcaat

SEQ ID NO: 3455 - DNA, 3804 bp, Oryza sativa
caaccgcctcgtcaaggccagacgcccgggccgttccctccctctgctacagcccaatcagcccatgtacggcttgttcagatcatgcatggacgctgcttgttgacttcatattgtcattgcacacaaattttgacaatttgaccttttgaaaaaactaattttacaaataaaccgacgccaaaacttatttcaaaattgacccttttgttcagcgccaaatcatctggcgctaaacttagacacttcagcgtcacgtcaactgacgctgaatgccgtgccaccgtggatggatggaaggctaagtcagcgtaccaacgcacattcagcgccacgctatttggcgctgaggtatctaagttcagcgctacacgatttggcgctgaacaaaatggtcatttttgaaatactccctccatctacttttgatagtcatatttcatttttcatacaaaccaaggataattaattctacttatcatccatttaaacatgttactagtcattcctcataaacaagcgatttattaatatttacatttctcgatgcccatgcagccaatcttgtgtggaagaatatagagttacacattaaatccgagaaagtcattaagaggataagttgttggattgaaatatgcctatcaaaaataattttttcagatttgaaaatatgactatcaaaaatatatggagggagtaagttttagcaacggtttatttttaaaaatagttttttttaaagagttaaattgttaaaatttgtggtcattgcagggaagagatttttcatttgtgagaattccaaacatgtgtgtaattaattccagccggtttactcgttcagtcttccactctccattctaccaccatacgttagcatcaaacttactggtagtactgatatatagcatatactactatccttctattgtatacttcgtttgttaaaaagaaaatctcattacgaatatagatatagactatatttatatcaaagttggatttttctttaataaaacggaggatgtatcagtgtatgtcgttgtctgcaacaagctcgattcagagttaaggaagagaaaaacataccttcatcctgaaatataatgatgttaaaaagaaacgtgcaattaagaccagtaaattgactagagcaaccaacacagttgtcatcagtacagataattgacgtgacatcagcgatgacgccgccaaactgcgcttctctcaaatgccacgaaattttcaggcagacaaaactcaaaagtacgtagcgtgtagagtactttcgtcttttctgttcctgttactagtaccaggcgctgtttatttcagcgcaaagtttagattttggttgaaattagagatgatatgactgaaaagttgtgtgtgtatgataggttgatgtgatggaaaaggactgaagtttggatccaaattttagatataaacacagccttagttaattaagaaccgaattaattgcttgaggcctaagctaatcatccctaatctttgactcaaccccttgcacggacagacacagtcagaccgttgcgtttgttaaaaacgaaaaggtagctagccatcgactatgacagcaaacgctaggcttaatagccagctatttagctcttcgactgtcgccctctcatgcgactatatactggagcatcgtcagcgtttacatctacgattctcgctcgacaactcgccattgtgcatggcatatccaactaaacatactctctccatttcaaaataaattaacctaattaatatataatatgacacattataaaactgaacaaactgtttcttggacggagggagtaaatgcatatagcaagagtacatataaaaggtacgatatatctaatgaaaattattaaataagtgaaaacccatacgttctctaaatttctccattcactctgcaccaatcgaaacacacacttcctccattcaacatatattagttgtcaggtgtttcaatcttctccaaaaacaaaagttctctaagtttaaccaattttttttaaaaagtaattaacatctataatatctaatcaactctaaaattaagctttaattcaaattttcgctgtgactgataaactaaaaaccaaatgtgatgaagccataaaatttataatatataacttatctatataagctattatctataatctattacagtactattatattaatcatccaagaacatgctcaaagtccattgtcaacctctatatacctcctctctacgcaccattctttctgaattcgctgcgaaggatccttcttgtagtactctccgttgaatcttcggctgtcgtcgtttcagatgactccggctaatcatcagacatcctgtacggtagactcttctttgctcaatcttttgtggagtataggctgtgttaagttcacactgaagtttgaaagtttggttgaaattggtatgatgtgatagcaaagttatgtgtgtatgaaaaatttgatgtgatggaaattgaaaagttggaagtttgaaaaaaaactttggtactaaacagggccatactataggagtacgtacttatggactagatctgtatgcggtgttctagcacaccacataggacgacgacgtagaaatttgtgtcaatgaggatgcgatggaataataattaggaccattttgcaaattgacttttactcgtacaatttatttgtcactttacaaggttaatggttaataaaatatatttttacaagtaagaaaatatttaagcacgtagtgtagagtttgcctagacccctaaaaatgtagagaaggtggtgcagtaataaaaacaatcaaagcatcggcagattaaaacaacggaaatatttagtgtttaaatagaagaaaaatgattttaaaccattcatatgaactaatcaaagttttcgaaaatccagctaaagctagtacaaattagtgacttaaaaaccgtgcgtgtatagagttacaaccttggtgtccattttaactttcaagtgatgcttaatacctctaatttaaaatatagcaatttctaactatggtcccgttcttttctccaacaaggttggatgaaaattaagattttcgtggcacgtttttcaaactgctaaatggtacgttgcgtgcggaaactttctatatgaaagttgctctaaaatatcatattaatctattttttaagtttgtaataattaaaactcaatcaattaaacgttaataccacctcgttttgcgtaaaaaaatcaatcttcatcttcaagagaaaagaacaccacctatatactagtattatttatgctttggtccaaatacttgcatattccctccatcccaaaaagctcaacctaccccttctaggacaacgaatctgaactaccttttgttcagattcattgtcctgagaggtctcccatccctttttaggttgattttttttgacagagggaatacgagtaagcttgcgttggaaggcatagggcctgttcactttgatgaaaaaaaaaaaaaccttaccaatgccaaaaatttgatatagttatcaaaatttggcagcaaactaaatatagccactttttttacaactttaccaaaaacttggtaatgttaaaaatgacatcaaaagtgaacaggcccataatcacgaggaatgcatgtacttgtgtgaaattaaatatagtattaaaaagaaaaaaaagaaacctgcaaaacatttgtagcactcgtatcagtccaaaacatctccttttccttgacgaacagatcggagtact

SEQ ID NO: 3456 - DNA, 1463 bp, Oryza sativa
cgccgagggactccgtcgacctggggggaacgtccgcgtacccgtccgcctgcgcgtctccatcctccaccacgccgacgccgacgcggtggggcgccggcgccagcgccgtgcccccgcgatgcccggggccacaggaccagcaccacgggctgccgctcccgcggccggtgtccaagtcggcgccgatgcccctggcgtcccccgccgcggcgccgccgtcgccgtcgccgccggcgtgcgcgtcggcggccgagtcggtctcgggcgggagctcgtcggacgacgaggcggatcaccggaattacaggtgatttgcttcgtactggctgctccgttttacagctaccgacctgctatttttttttcatttttgtttttgtttttgtttcggtttggtcgggtactccaattatgggcgtagctgctacaactccaaaccgtgatcgcaacgaattcgacgcgattaccctttttccagttcgttagtagtaatcacgaagtgtgccgagtgatagtgtgatttaggggtcttgagttgacttctaaaagaccaaactgtgtggagactgaggcttcgcaacaactgccatacggccgttgacctcgtctcttctctcaccgcctatagcgtacaaaaccgtattcctttgtttattactagtataattcggtggacttggggagtcaggctaccaaagcgcgtcaaaagttcaacccatccttcttttttattcattcaattgtatttaagatattttatgctaggatatttatgatattgttaactaacagaatttcccgcgtaatttgtttgcgtggaattcccgcgcaattttgcccagatagaattggatttgatatacaactattcctgctttgataagaacaagtttgtcttatgtaaacctttatcaataaatctgcaccgttgtaatctaaaacagcgcaaatctttctcatctttcgttaacgtggaaattttttaggcatagaacaaacatggcggctacttatagatagatagaatgtctaatgtattcctaacaatcattctatggaaatgaatgctttgttccacttggagacgcaaatctttctcatctttgattagcgtgggaatttcttggcgtagaacaaatacggtggctacttatagataaatagaatatctactgttttcctcacgatcattctatggaaatgacgccgaggtgtttctatgctaggagtagcattatctgttccttcaagaatgatgccagagcataaaagaatgcatctttttatggcgtcaagctaaatttcaacacattgatggttcttttctttctgcctgtagttatagtgcgtgtttcatgcctttgccctttctgatagtgtccctgtttggctctattttgttttctattgaaagatgacctattttgtttttcgacaatctgttcctacagtcctggaag

SEQ ID NO: 3457 - DNA, 2116 bp, Oryza sativa
atgtgactcattttttcatgtactttgcatccatgcaggttcatctttgaagtttatatagaattttagttctatggctagatcgcagctaaatcctttgtttttctgtctaaggctgtatacccaaaatgttgctatgtgtaatttgattacgtacatgcacaaaagtttgatatttatgtggacccacatgttcaattcggtaggctagaacatagaaaaaggaggagagggggtatgtgaagtcataattatcacatgtatacatggttctatttaatttccttaaacaaaagttgctacacaacacacttttttggcatcacatgagagcatgaaagaaaatcttagaactatttctatgaatctatttcactcttgactcttattgttgccatcttgtgattgatcttaattggcgttgtacagtgaaaatgggcagttttgtgcaatcaaggaggtgcaggtttttttggacgattcacattcaaaggaacgccttaggcaattgaatcaggtcatttgattgccctatacaattgataggctgtgtgtcattttgaacaatttatttttattgtaacacaaacacttttccaacctgtctctgactacatcctgttttggtttattaacttgtccatcttgtaatgacaggaaatagatatgcttaagcagctctcgcaccaaaatatcgtgcaatattatggaagtgaactggtaggttcaatatgattattgactaattgttcaataagcatgtcatgcagccacataattttattctttctcatcttagcatatttgtattgtgcgttgctcattacaagatggatctgtgagggaaaattataacattttttttggtgggaactaatctgatgatgcatagactcactctctggtgcacagagcataaatttatgcatcaattttggttctaatgcttaatcgtgcatgctttgtccttttcctcttttctaaaatcagagggtatacgccctggttccagtttccaccaagaaaggagacaccatcagttttactaattttgtgtgattgttcacttattttctgaaagttctcattaagctttggcttgcctaatttaaacaattttgagcaggctgatgaagctctgtccatctatctggaatatgtttctggaggttcaattcataaattacttagagagtacggtccatttaaggaacctgtgattcgtaattatactcggcagattctttcagggcttgcctacttgcatggtaggaatactgtacacaggtaatgtaaattatcctacactgttagtgattttcatggtaggcactgaatacaatgatcactttgtaaattttatttttgtggacagagacattaaaggagcaaacatacttgtgggccctaatggtgaagtcaaacttgcggactttggcatggctaaacatgtatgcagttatattttcgttcttcccggggttttgcttgtttggttgtgtagaagcatcattaaaacctcactgagaccacagaaagcatttagtagtcatctaactgaatactctctccatactcgtaaaggaagtcgtttaggacaatgtttaagtcaaaccttggaaatataaatcatgaataactctcaagttgttgagtttgaaaatataaaaattatatgtatagatttgtcttgaaaaatactttcataaaagtatacatatatcacttttcaataaatatttttatagaaacaagaagtcaaaattgtattttggagaccgtgtcgctgtcctaaacgacttcctttacaagtacggagggagtattaagttcctcctctgacagaatgctagatgcaactcagtaaaatgtctttaacattgagcataaacactggcttcctctaagtttgagacttgggagtgataaagatctgtactatgtctataaacttccctttatgttgtgggctggtgatgtcatttctacatgatttaaaaaagatgtctctgatggctatggaagggcttcttcaattcaacaacaaaatgaattccttttgagctttggttgtctcttttatctcatttcaatgcttatgttgaaacaggtgaca

SEQ ID NO: 3458 - DNA, 2098 bp, Oryza sativa
ttgtatcatcgcatcagatgatggggggcagtagggctgattcatgtgttgcacataattctttttaggaagcttgctttacatatctgttgttgataaattaattacgtgaaaccaggtttaaagactggattacacgacgtaattcccatgtccggacatccttgtcatgtcttcaattttttccccttttgcagccaaacagagaatcctcgtcaaggagaaacattgctcctctgcatggtatcgcaggactaagcgcaagggaattcgctggattttccacagcctatccttctcctcacaatacctccaggtataccattctacctcctgcccatcctttgtttccaagttcatcttgtaacctacttctcaacatggccgtgcacgtgcagcagcccaactgcagtgagagcaaacatgtctttaccggtgtcgccatgctcaagcccgctgcggcagttcaagcaatcaaactggagctgcctcccttcaccaacgcatccggcgctctcccctggattatcagcagcagcctacccaaacaatcccttgcagaaccagtcgaggcgaagcgccgcagttccagatccctggctggagttgagccagccgagacctccaagcccatatggctctccaaagagattctaggccttctgacctgcagagtttcttgtagcatggctcctcaaaagagattctaggccgtctgatctgatctgcagagttgttgtagatgatatgtgttgatatctgacacaagatagagagggagtcgcatatgttttttgttgacagatcatttgtaactatatatggcttactctgatctgattcatcattcattgtataccataggaaaaaggagggcattaggatgatctctgatgttctgtaaatctgtaggactagaaatgtggagtggaggcttggaccagttgcagaacttgtaaatttttagaaaatggaataaaatatcccggccgctacacacccgaaggaagtttttctaaattgttataagcatattatatggatacttgcgatgttggctgatcgaaaagctaggtttaccctgaatttctaagggagatagagaggtaggagaatgccactgaacagcaagcggaagcagcgggccagtctgtttcgttagagtttcgaatggagagagatcgacaggaggttttcaaatttaaacagcatataagttaaacaaaaagatgtaaagggggccatagtttgaaagatgtattttattttcttaaaagatgagggatgaggctttcaaaccaattttaaacggcgcacaagtttaaaaaacaaaaatgtaccaaaaacattgcggtgagcgtggatcgaacacgcgaccttcagatcttcagtctgacgctctcccaactgagctatccccgctatgcgtgacaagggtctctgttccacctatagtgacgcataacttcataagttagctttggtttatgccaattgaactcagaatctttggattgaaaccacacgtccattgccattgcactatcaaatacatctcgatccatatattagtatccaactaccgaactacgcaagcatgaaggcaattcaacaagttcaaggccacaagggacgtacaccgccggtacacgcatacaggctatccatgtactacactagtacacacatacaacaaagttatccatccatgtacacaccgggtacacactacacgcatatggccagatgcgtgcagaactgcagatgcattagttagggccaaggggaaaaaaaacttatggctcgttaactcgtttagctcagctcagctcgacttttaactcgttaagataatgagtcaagtcaactggctcgacatcaattggtcgacgtcacaagttggtgtctcgatgtgagcaataattaattcattcggtttcctaagttgtacttaaatacaacattagttttggtattataagtgcacagaaagtattagtattgtgcgcgtttattggcttgtaagaggtaccacgctatgctttattgagttactttcttgatttattttgtattatttggtatgttcatattaaat

SEQ ID NO: 3459 - DNA, 1552 bp, Oryza sativa
ctttatagcggtctaggctactgatgccctcatataggttttggcaactatggcgaattttcttgaccgcaatactttacatagaactattacgcagccctcctgttacacgaagcagtacaaaagagtcccgtaattctatcgaaagtggagacacaaagtttacgggtgagactctctttactaatcaatgctctaatcaactgtacaatgagtaggcccctccactctttatacagtgcaatccaatatatgcaaggttcggtgatgggcccaataaatacatttgggctaggtcttcatgggccaaacccaaaatttcttaacaagaacaatgctatcatggaaaaaataagtgcgggtatgcgtcacttaggttgagcctattttgacctagtgaaaattagctgaatttaaacatcttccaaatgaagaaccctagctttaatgactacatggatcatggatggaaaattaacgtggaatagaatcgaatcgaatccctgtggccatgtgaatatgtgatgcaaatgatggagccctgcaggacatggaggggacatgcatcatcccaggcagtgtaaagccatctcccatcacatgtgcacaacctttatagcttagcccttttggtccctgccttgcctctctcccaacaaactttgcccagtgctgcagcattgtgtgttgtgtgtgttgtgcttgaggggtttttatgtctgcatatttccaggggttggctggtccagggggttgctgcagtgtacactagttaatcaacatcaaggaagattcccacttagctctccagcagaaattaaaaaaaaaaactaaggtgaagtatattcaattgcattcattgggcatgttgcacttcatttttactaaagtaactaaaacatgcaacattgttaggatacgatacctttttttcctgccatggttaaattaaggatatgatacaactgatgaaataggaagctaatgtgattcatggtggctagctttgctgaacttgggtcggttttatttttaatatgaaaaacacaagaagcaaaaggatgttgtaaaatattggtacttattttttctaaaatatttaaaataataattaagtttttttttggatttgcccccaagacttttttttataacaggcattcataatacccggcttttaaacaaagccgaagataacggcacagaagtcttacacaacacaaagaaaaacaagtgacttaagggaacagactaacgctggagcataggtatcactggagaggcccaacaatcagaaaaaacacacccccggacaccctaaaacaaggcacctaacatgctaaaccaaaacccaaccccttagcctgttccaagacttccagatattaattctttttttaaaaaaaatcagagtttgtttttttttttaaaaaaagatgatctggttcatttacaagtttgtgggaaaaaaatacaaaaaatgtcatggcttactaacgactaggctttttacctgctcctacataaacaatgtggctaccacaagtccaca

SEQ ID NO: 3460 - DNA, 12871 bp, Oryza sativa
tggattgacattaaagtaacgagataagttactggaaattttgaaaattctcagctaaattctagccactcccattttatcttatatggagtagctaactacaaatttgcacaaaacccctgtttcaaaagtttctctaaaaagaacacacctatattccgaaattttcaaattcctttttccccatccctcaaagctaatccttttatgtataaccctatcatggtcactattcactaacatgtcccggctatatagttctatgtgtttagtacgttcctctcattttacttataagtggagatgttgaatatataggttgtgggtctggtattaggggagaaagtaggtagtccgcaaaccccctttagggtgtgtttagttcacgctaaaattaaaagtttggttgaaattgaaataatttgatggaaaagttagaaatttatgtgtgtaggaaagttttgatgtgatagaaaagttaaaaatttgaagaaaaagtttggaattaaacgaggccttaggtcgcttaccctataaccctataagtgggctacgggctaggcacttacgcttaactgtggttccagtttcatacagtcacagactcatagtacatctctttcacaaacattaattaataacctgtttaaccaaaaggtaagggtataataatctactcacttcgtactattctaagtgtagttctggtttctatgtctaacgtttcaccgtctgtcttattttaaaaacataaaaaattaagtcatgtataaagtacttcctccgtcccaaaatataggtatttttaaggttggtacggacattaagaaagtaggtgagaatgattggagaaggtgtgtgattggttgaaaaaaaaagtaggtgaaggataatggttctgattggttgagaggaggaggtaggtagaaaaatagcttcattttgagacacggtactgtgctacaaatagctacattttaggacggaggtagcactactcatgttttgtcatctaacaacaataaaataataatcataaaaagcatttcaaataagaagtacggtaaaatgttgaacgcttaaatacacaaccgtacttgaaatgggatggagggagcagacgagtagtaaccatttaaaaatgcttgatttgattccccggggtccactgcccatttgcccccaaggaggaggaaatatagaaaaacaaaaggagaaataagtttcttttttcaaaaaaaagagaaagaaaaccgggcgacctgtgctgttctgccacctcgcgccgcgcggcgcatttgcgccatttgtttagctcgccatgtccgccaccaccttccctcaccagcatcgcctcgccgcccagctgctgccgctgcgcttgcgcgtcctcactggaaagatggcccccctctgctctggcccctctccactgcggtatgaatgaatgatgcgccttttctccctccccccgcccagatcgatcgccagacctgcactttccagttccccatccatgctctgtctgcttcatcctgtcccagcttcttcttcttcttcttcttgttgttgttgttgttcttggtgcgggagggtgttcttggggtagggagcagcatcggcggcggcggcggtcatggcgaaggagaccgagttctacgacgtgctcggcgtctgccccgccgcctccgacgacgagatccgcaaggcctactacatcaaggtcttgcttcttgcttgttatgccaactctgctcggagagtcggtgctgatttgtttttttttttcggtttttggtttcttgatgtccaggcgaggcaggtgcatcctgacaagaaccccaatgatccgcaagccgccgagaaattccaggttgtttcctgctactcagctcaagttggtttcttgcttggatggtttttttttaattaaattcagtttgctttgtctgaccagctgagctttcttgggtggattttttgcaggctctcggagaggcctaccaggtgctgagtgatcctcttcagaggaaggcctacgatggctatggcaagaccagcatttccaagtagccaaacaaacccatctgagatgattgattgactctctgcagtctgtggcaattcaagtttcaggttaacaaatgttttgttttgttttgttttgtttgttttttcagggagaacatgctggatggcactgtggtgttcacccttcttttcgggagtgagctgtttgaggactacattggccaccttgcaatggcaacaatggcttcctccgagatggccagcgacaatgacaaccctgaaaagcttcaggacaggctcaaggtcagtgagctcaatagccattgcagccatctgtgattatggatgctccaaagccagtttgatttttctctcctttctgatggaatgttggcactagactagttgatactaaccattctgttctatgtttattgtgacaaagggtgtgcaaagggaaagagaagagaagctagcaagattcctcaaggagttcctctcgcaatacgttcgtggtgaccaggaaggattcgcaagccgtgccgaatccgaggccaagaggctgtccagcacttgtcagtctgatcgatccccgcaattcatttcgatctctatgccaatctaagaaaagcttcttttaactgttctgaaatgccattgctcagcatctggactagacattcttcgcacaattggatatgtgtactcccggcaagctgcaaaggagcttggcaagaaggccatgtaccttggagtcccattcctggcagagtgggtgaggaacaagggtcacctatggaggtcacagatcaccgcggcgaaaggtgaaaatctcgcaaaccggggcttttggtgtgtattcattaaaattgctgactgattagaggacaaaaagaacaatgcaggagccttgcagttgctgcagctgcaagaggaggcctgccggcagagcggtaaggacggcttggccaccgagagggatgtcgatctgcagatgaggatgaacaaagacctgatgatgagctcactgtggaagctgaatattgttgatattgaagtgacccttctacacgtttgtgaaatggtatgcctcaagatatcatagaaatttgcagtgatatgattaatagttagttggtagtatctgaactgcgatcgccaagtagcacgacatgcctgtcttatcttccaggttaacatgtcaaaatgattagtacattaaattgaattgattctcttgtacttgttaggtgttgcatgaaaacaatgtcaagaaagaggatctcaaggctcgtgcaatggcactgaaaattcttgggaagatattccaggtatatgttacttggccttttcattaggataattcataccgctacatgagatttattttatcataatttgcaaataccatattaattcaattggactacaaacagagggacaaggaggcattgccaggaccatcaaaaccgaccattctcgatgatgacagcagctctgatgaaagttcagatgacgacgtggctcggacagtgccttatcggactcctgcagttactcaggcaattactaaactaagcagcttttatgttgcatagcaaagcattgcataatcaagtgcctgctaatattagttcccatgttttgtggttcagggaattggcaggttattcagatgcttatgcaacccagcatatgatgttgacgatgactttgaaccacgcaaatgagtggtaaagtagcagagaggttgcaactatttaagagatccctgaatctttccagattatgtgcttctgaacagttggggatcatgcatcaccataatttgtctgggtgtgcattgtagattctactgcagcactggtgatcaggccattagctcaaaatcgttctttttctgtccatgaacagtagattctttcttggtttttgatatagattttatcgaattgtgtggtgtttatgtaattgtttggtttgggagttgtcaaaagaaagaaagcaagaacaagtgtaactggaagtccatttctctctgattttaaaatcacatgtaaaactctgacatgaaaaatcaacttttgatcctatcgtctgcctactgtcaccatcctctgctctaaagatcttctatctcatattgacatccctgattgctgacctgccagatgaatgctgtcaaactccaaaaagagtgatctactgaaatttctttgagcttctgctagaaagatgctgtacaaaagatgaacagatagctcaaaaagctcattcatgcaactcaagagcagtctgcattctgcaatctgcattgcacagaacagaaccaacaccatggatccagcatttttttctcatttcctacactggtaggtagagctccttatggtttatggactatacaacaacagcaatttctttttctgccatatgccacacgcagtttctcaccctcaccccctaaactctaaaatttcaactgaaatctccttctccttatggcgatttgcgcaacccgaaaaagggaccataattcttcagagattcaggtgaattatatcatgctctgagcttggcgaagaggttgccgaaggagaagaagctggtcctggacagggcgccggaggcaggctgccccggcgacttgccgttggcggcggcggcggcggcggcggaggaggaggagggggaggagggcaccttcttgacgttgagcatgacggtgtggccgacctggacgcggaggccctcgatggtcttcatgtccaccggctcgccggaggcgtcgcggacgtagaagacgttgatggcctggccgccgaccgtcgtgacgtcagccctcgtcaccgtcaggccgtgctccctgagcacccgcgtcacgtcggacagcagcccgaccctgtccctgccgcacagctccagggtgaatccctgcatcatcaaccaccagtgttagcacatattcaagctccagttcgagctgaaagagatcctctgacttaacgccatatcaaagtggaactcacatgtcagtgactcaattgtatgtgtatgcatgtgtagttaagtcagaggatttgcttctcggtgttcgagctattgtactggtcggtgcatgtaactcaatctgacttttatcttttttctttttcagaaatagaatcagaattcagtcaaaggtatatatgaaaatggagaaaagacaggtagaagggcagtatgttactactggttaatagaactaaatgatgaactgaaacagtgtactgaaaaaaatgaacagattaatgtggtaccaggtgctgtagcaaaaccgacatactagtaacagagttcagtgtgagtgtatcgatcaatcaatgtgactttactactaggagaactatacaccataatctgcaacatgtcctgattaatcccttgttccagatgcagccaagctcagaaattcttttgcaaaatactactaacagttactacttctactgatgcagtgatgctagttgcttgtacagacagtggcaaagaaggttcagacctcagatactcttctggagatggccgcttcaaggcacttgatcaccctccctgcttcgtccttctgtagcgtgcgcccatccttccgacgaatgtacagctcctgacaatattaaaataaaaaaaaggaagttcattgcaatgtcaaaagtcaacgttgaccgagtcgcggcgcagagctcctttgaaatgcaggaatattctttctacaaatcgaattatttcatgtgaaattcttagcattgtcgtggtaggagcttcgatatggtagtagcagctgttgacatgctagagtccagagtacacacctggatgccgtagatgccgtcggaggagacggaggcgtgggagacgacgtagtgcatgtcggtgagcgtgcacacgatgtcgaacagcagcttggacctgtccctgcacttgacgttcaccaccgagtagtccttctcctcgcagtgctccaccgtcaccaccggcctctcctccgccgccgccgcgttcccggcctcgcccgacacgatggcgcggctgtcgaggccgtcgtcgtcgtcggcgtccacgtcggcgtgcatcaactggtggagccgccggtcgacgtgggtgttcgacccggcgccgccggaggagaagaagttggcgtgcgccgggccgtcgtcgccgtcgccgtcgtcgccgccggcgtggccgcggaggacgaggcggaggcggtgctcgatccgggacaggcggcacgggtcgccgacggcctgccccgacgcgacgtcgttcacgtacacgacgcaggcgacgcgggcgcggtgcgtccacacctcggcggcgagcacgttgcagccgagctcggcgagcacggcgaagacctcggagaggaggcccgtccggtcgggccccttgagctcgatggcggtgtggtcgccgatggagtgcatccccaccgacctcaccggcgacgacccgcccttcgcgccacccagcaggttgctgtctgggcctaacgcctgcaattttaaccaaattgatactgccacttcagttttcagtttttcacttcaactttaatttacacttcagtgtaaatctatagtcacaaaaaaattcttgatttcatggaaagttttcaaaggaattgttggctccatatctccactatccattccaaacacctcatgaaaaatagtactgcggtctaaatttgtaattcattaaaggaaaacctttaaaatgtttttcaaaaactgaaacacatactgacatgatgaacagatacgaaaatacttcacctaaactaccaatactttcaaaccaaacactatcaggatgcagttgcaccaaaaataattctgaaagcttgatatagaggataaaataggttttcaactttcaggtggtaaattttaagaccaattttcaggtggaaaaaaaattacaaaccttctcaatgtgcttaatggtcttctcatcagtcaccttctgcccttgcttgtccaccacatgaaacactgcatcaggttgtaacagacatcatgaataaaccggcaattgatgtccgcgaaccatacatgagtttgcatatatatgatataattgcatagcataggctgccttaccatccatgaaccatccaccatcagaggtgatgtacgccttcgagatggcgagatcgagatcgctcagaacttgcaccacctccaacaggatgccattcttgttcatgctgtcgacctacctccaaacgcaaacagacggtgctcgaagcaatcagtgaaacggttcttgaatattggaagcagtgttcagtaagattatccagtcaagttttgagagagagtagtaagtagttcttaccttcactaaggtgcagtcgctgcaggtgctgttgtcaatgcataccctgcagaaaattatcagcttgttagctacagaaagtagcggagcttccgacaatagcctgaaatgaaacaggataatgatatgaggagctctggaatttagatgtttaaattagagatccacctaggagggttgatgcgctgactgaagttctcatactccggatcaaagtaaggcagcatatcttccaaggttacgaatcttccctctgaaagaattacgagttgaaaaccagcactgtcatgatgcgaggtatgcagatatatataagcaaacagaagtacacagtttcgtcttgtgaaccatctgtgatagtttccaatcatgagggtagaaacttcgatcttaaaatcatcaccggaccaatgatgggctcctcataaagaagatctaaattactttagagagtagattagaccaacctttcagtagattcttctttcagcagggcctgaaagttcactggaaaattttcgatggcttcaatcaaaagctaacccccaacacttcacgctttagtatcctgaaaaagtcatgagcagtttcgagtcaatttctgtacaacgatacctgaaacctgaacgcacctgctcaccctgaaaactgcctgtcaaaaattcagacactgacatggaacacataaaaactcaagaatcgcaggcagaactggatcgaaatctggatcagaagttcagagcacatcgcttataaccataaaaaaaggcaaccaacttgaaccactgtgatcagaaaactaacaattgccaagaaaccatgggctactgcaaacacaacatatacacatctccctgaaagcaatccacccccattgatcaatcaatcaatcacctcacctcacagaagcaagatactcttttgcctggatgaacaaatcagagaggggcgcacagatctgcatactttattgagtgctcgtgatgcatgaatcaacagccacccacaaccgatggccaagaattgcttgctgctgctggctggggatccaatccaatcatcccaactagagctagaataatcgcccggcctgaggaatcaagaaccacgtcacggtgactggatgtggggataaaagaaaagaaatgcacacccgctttgcgccgcagatgacaaaatcgatctgcttttttttgttttgttttttcagtcccacccgccggattctcgagcgagtgcgcgtgcgtgccagcattgggaggaatttttttcccaccgcctcggttgatgatggtggcggcttcggttggcgttggcgttggccctgcttgcggcgatcgccatgactgaatcttgagaagaccttttctattatctgaacttattagggttcgttgtggtttgttacttatacctgttattactgtgttttttttatttcagaggttcttgttgtgatgttgattaggccgaattttttattcataataattaataatgcagaaattaaatatataataaagcaaagtcaatttttacgaaaataggaaggacactattgcataggacgtccaggtgtggatgctgttgtagacaacgtccagatggggacgcttcttacaagggcgtccataatgctgcagttgaagaccccacagagccgtccaattcaccggactaagattggactttggatccaatcacacaatggtcgaactctgcctcgttactcctatgcagactattgtctcttgttgattgcttgcttgccgagtaggcaccgctctctacctgatctgccagacagggtcgccatcccccggctctccttcaatgcttccgctgttccgcatgacggacactctactcggggtcatatgtgaacagccaccacttttattttgagatatttgattagtttggtttttgttctggtccattgtttactacgcatcgagctctctgctgactgaatcttgagaagcggccgccagatgaactgcatgcgaggttttcgatcgatgctttttttccttttgcaacaagccagagattggaagtcatcgggcgacagatgatctgatagaaggaggatgtttgcgtcctacccttcgtaattttgcattctttgtaaactttctattgcagaacatatacacctgaataccaaaatctatgaactgagcatacttgctcggccagccacctggagtgaggcgatgcctggacttgctgttaggaaccaagaggggcggacagacgacgcaacacaagccggcacgagtgggttattgttccagcatgactcaaccagaacgtggatagcggctgcgacctcccggtgtgaaggcaaaaagcggcggcgtcctctccggattcgagagccttcgaggtgagttgaggtgaactgcaatggcagattcctgacattgtggagacggaagccggaaggcggctgttgcagtctcccagagtcgaggtgaacggcgggcatggcagcaccttgcccgagccctgcaccaacattgggcctgaggagaggagagtcgacgatggcgcctctccgcatggcggcatgggcgccccaaaccgagcctggacgtgcttcggtacagcgtccacctctggacacttcttggaacagcgtccaaatctggacgccctttgaaacaacgtccatcctatttttacaaattcaatttaagatttaccacttatttaattcaagacttattaattaatataaataaaaaattcggttgattaggtcttatttttccagcgttgcatgccgcggttagggcccacctgtcagttagtagcacgtgtttgaatacgaaaatggcaactttaagttaaatgttattatttaaatcatttattctcaatatctctaattttattgggtgcatgtattgtatttattatgatgatatgaacaagaaaaatgataataattggtttttggtctttggactaaggatagttatgtcttgtattttaaaatagatggagcattgcccagttttgaacaatatggagtttaaagagcaaataatcgtgaaaagttaaatgcaaaatgatcagatttactcgctctgtctcagaatataacaatctagaatcggatgggatacatctattataaaacatccatttcagttgtagattactatatccacatgatgaagggaatagttttttttaacaaaacaagtaatcttgttcaagatttttaagtgcgagaaaggtcatcggttcactattgtatatagtttgtagttaggtgaacgattttgtatgaagatactaatgtgaaatgttcctttttttttgttgtttttctgaaacaaacagagagtataaagttacttacaaataggcaagcaagtacttgaaacaattggggattaatcactaatcacagagatgtcctaagacctaaacctaacctactactctgtaaaaaaaatcaaatatgtccaaatttaaatatagggtttgattttttttttgaacggagggtagattaatcagcagggtgatagaccaaatcatctttgccttggtaatccacatggtctcaagtcaactggtaagaggaattcacatttctgaatttctgattggcacataattgccttttatccaggtaggagtagttaattgcggagtagtcaactaccactggtggtcagccagccacgtggcccggtggggcacctgtcaccgacaggcgggcccaatccgctgcgcgagaggaggccaggcagccagccacgcgcgctttacgctttcccaaaaagggaatccgctttccgcaggtgcggcgggcggcggcgcctccccgattggaatctcgatgccacgtggagcactcccttccgtccgatctccatccgacggtccagataggccacgcgccccccttcctcctatcagcagcgtgtggcacggtaactacagtactatactactgctactgctacatcaatcaaaggcttcccaaaacaagcaaacaaaaatgaacaaaaaaaaaactctatgcaattaattaactaattaattgtacgtggtgctaccagagagatacgactacagtgtacatgcgccgtcacaagccaaccatccaatctccaatcataacatccatgattttctttcccctttaattaattaattaattaattaattctctcctccctctgatcgcgaccagaagaaacaataaagacacagagattttgcaacaaagtggacgagtggggcccaccggtcggcgactgcagccgacggctgatggaggcagtagtagtaacagcagcagcaacagtagggcagatggggggcttcgaaagagagatttttgctttcccaatcaacatgatgcaaaccagccaagaaccaagacaaaactctctctgtttttatttttttttgttttgtttttttgaaaaatacttagaacagaaaaaaaagaagaagaaggaaagaaacagagacacgaacagcaagtcggttgtgtcggcccacctgattgacgaagactgcaatcattcgacgctaataaacataaaaatgaaaatgaaaaacaacacgattctaatctaccgtcaaacaaggcaaaccaaagaatccaggagagaaataatttaagagagaaaaagagagagagattggtaaagcgttaattaccactgttcttggattccctcttaattctctcctcctttttccttctacttgctgctgctgttcttggcttcttgagattttgagatttttgattcgcgcgtcgtcttacatctcacgcagccggagcacggctagctgagaggaagaagaagaagaagaagaagaagaagaacagaagaagaagaagaagaagaagaagagctctctgttagtgtaaggaaggggagagaagaggagagaccatgggaggaagaagaatcaaatcaagaaaaagggacggcaaaaggaagggagatatggatgaatggatggatggatggaggggggagagggcaaatgggcctagtaggggagagatgacagggaaagagggactcacactgcctctccacatatgcccccactttggatgataccccgataccttccctttcctcttcccctcctccgtcgaggattatatagtcccgcgcggaccggggaagtccaggatagcgctcgccgtggcgactgtgtgtgtgtgtgggggggggggggagtcagaccgagtggcgagacacatgtgagaggtaaatgcggatagtgtatgacaagcgatgccaagtagccatgtagtcgatggtgtggcgtttgttagaaggtacaactaagcatgcggtggttgttgcgctagctggtgtttcggatttgtaaagtgtgcattattcacatgttttttattgtgcatgttaattaagatcatggttgcttggatggtaaacggtaa

SEQ ID NO: 3461 - DNA, 4327 bp, Oryza sativa
aaaaaaaaatgaacaacataactaaaaataattaataggtgtgttcttatcgatttgaaagctaatactagaaaatgaactacaataaaaaaacctcaaccctaaaattaagtttcacaattcaaattttggtttcagctgaacaagcaaaagatggagctaaagaatactaaaaaggaacatcagcaaaaagatatataccatcataattttcagatatgattttatagaaatctagttaaatttttagaatcttctaggactcatgtagccgatggtccatgaaaaataaactttgtagcgtgtacgatgggcagacaatgggggatgacacggtgccacgccaggtaccggggctatggaatgtggattgccttgtctcagaacaccacttaaacctcctcctctctttctttgctcctcccatcgccatctccatcacctcatcaaaaggtccctccccttgccatgatttggtcatttgcctgccctcattgaggagctatggcctgagcttgccattttccaaaaatggtgcttaggtgcactgttcctgctaggcccaaccccaagtgcaaccacccacagcaatcagctcagcttgcagcctcaatggatgcaccaacattttcatgtgcatcaacagcgacagatcaagcaaagagccatagatgaaataattgtgtaagagaaagaaaaattcagttagtttccacatacaaaagcagaccaaagtgtgcgttaggacatgaaaccttttttcagacaaagaaaggacatgaaaattcagcaggttaaccgattctttcaatctttcctgctgaatatctatctatagtcgatattaattcactggcatatgcatttggctgcattttttgtgtgtgtccttgcttggctgcttaatttgcatcaagaaattaactcatgaaaattaaatggccctagccaccaaagatatgtgtaggatgctgactgtcgggaggccattgatggtggctgttccctcttcatgcttcaaggcccagacagcaacatggagccatggacagagtctgcagacattcttgcatgatctctcttgtgatgaaggaatggccacgttgaggtgcttccaaacaaacacaatttcaaggttcagaatttcagacggaaatttttcagttctttggcttgttctgcatgccattgcctttgggctttgtcactacggctgaagtgcagagtgactgactgagtgagtgacaagtaggatagatggagaatttaccagttaccgcaaagagaatgtaggggctggctgtttaatttgtttttgtcaagtgcgattttacgatccttgacgaggtactatattttccagtgtaaaatttgatatctcttggtatcttcggtacgaggagatatcaaatttgaactaaaaatttggtactacctccgtttcaggttataagactttctagcattgctcatattcatatagatgttaatgaatttagacacacatatatgtataaattcattaacatacatacatatatatatatatatatatatatatatatatatatatatatatatgaatgtggacaatgctagaaattattataatgtgaaacggaggaagtacctcttattattttttaaggaccgtaaaatttctcttttgtcaattattgataaaaaggaagctttttattcttatttttatttatttacttatttatttatttatttacttttttagtaggattaggcccagcttaactggagtgagagaaacgtaaccgggcctaaaatgcctgtccggctagagttaaatctaccctggcccagctctatctactaaacagtttggttcaacgtttgctttctaaagggaagttaattctggtgtccagataaattttaataaagtaaattgaattgacggtatccgacttgtgtcaagtgcatataatgtagtacatataaactggaaccacctatacatttgtcgataaattttctcctaaaaatttgacagatataattatagtacaatcgtagtgtaattacactgtaacttacatgtaactacagtgtaactttacacttgtatgtaagtttcatgaaattttgaatcgttagatctattacaagatttgttatggtgaggaagaaaaaaatcacagcacacacatatgtgaaatgatttgttcccacgaccttcattttaccgaaataacatgttatagataaatttttgaaagttacgtacaagttacattatagttacagtgtaattacatgcaagttacagtgtaattatactacgattatactataattacatctgtcaaattttttggagaaaatttgtcgacaaatatatagcaaaattgtataaactaataagcgctcgttttggtgcaccaacttgtacggcgagtgcccaaggataaaaaggtactatatgaccaatcttgttgattaggatgtaacataagcatgtatataaaagaaggatagaacaaagaaggataaagataaatttagaaacaaagtacatcgttgtttgcaaagatagcatgtctcatgtcctcctcacatggacacatcatgtttaatcaatatctgacctagtaaggttagctacaccgtgccttttatagccttgttttgtactccctccgttccataatataaccgattttggtggaatgagacatatcctagtactatgaatctggataactctctgtctagatttgtagtactaggatgtgtcccatcccaccaaaatcccttatattataggacggagggaatacacaccaagcaagttcgtccatcaaaacgagtcatttacaagtttatacactagattgcatccatatgataagttcgtgtacagtcaatgcaatttactttacttttaaatgaataatgtcacgacttaataacaaggttttacggatttgttgttgatctgtctttgaatgagtctgggtgtcaaggagaccacattcatgcataggtagcgttgtagtagtggtgctccgtgccttcgtccgtgttccccacgctttgttgcaagaattactaataaatttttaatatgttttttaccaacaatcgagctaaaagtaaaaaagaaaaataataatgaaatattagggtttattggtactaaacttaaaatagtcaaatgataccaatgctttagtgcagaatatattgataagtatacgttaagtattataaaaataatatatatagatatgtaaaaatattgtggaaatgatatggtggatgatgattggatatgtttgcatgctgatttgtagaattcaatagattatagattgcatgcttgcatgaggtttgatatgtaattatcattagcgaatgatgatgtgatatggttgaatgttgagctttaaatttagtgagttgtaactttatagaagatatagattataggttattgtccagaaacctaaattgcaggactttgtcacttcggcttgcctacatttggaacaagtgatcaaggagttttttaccccgacatatgggtggcgacctagtcttcgggttgtagggccttgatcttgcacgctgtttttttctcttattttgtttgtgttggagtttgctggctgtgtgcactgtcatggtgcaaaggccagaagtatcctcagaatgaccgagatcaataaagcttgtattatataaaaattagaccagaaaaagaaattttgttaaatccgtaggctcttgaaacatgtaaaaatagccacgttctataaaataatgtgttttactttgagggtctgccgctcacacaaagggcgcgagtgtgccattagaaaagctggcgcacacgtgcggcctgcgggtctcacgtgatttctttagtgaacatgattttattttcatgatttttttattttttttcacatgattttttttcgtgaatttttttaatcacatgcaaatgttgagtaaaaaagtttttaaaattttagctcaaagtttaaattttgagtttgaatgtttttaaaatttaagttgaatgttttaaactttaagatgaaagttttcaaatttgaattgaaagtttcaaatatttagttgaaagttttcgaatccgagttgaaagtttcaaatcttgatttgaaaattttcaaatctgggctgaaagttttcaaattaagtttaaaagtttcaaatctggacttgaaagttttcaaatatgagttaaaaagtttttaaatctgagttaaaagttttgaaatcttgacctgaaaattttcaaaatctacgttaagggctgcaggaa

SEQ ID NO: 3462 - DNA, 3807 bp, Oryza sativa
attcctgcagcccactatagaatactcaagcttcttcttgcgggttaatcttggggggcgccgcgacgccatgtgtgtgtttgtaggcttgctggtgaaggggatctacgagctgtgggggcaaggcaccacctacgaggagctggagagggtggtcatggcgtaccccgaggagaggaagctgccgtacctgacgccggagagcaccttcaagatcgtcgtcgacagcttcggcaaggtcatcagcttccaggagcagaacgacatcatgaagagcctcacctacatccccttcaaggtaaattcatttttgagccataataagttcaattttagcctccccagtttgtcccaaaataagttcatttttgagtaaccactgcatcggagtttatgaaaatagaagataaatatgttaggagtagataaagtgaggaataattgcgttgggatttgataaagtaggtattatagtcttttttatgttgtattggtattggattggtgaaaaatgaacttattttgggacgaagggagttcatggagtagttcggatcacgaatttgtggatgtcagatgcatttattttctcttgtgtgtaattggtgctgttcctcatttccagggccgtgttaatttgaagaagcccgatcataagttctttgtcatggagactgatgactatggctgcaacaatggcctcccgccggttgctcagaggacggtattctttggccgcgaggttggagcggcggataggcatctcctgccgacatatcagctgaagagcaggaagtatattggcccgaccgcaatggatgctgaaatggcatttcttatggcgaatcaagggctggcgcgccccgggaagctcgtatatgacccttttgttgggactgggagtattttggttgcagccgcgcattttggagccatgacaatggtttgtgcttattgcacggataacgaataattttcattctgcttgtgagtatgtcttactgataaaggcctttcagggtgcagatattgatataagggttgtgcgggacggtcgtggtccagattgcaatatttggagcaactttgagcaggtgattgattgaagttagctattattttttgcttagattcttccatcctgttgtgatctgcttgattctgtgtgagctgcaattctcttatgacagttagttcttaaacgctgttcttgcctagtttttgacttggtatcatatagcttatgcagattatgtgtactaactatagtgacatttcggcatttatcacttgttagtaaaacacccgaggttcgtgtgaagtactaattatattgtcttcttcagtacaaattgccggaaccattatgtatactaagagcggataacaacgtcccaccttggcgtccaggattgaaggaggtaatactctgttgtgcggtttatacattgttgtatttttttgaattttacagttttgacagtgtaagcttgtactatatgcgcgactaaaaactgaaacaaatgtgaggaacgcataaagtgattcctgtacattcatgcaatattttagttgtgcttgaaatcttggatttgttatttacattcttgcattgctttatttggttgacattgcttgagaaaatggttgatgctgaagtaattgaattctcacgtagctttttaactgatgaaatatttcctacaactgaatttccatatgaagctattgtagcctacaagcgcatgggccttaatttccatagcttttttttttaataaaactttccataaccattggcttgatatatcttctgcttgtatgctacaagatactctggaaagttactgatttactccgttgtttcaattttttcgacaagatatgataaacacactattgatgcttgcgatcaatcaggttttcgatgccatcatctgtgatccaccatacggagtccgggctggaggccgcaagtccggtggccggaagctcataaagggcaccgtcgctccgtacacggttccggacgagaagagggacagccacatcccatccaccgcgccgtacagcctcgcggagtgcgtccacgacctcctccacctcgccgcgaggatgctggtcatgggtggccggctggtcttcttcttccccgtcgtccgcgaggacggcgtcgccaacccggccaagtacccggagcacccctgcttcaggctgcttgcctcctgcgagcagatcctgagcatgaggtacagccgggtcctgctgaccatggtgaaggtcgggccctacaccgaggaggtcgagaaggcggcggaggagcggcgccgcgagttcagggagaaccaccataagtggatggaggaggggaacctccactccgccgtgttcagccccgccgatcaggccgccgccgccgccgacgggaagccggccatagacagggactccaagcctaagtacagaggcaagtatgtgtaggtgtaggcaggtgagagacgctgaactttttgtctgaaaatttttctgacgctgtaacgaacaattttgtcgatgtcatgtggtcgtgtatccttcagcttaagagagcccggaggctttggatcagccgatttttagagcataaattagtgcaggtgctgctgtactatgatgtaccatttctgagatgatacgaggctgctaattcatttggtcgatgatgaggatttgccctattgaattatctatctatttgtactagtagtgttttggtttatcagaactgagaatcgtgctaattgaactaaaattatatttttatatgatggtattgtagtagtcgttaaaaattatattttttatatgatggttggaaaaggatatataaactttacgataccactcacatcctaaggttgtttaagatagtggttttgcatatttgaaagcttaaatcagcaattttgaatggctaatatagcatgtttacatatcgtcgatcattgatcattaaattttaaattatactctagtgatgtcatattagtattataatattgtcaactgtttgtaaatgagagcaaaaatatgttgttaaaacgaaagatttaggtggagattttaacttatctaatgcatatgtcacctagcaaaacttattcaacatagataaaaaccactttgtaaaactatattaaggtgttatataaaaggtatgtttgggggttggatgtctgggcttcaaagttcagaggtgctagatgaactttcaatcaaagttttgggggtataccttttattgctatattataaaagaaattaacgatcaaagataacatgaagaccgtgtaaaagtctaatactctccatatcattctactccaggtaacacaaccatcagtttttaaaagcctggagtttagaaacatgtaaattatatgtaaattatatattataaaagtagtgctcatggtaaatctaaaaataaaatataaatcgtacgatgttaaattattgtaaaattataggaatcgatggtcaaagattaaaatgtttaacttggaacaaactagcaatttaaaacggactgagtatgttttatattttataatttagaagggatatcttagaactgatggatgctttaaaatgtagccacttaaaaaacttcagatgcaacatggacgagagcagatcattgactgcaatcaaacatggtgagcatgatacgatttatttactatatacatcttcaccactgattgacatggatcagttaaataaggttcccctactaactgtaaaaatctatgaaaacgaaacaag

SEQ ID NO: 3463 - DNA, 966 bp, Oryza sativa
cacagtagcatatatggatgataatcgcattcatcacctggatttatctttccttgatgagaagattcttccaacaaatgagacgccattcttcttctgctgctgcttcttcttgctgttcatggcgttcttggtgttcttcttcctcgcattcccctgcctcctctctccgaggtggcgatcgtcgtcgaccatcttgatggccagcgcctccgacaggctgggcaggtactccaggctcgccgccatccactcctcggcgcggctctcgtcccaccggtcgctgcggaccctgccgccgccgccgccgaggtcgacgtcgatgtcgacgacggcgagctccttgcccttgccgcgggcggcgccggccgagaggatggcgaggccggtgctgagctgcgcggcgacgctggacacggccgtctccatgtgcgactgcctctgccgcagccgctccagctcgcccttcgcctcggccagctccgcctccagcttcctcaggcagcccagcaccgccggcggcgacggcctcccgccgccgccgccggcggactcgctgctcgcccggctggtggagctgaggcacctttcgccgaacacctcgacggcctccctgaccgactggaacggccgggaggtgtccaccacggcacggctcgccgccgccgcgatctccatcgatcgacaagatcaagaggacaatgccgatgccggcgaggaggaggctgaggtgatgggaaggaaagaatgcgacgatgtgagaggacagcaatggcgaactgaagtaggcatatcttgtccttgtcctgtctgtctttgcttctacttcagagttcagagttatcagaaactaaagtcaccagccaaaccagcaaccacaaccagaccaccgtgcagtgcaggacaggaggggagagtggcatgacagtggaatacaggcattgtgtcaaggccaaggaaaactaa

SEQ ID NO: 3464 - DNA, 1126 bp, Oryza sativa
ttgattattgttaggaaatctccgtccttgatgattgtatggaaattttgttctcgccccatttctccaattcctatgtattctcccgtctctatttgcagccctgccacaatgtcccaaactgttgtgttcatgctgagacatctgagtggaaggacaaggactccctcttggatagggcggcaatggtggaaagggctggaaaggcacaccaggtgcgactttccagtttttgcgacatggccctccttcaacttctggggttccaaaatgctcaacaaaagcgattggaatcccgtatgaaatagtcaagttatgttgatacctctccaagtataatcctggagaaacccccgattctaaacaagcttgtccaggccgactttcctgctgagactcaaatccaggaggtgcttcatcatctgcaccatcggctgaacttcccaccacaggaacatcattgtgggagctgttcgttccccaattaccatgcaacttatttcccaccgagccagtccgaaactcactttgtacaggacaaactttctgaattttcaggccacccattttatagtggtcatctggttggtaatcccaacggctcttgcgttttcttctgatggatttccaatccatagtgttggctgaagttggaaaagatccaccagctgttgaaatgacatgaatatcgtgtgcagatatggatgcacgtgaatattctgttggctcatttcttgaaatatttcgaggggcccattggatccatctatcacgaaagttccgagcaatctgttgaacctgttaaaatcattatatgaatcaaacaggtcatatcctcacatcagagaatcactaagcctataaatgcaggtaataacaaacaatattcttattgcaaaacctatattaaagaccaacagatatcaagccagctaagagagaatataaattgtactccctccgtttcaggttataagactttttgactttggtcaaagtcaaactgctttaaatttaaccaagtttgtagaaaaaagtagtaacatttccaatccaagacaaatttattatgaaaatatattcaattattgatttgatgaaactaatttagtattataaatattac

SEQ ID NO: 3465 - DNA, 2328 bp, Oryza sativa
taagttccaacagtttccgggaaggctcaaagaatacagctgttcataagtaaacatgatgatgctaatgcataatccgtttacagcgaagtactcacactaatacatttgctaacttatttacaaacaaaaaaactatatgaattttcaaactatattggaaatttggattggttatccattaacgaaaataaagaaaacttgattttggttccattttttgctctaagcaaaaagacttgtcctatgtccatggataaactaagcatttacaatacagaaacaatcaatatcaaaccatgtatatgcatgacaagttcagaaacatgcactagtattaccaattatgttgtattgctttcttttaaagtgacatttccctcccaaaataattaatttgctgattgcatttgcaaacttgcaatctttctatactatgttcatggcctgaattgtatactatctaaacaaagagtcaatgcacaaacaaatacctaaaaaacaagataaaaatcatacacgttgggattagtatatttattacctgcatatcattatgccttaacaagcccaacatcgactccctgaagctgcaatgcgaatttcagagaataaaaggtaaggaaaaattgtagaattgatgcttcaaaatgaaaacttcaacagcaaaagaagctatatttagagcattaaaatactgtccatagcatgttatttgcacggctaaagcttagtaatacaattaatggtaaacctgcaactgcaattagatatacataaaacaagtgtcttgaattcaaaattgtcacctccaaatatactgttcactcagggcagcattaggaaatattctttaatatgggacttgtaatataataaattgcaatgctacaaacacatttcacaagtggttgcttgatggattacaaaaggccatacagaagatgtactagcaaaatttgaaaatttgaaagcttgaaatatcaaacatacaaaaataacaagcaagaattgcatttatttcctcggaagaccatgttttggcataaaaaatatgttgctacacaaagcaaatatacagaaaactataatgaaacctaagaatgaaaaataccaaatgaataaataacaagtttgaataatcaaacctttctgtcccagcacatcgaggaccaccatttatatgttcagatgtcagaatgcccttggaagctagaaactcaagtacctgaagaaagattactcataaggaaaaaatagggtcccataatgatataattctgtgatagaaatattattctcttttttgttatacagaaaataagaacagtggtgcaggcattgcactcattacaaattaaaagcatgtccatccctatctgttaagaaggtactagaggacgggtatgtagttagcacctgtgctatgggccatgggtttaggtgttacagcaaaaatgcttcgcccatgctaaacgtggtaagtggctcatgctaaatctctccctcgtacatttcacaaatgtttaatgataaaatctccaaaatattataacgttagcaccaaaaaataggtggcatataataattaatggtaccaaactctagggaaaaaaaacacccctacaattccaaatgcaatacgttttagcctactcaactctttcctaaatgtaagttgctttggaatttctatgcatttttacatcttttctttcttgtttgcccttgccaaataaatgccaccatctcacaaaatacattatcatcttttccagtgcagcataaatgaaggacaatagtcattttgagtttttttttcttgatttttgtgcacaagtcataaaagaatcagagggagtagataacaaggatcttgtgggggttgatatgtccactgtagcacctagatcagttgttaagggatgtacttgctctaatgtgatatattaattggaaactaatgtaataagacataacataaaaaagaaatgcaaaccttcacaagctttcttattataggtatcctatggaaatcgcttttattctgctttaatatattgtgaagcatttgcagtcctgtcagaaaatagtacaaatagtttattagtcagtaattctagatgattgtatttcacgtaaaaagctgcagaatgcaagaaaatgtaccattcttattgatgatatccaacaggacagaattggatcttgttttcagaagtgcatcaagaattaacgaaagatcccttacactgaaagatataacagaagcatatttagactgggcaaatgtaacttgctggatgttattatgtaatcaaacctttt

SEQ ID NO: 3466 - DNA, 1134 bp, Oryza sativa
gcaggccgtgtatttggccacctttccggccagagccaactcggcctgctgtttgttgccccaaaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagttttttgaacgggaagtctaacctacattttaactagggaagtgctttgtatttgaggatgtgcggactctggggttctgaattcatgggt

SEQ ID NO: 3467 - DNA, 5886 bp, Oryza sativa
aagttctgctgattgtggaaatatttttgctacattatcaactatgccgcttctttctagcttgcttctttctgcaagagatgagaatgaaccactttgctttgaggctctccagcccatgtccaaagaactccacaggtcaattatcagagggcaatgggccaagggcacattggactacccgatatttcttagccacactacacatctcaagtacttagctctaagttggtgtaatcttggggaagatccactggggatgctcgcatcacacttgtcaaacctcacttatctaagactgaacaacatgcacagttcgaaaactttggttcttgatgcagaggcgttcccccacctgaagactcttgtgttaatgcacatgcctgatgtcaaccagataaacatcacggatggcgcccttccatgcattgaaggtttatacattgtatcattgtggaagctggataaagtccctcaaggcattgaatcccttgcctccctgaagaagctctggttgaaggacctgcacaaagacttcaagactcaatggaaaggtgacgggatgcaccagaagatgctgcatgttgcagaggtccgtatatagatgttgcagattggctctttctacattagtattctttcttaaagtctgtctgcgtgcaagtacatcacacatttagttctttccagtaatttgtcagatttgcatatgtatggtcggtattgttttctttggtaacatgtcatgcttgattttttttcctaaaggaggcccccataatttatgtgttgtttcaattgccttcagatttatttcatgtaagaatcatgtcccatttttatcaacggcatcttcctgtggtgttatcaacgttggaacctccttgttctcgtctgataacagggcttcgcggctgttttaatcgagctccatgcctagtgtggtctgtactggggttggctttggtgcagacatgcagtgcaccggcgtgagcccatatcgcattctcagttgtagtgtggtaattaataatgctgcatgttgtctccattttatttcttggaaaaatacaggttccaatgtattgattttgctaaagatctctagatgtgtaacaaactagagtcattcaaattcaggattttgattagagtaaaatacaccagcggtccttaaacttgtcaggaggtcttacttagatccacgaacttgcaaatgtgatggccatccactttctcttgttagtgtggccaattttttgagaagggttaacagtctgacggaaagcagcgacgacatttgccaccgattaggttctcaggttgagaaggcacctgcattccaagaattgcgggaagttcttatgagtaactatggcaatctgtctgatcatcttgtcaagacatgcctgctatacatgagtgtattcccaaagggttttgagatcaggagaaacagtctagccaggagatgggtagctgaaggatatgcacagtctgtgggtaaattcacagacgaaacggtggcacatcaaaacttcaagaaactgcttgaccagaatatcatcgagccgatgggtgcatgcgacaatgcaagagtgaagacatgcagaactaatgctgtcatgcgcgagttcatgctgcacagatccttctgtgatcacttcatcgggtctcttgatacaatgtcagagtcagatgacccaagtacctttcgtcatctcttcatccagaattgcacaaatatcaacatcctcaggttggccaagaagaaacttcgtgcccgttctctgacaatctttgggagtggaggaggaggagctgtttcttgtatgagagatgctccggtgctttctactcgtagtattatactaccagtagaactaatctgaaccgtttatttttttagggtagattagtataagacagatttggggtagatttgacacttaatttatttctccgtgtgggtctcgtggttagcgtcgctcggaatcctcatctatctcaatcgagcggaggtggagagcgtgactccttccgccggcgcctcgactccttctgccggcggcgcttgtgcattccgttcccttccgccaacggcggaactctccggcgcccctctccttccgttccccttctctgctggcgtctagccgcttccccaccggcctgcgcgcaggagcttctgctgtgggatgtttttctgttcatgattttgtatgggttgcgttttgcctgaattctggtgtgaactgaacagagaagggaaaacgttagttggaaatttatctgaaatgctgtagttcgtttcatagatatatggactaatccatgttagtactgaagaccaactgatcatcaattgtttggtttagttttcaacagtaactgatccttctgtttgtctctgtctgtttggttaattgaccctactccctgcatccctgcatgtatctgaattcttctggatatgaagcaactcgtttcaaatatggatgtggatttaataccctagtatgtcacaatgtgttgaattcttctgcatctgtggcattccgtttcagagatgaatgggcttatctgaagaatcatgcttttaacttgcagggctagttgaactgttggatcgcttgcataaagtaaatattttgcccccaagctgccactcttatacttcctccgtttctaaatatttgacatcgttgactttttaatacatgtttgaccgttcgtcttattgaaaaacttttgtgaaatatgtaaaactatatgtatacatataagtatatttaacaatgaatcaaatgataggaaaagaattaatcattacttaaattttttgaataagacaaacggtcaaacatattaaaaaagtcaacggcgttaaatatttagaaattgagggagtatatttaagtgaaatcccaagctgctaagttgccattcttatatatttaattgaaatcccactcctatgtactcttatgtagcaaaaccgttttactgtagacttgttcgatggtcgcaaaatgcattgacagtgatatgctatcaaccataaactctggacagaaagttaattagggttgatcaaagaatagtttgtcaggttttgctgctatcatgcttcttcagcaagctctcccttggtctgttcaatggtatatgcaaccaacttcgtatgtgtcagaaaagatgcaaagcaaaatgctcaattcagtagattgtcgacaagatttttgacgacatcgagcaatggagcagctgcgggcaaatgtgctggtgcatttctctcagagagctagataaacgttggaggcggcggaggcgagtgcgtcgggaggcggcagacgagggcgagggtggcggagcaggcgaggtcggctgaggcggcggaagggaggagtcgcgagggaggttctctcggcatgggctccagatgcaggcgtcagttccagaacgaaagaagatagggtagctattgttataaagtgaaagtgacgattatacccctccgtaaataattttatgtagacaaaagtacccctccataattctactaccattaagtgaggtggtagtagagatagatctgaacccttcgatcaaataagatcaacggttcagatttttttctactataagtagaaagcaccggagtgagacttttcttgtattgccgagtgtgaactgttgcaggccttagatctaaaagaatgcaatgattttgatgataatcgtgtcaagggcatcatgaaggacaatctcagtcgtctaaaatatctgagcctcggaagcgctactacgaaacttccaaaggcgattgagaacctacagtgtttacatacactcgaattaagaaagacaaatgtagtggcactgcctatagtagtcataaagctgccccatctagttcacctgtttgggaaggtcaagctcaggaaaaagaggagtattcatgcggtgcaggtaatagatgatatcatctcaaacaaaaaaagtatcggacaaaagagtaagctgcagactctatcaggatttatcatagacaaagactctataattccgcaactgatggttcatatgaggggactgagaaaggtcaagatatggtgtgattattccactggtgaaggtaacactatccacctcaaggaggctattgaaaatatggttatgtacgaaatggacacaggtgttggcgttcgttctctgtcactgtacctcggaaatgccttggagaatcttcttggtcttctaggtgaaacaaatggttttcttaccactctgaaactgcacggcagactgagccaatttcccaagtttgttacgtcgcttacaggcatcaaagagttgtgcctttcatcaactaatctaactgggagtgatttatcaggatcaggcctgggtgatctaccctgcttgctttatctcaaactggtagaatacaaccttgtgggcttcgtcattaaaaaaggggattacccagtcctgcagcgcctatgtctagtggtggagagtcctaatcctatcctacctaaaatcgaagaggaagctttgccagaacttgtttcacttcacctgctttgtgtgcgccttggtgatcttgctggcattaatattagaaaccacacaaatctccaggaagttgctcttgattcagctatcagtatggaaaccataattacttgggaaaatgaagctcggaagcacccaaaaagacccaaggttttgttcttcaaaagggttggcacacccaacactgggtgtacggtaaagtatactgcgaccgagaggcctaaaacacctgagagcacggggcccggtgaatcgatggaaatagataattaaggtcctctccgtctctgactgatcgagctgctaaatgctcgccatgttcttcaaggtcagtattattactcttatcatcgagtattattatcctgattattagtgcgctctacatacatcgagtaaattgttatctacatgctaggaacatgtagagcgcaatttactttgcaaatgaaaaatgtcagggtttttttatcctgcaccttttgtattgtacctttattttatattacaagtctctttgactttttctttagttaaactttttaaatctgaccaaattatagagaaatataacaatattttcaacactaaacaaatatgttatcaaaatatactcaatattaaatttaatgaaatttatttggtgttgtaaatgttgctaaattttcctatatttctagttaaacctaaaaaggttttactaagaaaaaaatcaaaacgatatataatataaaacggatagagtatttgggcctgtttgggggagctttagattctgagaagcagctgattgatagccagcttctgagaatctggaaaagctctgaaacccagcttctccagcttctagcttcttagttcatatttcagaatctgtaactacagattctcagaagctgtggcctgtttggaacagcttctagtagaaacagcttttgggaaaagctgcagctgggacaaactcccccaaacagggcctttgtcttggcaccgtcgctggttgcaacttgcaaggttgtattcttctcgtagaattttaacatgacgttcatttccattttacagcatgtcgatcgtaaagctgttgttccgcaggagctgtaagatcggcgcccgaccaccgtctgttgaatttccatatttactacagtgaaccatgtcgtgtgtgatgtgtcaagtttccttacagaatgagtaactttcgtattcatattatcatgtcggcctgctacaaaaataaaatcagaacaaatgatgatttgtggtgtgtctatcaactatagccgagtagaaaacgctggtttg

SEQ ID NO: 3468 - DNA, 1682 bp, Oryza sativa
tcccctccggcggcgggaggcagctaggcagtggcggcagccgtcgcgcacggagggccgcccctggcggcggaggcaagtgcggaggactgggcgcaaggcgcccggcggcggtggcccgcgcggcgaccgggcgcaaggcggccggcggcggtggcccgcgcagcagcggggcgcaacggtggctagacgcaaggcggccggtggcagtggcctgcgcgacggccaggcttcagtggccttcgcgacggctgggcgcaaggcggccggcggcccacggccgggcgacggcaactgctacttgattttttttattttgtgaatttttgtagtgaatgatgaatgttttgtatattttgtcgatttgggaatggtctcacaaaatttgtggattgtggatgtgtatgtattattgatgattttgctggttgatttgtggataattttattgtgcatgattgatgatttgtgaataaattgagtggatttggggtggaggaatagatataagcagaaaaaaacagccgtgacgtgaccctatctatctttagtcccggttggtattaccaatcaggactaaagatggatttttaatcccagttatttcacccgggactaaagatgggtatctttagtcctggattcgtcctcccggttgcaaaaccgggagtatagggggtttccgaaccgggagtaaaaccttttctctactagtaattcggtatatattccgtctctgactcgtcgttcagagcgcactgacgatcgagcagcggctgattagggaggtcagagcttggtgctgatggactagcaacattctccccggctgattagggagggcacgtacgccgtctcaaggctccagcagcgctgaagagattgagctcgtgccaccgcgccattaccactccgatgactcaaattagtcgtctgctcgtaatgtgtttgtcagctgttcttgtgtgtgaactttgcgcttagaaagtcggatcgtaaacatctgttatcaaggagaaaaaaggtactgtgtaaagaacattggacaaatttcaggggcccaaacactttcacctgtatcttttattctccgcgatactcttgtgaaatcaaagtgttttttattattatatattttgtgatgaacaattgatatgtgagattactggtttttatatttcacggatattcgacgaagtggtgctaactatgttggactagtcagactaggtggtgtaggtcagtcagaccagcgtgtagtgtgcggttagaccgaccagtcaaatggtctgactggtatgctcatgcttggagttggtttcgggttgtttctttggatacttgtgattatctcgtgtttataacttctggatgatttctatgcttgtgtaatagtgtggtttgctaatgttgagtcaaggtagttgtggaagaactatgctcagatatggtttcttgtttactaatgtgtagatatgtcttgatatctcaagagagtattgccggtgatggattgggaattaagttgggagaagatgacgtccgaacaatgaggatatcatgccattgctgcacaagtgatctttgccgccggttgggaagctcttattgtcccggttatgcaaccgggatggcaaattcgggattaaagatggctacctttagtcccggttgaaataacc

SEQ ID NO: 3469 - DNA, 16357 bp, Oryza sativa
tcaatgttagtaatgtggtaattaattggactcctggtttggaatggttaattcctggtttggaggtttagtttgttcaactggggttggttgttcaaatatggttgggcctatgcaacatgggtgtgttgtatggtgttatttaatattgattaattattcaactgttttcactattctcttaaatatttattaaatgttgtttctgcaaatgagctatgttatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttcttggttaagatgcctgtggagtggagtcaccatagctgttccgtagtttgttatagtttttctttccgctgcgtagaatgttattctttgagaggaactatctacctctgtaataatttttatttgcgaatattaaatagtcatttatttgtactctattattaatttgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaatagaactgctcttctctattctcttacaaattaattaagttggcagcacatgcaaggttatgcacaaaatttatttaactcaatttcttttcctttaaaagcaaaagttgctcttctcaaaacgtttcattttctttttaccaaatcttattgattagtcggcactgtacatctattatggtatcgatttaatcatgctggcactagtactactcatcccctttaatggtgacattgtaccgtgcttatagtaggtcttaagtattctggttttattttattcacttgtccaaactgatttgtctatgttcaaaagttaaaattctaaaaacatatttatataatagcttggtatgtgtcttttcttttattgtcttcctttttggtcaaaatcagttaagtctagatggtgcagctaacttaaaatatgcattaattcttctcttctatgtttctttagatgccgccccattcaccgagaaatttgttcaaggtgttaggattcgttagggagctgaggttgatggtttttgaggtaggctatgaagttgctcccgagtaccgccaaatttcccatgaccccgacgaggagaagtgtcgtgttcgtgtgacgttggctagtgatcgtgaagaccttccgtccattaagttcgaagctggaggaagatcgtacagccatgcttgtcaagaagcagctttggtggccattggagagttgcgtcaacgctttgaagaggagttggattcatcagctttccagtatcatcctcacaagcctcatggacaagactatggaacctatacctgtcctgatggtgaagagagtgccactctgatgcatgcggtgcatatgcttagtgctatggatgcagtaagtgtggagcgagacaaagcagctcatgacagggaaaactggaatcgaggcaagatttacaagttgaagagcaaggtgtaccgtctacagaaggaattagctgaacttaaaggagaaacgccgccgccaacacccaagcttcgcctcaccgcaagaaagagaacctgtccgccacctcgtctccagttagctttgaagattcgcgtgatgggtgaagctgtgcccgatcgtgctgaacctgtcattgacatcataagtgatgaggaagaggaggaagaccctgaagaaagagagccagctactccagaggaagaagatccatcgcttcgttccgacgcaaggcggaattagtcgcttagttagatcgttgccgtagttcgctgtgttagattgcttgtttaagtttgcttgtgagtgtgtgggttttagttgttgcttacatcattggtgggatgtaacagcatgagtctagttctttgcttgtcagagtgtaagatagttggtgagatagtgttaatgcaacttaaatgtaatcatacacagttaagagcaatatagaatttaaattaattaaataactccgttctaagggtgtctctctgtcgttctttcctgttgtccctgcttatcgtcagatggtcaacacgcgcaccggaactggaagtggaagtggaagtggaagtggagctactaacaatggaggagatcccacgttagctcagattctggcccaacaaacgcaactgatcaatctgttagtgcagcaggcacagaatcagcaggcaaacaatcagaaccagaatccacccccacctccccaaaacaagctggcagatttcttacgtgtgagaccccctaccttttcaagcaccaccaatccagttgaagcaggagattggctgcatgcggtggagaagaagttggacttgatccagtgcactgagcaggagaaagtttcttttgcttcgcatcaactgcatggacctgctgctgaatggtgggatcattttcgccaaggcagggctgaaggagagcctattacgtggcaggaattcacggccgctttcaagaagacacatataccagcgggtgttgtagctctaaagaagagagaatttagagaactcaaccagggatctcgttcggtcaccaaatacctccatgatttcaaccgtttagctcgttatgctccggaagatgttcgcaccgatgaagagcgtcaggagaagttcttggagggactgaatgatgagttgtcttatgctttgatgtctacggatttccgggatttccagcagttggtagacaaggcgattcgtcaagaagacaagtataaccggatggagcagaagaagcgcagggctgcccaattcaagacacaacagggcagtaaccagaggccgcgtctcgttactggacctcaagttccatcgtatcctcaaggaggatcttcatcagttgtccgcccccaacgccagttctacaacaacaatactggtaatcgtggcaatgacaaccgcaacgtggttgctcgtcctgcagcaactccagctcagaaccagcccgtcaggaaggaacagggaagcaagccaggggtgtgtttcaattgtggtgatccaggacattatgctgataagtgtcctaagcctcggcgcgtgaagaacgctccagccccgaacaactccaatgctccagcaccaaaggcacgtgttaatcatgttgcagcagcagaagctcagagtgcaccagatgtgattttgggtacgtttcctgttaactctatacccgcaactgtgctttttgattccggtgctacacattcctttttgtctaaaagttttgcgagcaatcatgggatggaagttattagtcttgggagacctttactagttaataccctaggcaatcaagtattttcgacacaatattgtccttccgctactatagaaatagaagaagttcctttcccatcctcgcttatcttgctagaatccaaagatctagatgttatcttagggatggactggttatctcgtcacagaggagttatagattgtgccagtcgtaaggtgactttaaccaatagcattggggaaaccgtttctttccttgcgtcctctcctaaatctcatggtgtgatcttaaaccaagttgctctacaagagatccccatagtacaagactacccagacgtgtttcccgaggatttgctaggtatgccacctaagagagacatagagtttcggatagacttggtacctggaaccaaccctatccataagagaccgtacagaatggcagctaatgagttagctgaggtgaagagacaggtggatgatttgcttcagaaaggatacatcagacccagtacttcgccatggggagcaccagtcatctttgtggagaagaaagatcatactcagagaatgtgtgtggattatcgagcgttgaatgaggttactatcaagaataagtatcctctacccagaattgatgacctgtttgatcaactggaaggtgctacagttttctccaagatagatctccgttctggatatcatcaacttcgaatccgtgaggaagatataccaaagaccgccttcacaactcggtatggtttgttcgaatgtaccgttatgtcatttggactcactaatgccccagcctttttcatgaatctgatgaacaaggtgtttatggaatatctggataagtttgtcgtggtgtttattgacgacattcttatttactccaagacgaaggaagaacatgaagagcatcttcgtctagctttagagaaactacgtgagcatcagctttatgccaagttcagtaaatgtgaattttggttgtccgaagtgaagtttcttggtcatgtcatctcgtctggaggagtagcagtagatccaagcaatgtggagtcagtgttaagttggaagcaacccaagacggtttcagaaattcgtagtttccttggacttgcagggtattaccgcaggtttattgagaacttttcaaagatcgccagaccaatgactcgtctgcttcagaaggaagtgaagtacaagtggacggaggattgtgaacgaagtttccaagaactgaagaaaaggctagtgactgcgcctgtattaattttgcctgattcgaggaaaggtttccaagtgtattgtgatgcatcccgactcggtttgggttgtgtgttgatgcaagaaggaaaggtggttgcttatgcatctaggcaattacgtcctcatgagaataactacccaacgcatgacctagagttggcagctgtggtgcatgcattgaagatttggcgtcattatcttttcggtaaccgtacagagatatatacggatcataaaagtttgaagtacattttcactcaacctgatttgaacatgcgtcagcgaagatggttagagttgattaaagattatgatatggagatccactatcacccggggaaagcaaatgttgtagccgatgctcttagcaggaaaagctactgtaatatgtcagaaggtcgacgtttaccttgggagttatgccaagaatttgaaaaattgaacttgggaatagtcagcaatggttttgtggccgctttagaagctaaacctactctgtttgatcaagtcagagaagctcaagtgaatgatcctgatatccaagaaataaagaagaacatgagaagaggtaaagccatcggttatgtagaagatgagcaaggaactgtgtggttaggagaaagaatttgcgtcccagaaaataaggggttgaaggatactatcatgaaagaagctcatgaaactttgtattccattcaccctggaagcactaagatgtaccaagacttaaagcaacaattctggtgggccagtatgcgacgtgagatagcagaatatgtggctctatgtgatgtatgtcagcgggtcaaggcagaacatcagaagccagccggtctgttacaaccgttgaagattccagagtggaagtgggaagaaataggaatggattttataaccggtctacccagaacgtcggcaggacatgattctatttgggtagtggttgataggttgacaaaagtcgctcatttcataccggtcaaaaccacctacacggggaataagcttgcagagttatacatggccagagtggtatgtttgcatggtgttcctaagaagatagtgtcagatagaggtagccagtttacttcgaagttttggcagaagttacagttagagatgggtacccgtttgaatttcagtaccgcttatcatcctcaaacagatggacagacggaaagaataaaccaaattttagaagatatgttgagagcttgtgttctagattttggtggaagttgggataagaatttgccgtacgcggaattctcatataacaatagttatcaagctagtttgcaaatggctccgtatgaagcattatatggtcgaaagtgccgtacgccgctcctttgggatcaaaccggtgaacgtcaagtttttgggacagacattttgcgagaggcagaagaaaaagtgaagattatccaagaaaggttgcgcgttgctcagtcacgtcagaagagctatgccgacaatcgtcgcagagatttggctttcgaagaaggagattatgtataccttcgggttacgccgttacgaggtgttcatcgtttccagaccaaagggaaattggcaccgcgtttcgtgggaccttttaagattgtgagtcgaaggggtgaagtagcttatcagttagagttgcctccgtcaatggcgggaatacatgacgtgttccacgtatctcagttgaagaagtgtttacgtgtacctacggaggaagcagatcctgatcgtatagagcttcaagaagatttaacttatgttgagaagccagtcagaatcttggaagtaaccgagaggaataccaggaattgtgttatacggttctgcaaggttcagtggagcaatcattcagaagaagaagccacttgggagcgagaagatgaattgaagtcagctcatcctcatctgttcgccagttcttctgaatctcgaggacgagattccgtttaaggggggtaggtttgtcacgccctaaaaattgcctaaattaaaaatgcatattttaaattatttttagaaattattttaaaagcctacaaactaaagtctaattttctaggaaaattttcaacataaaaatgagctacataaaattttattaaatactatacttgctcctctattttctagatttttctgggaattatttgagcaagggaagtatttttaacaattgaaacaacatttcacaaattgttttatttgaaaaagttcaaaaaaacccctccctaagccgttgggccgaattcggcccaacatcctttccctcccgcgcggcccaagccggcccagttgccgccgccgcccctctctcatgtgagacaccgacatgtggggtccacatgtcgggcctttcttcaagctccagccggccggccgaccaagccgagccgccccaccgcgtcccctttctcctctcaaatccgctccaatccgaccccgattcctccgggtttttgagggattttgatcctctcgttctcctctatctttcccctcaagaaacggagcaatccgttgagtattctctccgaatcgagttcgtttcgagtttatccctaaaaaccgagtttggatttttcccgagtcgattcctctcgtttggagtccgatctcttcaatccaaggctataaatagcatcccctcgtcgccctctttcgtttgccccctctcccgtggtctcccgtgcctcctagtcgccgcgccgccgccgtttagtacgccgccgccgccggccgtcttcggctgcgccgcgccaccgtctccgccgtcgccgccgcttgccgtcgccgccgttaggtgcgcacggaggtgaggaagcctggccgcacctcctctttcgccgccgaccgccgtagttcgccgtcgccgaccgaccgagccgccgccgtcgtccctctcgtcgccggccatcatcggtcgtcgtttgtcgttgtggtgagtaccgttgggttcgtctcgtcgtcctctacatgtacatgccctccaaaaccccggccgactgccctagctccggcgaggtcgccaatccgagccgggccggccatggatgacgtcatgctgacgtcatcatctcctctttttccaatttcttttaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgattttgtttaattgctttagtttccgacgttccggaggagagcgtttcctttgaggaaggttccaaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaattaatggccgaagatgactttattttcctatgggttataatttgattagcatgaaccttatatattggattggttcagctaaacgctatatgtaagtttgcttagccatgcttagaaacattagctaactaaagggattaattataaactatgttatattattattttaattatggttacattaaatggtagctcacgatggttgatcgtgtgatgataattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtgtaacgtgattcattatagtgcgccagactgagaagtggcgagaagtccacgggggtcgctggggagtccatgccttgtttataaagggggtgattatgatccagaaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactgttcatcaatgttagtaatgtggtaattaatttgactcctggtttggaatggttaattcctggtttggaggtttagtttgttcaactggggttggttgttcaaatatggttgggcccatgcaacatgggtgtgttgtatggtgttatttaatattgattaattattcaactgttttcactattctcttaaatatttattaaatgttgtttctgcaaatgagctatgttatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttcttggttaagatgcctgtggagtggagtcgccatagctgttccgtagttatagtttttctttccgctgcgtagaatgttattctttgagaggaactatctacctctgtaataatttttatttacgaatattaaatagtcatttatttgtactctattattaatttgtcattgtgtgcctcggttgattcctggacgagggtttaacacacatataagcgtttggaattttggatagaaattccgggcgtgacactattcacctaaaatttgtcttttttattactcctaaatgaatttgagtttgaacttgagatttggtgagaatgtatttgagtttgaacttgaaatttgattttcgatgttcctaccattcactccctcttgtatgcttgactcttgtatggtggcaaactattgataggatgcatgtggtgtgcaacttgttggccttgggtgatgcacccactcactgatgctcatgtcacaaggaaactcagcatgaggtattgtgccatccggcatcatatataatcaaaatcctgaatttgaatgactctagtttgttacacatctagagatctttagcaaaatcaatacattggaacctgtatttttccaagaaataaaatggagacaacatgcagcattattaattagtacactacaattgagaatgcgatatggtatattgtgggcgcactgcatgtctgcaccaaagccaaccacagtacagaccgaactaggcatggagatcgattaaaacagccgcgaagccctgttattaatatgagaacaaggaggttccaacattgataacatcacaggaagatgccgttgataaaaatgggacatgtttcttacatgaaataaatctgaaggcaattgaaacaacacataaattatggggccttctttaggaaaaaaaaaatcaagcatgacatgttaccaaagaaaacaataccgaccatacatatacaaatccgacaaattactggaaagaactgaatgtgtgatgtacttgcacgcaggcatactttaagaaagaatactaatgtagagagaaccaatctgcaacatctatatacggacagtggcgaagccaccgtaggggccagggagggccaacacccccctaacccctatgtgacctcccctcccctctcttctcccaaggataattagcccttataatctagccattaattacatcattagttgcggatgagactaactatataggacaactgcctagctatatatataggacttatgaaatgacttagttaactgatttatcattttaaaaatgattgcaagactccaattaaaatcatggaacaaactgtttaaattggcaaattatgatctataggttctcattctctcttctagctaatcgctataacatgtatgatgtcgagttagcaatcatacatcaacgctacaatgtcactgttcaccgaaccttaagtgagttaccacgtctcgtagatggcaccccccgtctctaaatcctggcttcaccaccctacatggatctctgcaatatgcagcatcttctggtgcatcacgtcaccattccattgagtcttgaagtctttgtgcaggtccatcaaacagagcttctttagggaggcaagggattcaatgccttgagggactttatccagcttccgcaatgatacaatgtataaaccttcgatgcatggaagggcgccatccgtgatgtttatctggttgacatcaggcatgtgcattaacacaagagtcttcaggtgggggaacgcctctgcatcaagaaccaaagttttcgaactgtgcatgttgttcagtcttagataagtgaggtttgacaagtgtgatgcgagcatccccagtggatcttcaccaagatgacaccaacttagagctaaatatttcagatatgtaccatggctatgaaatatcgggtagtctagtgtgcccttagcccattgccctctgataattaacctgtggagttcattggaaatgggctggagagcctcaaaacaaagtggctcattttcatcctttgccgaaagaagcaagctggaaagaagcggcatatttgatagtgtagcaaaaatatttccacaatcagcagaacttatgttgtcaatccaaatacttcttatctgcattagttccttcagctgctcggccaagtccttgctggcttccacagtctcaagagtctgaagttcttccaacttagacagatatttgggtgcttgcactccaataaaataccggaactctgacttattttcatcctcatatctgtcagctagaaggtgcctcagcttcttgatcttagtgattccacgtggtagcttctctattttagtttgcttgatgtccagagtttgcaggtttgagagcttgtcaatagactctggtagtgagcagagtcttgtccgccttaagccaatgtaacgtaaattaaacaatttgcctatgcatgctggtacttcggtgatatctgagtcttgtagctctaggacagtgaggtatttggattcagacaaaattgaggataacaatccaggagggtgtgtagttgtttcaagtagtgtgcgaagatgtggaaatttcactgttgatgcacaaccttttccattgttcaagaataatgacagacgacggacttcccaatcaaccttttccacagctccataatcatttgcgtaaccgaacctctcctgtccagcaattgagagagccaggttgcgcacaatgtcatgcatcttacaagagatcaccttgccaagctcatcatactcgtcaacttcaagcatgttccggtggatcagttccatgagatttatttcggccacatcttctggtctattgtgttcgattctcaccgcaaaaccttctgcaacccagtaccgcacaaggctctcacgagatatgcgaaaatcttcagggaacaggctgcagtacaagaagcagttcttttggtcagctggtaatgcatggtagcttactttcagaattgccttgacatcatcatttttggccagctcactccgaagctggttgtacatttgttgccaggcatgctcagtttgtagctttgtggacatcaggccacccatggtaacaagtgctaggggcagccccttacacttacttactatggaggcagccacattctcaaggtccagcgggcacctatggtcctttgtgttgtaaaatgcccttctgcagaaaaggttgaatgcatcaatttcacccaaagcctgtatcttgagatggcattcagagggagcaagaactgccacatgttccatccgtgtcgtgatgataatgcgacttgcttggggattcttaagcatgccctgtatttcgaagtacacgttctggtcccagacatcatctagcacaatcaaacatgatgtacagttttcagtccttctgtttaattcttttgtcaattcatgaacgcccattttgttgattagatcttccttggattctgatgattcttgttccatgggtatgagcggactgactaactgtcttagaagactaaggatcgtgcaagtctgtgacacagtgatccaggcatgaactgggaacttgatcttttcacgttcaaatacgtctaaggccagggtggtttttcccagtccacccataccagacactgttatcactttgtggcctggttcttcagggtacagtaattcaagcaaccttttcctgttgtattcaatccccacaggatcgccacattcaagcaactttcttcttccttgagatcgcggtgtttcgatgtcagtgggtgttcttgaaatgagctgaactgtaggtaaccattccatttgctgtcttttaacctgttcaacatcaccctttatcttcattacctcactagcaacttcactgaaaacacctgcataatgtgctcctcttacgcatctcatcactgatccttcttgctgccgttgacaagcatagtatgagtacttgtccattatgtcttcaacacggtaagccagcttccgcagttcgtcgatccaacccttgacaacattcatgttggtatttgtggaatctaaatcttgtattacatctttcatgagacgcaattcccttctgatatactcaactttgtcaggaagttccctcaagttagatacttttccggagagtttggctatgacagccctggtggcttcatctcccaaagctgtactgatctttgagatggcaagcagcacagcttctgccattgccttagtgctgcagaatagaatcatgaatcatggagctttgtcacataacgaatttaaaagataaaaagggtacttgttactgttgtagaacaattacagctaagattgtttttacgacccttgtgggaatttgcaagccatatatgtattcaagtattcaccatgatgtaccaatagatataggtgaaggagctgtgtcaagacataccatcctcctagtgaatgagtgagaaagtaaagctaatcttaatctatactttctataaaattatagcccactaaatctaaagctcaacatataaccataccacatcatcaccactagcaataattactccctccatctctaaatacaagggattttggttggatgtgatacatcatatgtccagatttagtactacttggttattctggtttgtaaaaaggaaaaaaaataacacaatgatgatcacacatcagacatatttgatcacttttggtggatatagctgatacttgagaactgttttgtttgaagcgcctgcaacactcgtaatttcatcaggtaaatatttttggaccatttatggtgttatatgtcactgaaggtaagcatttttgtgcccgtaaagttcataattttcattttattcattagctggagagacctacttcttattgatttaaatcccactgctatgatttcttctactaatggaatgaattatgtgttaattgtcttgttggaaagcatctatgttttcttcaagaggtgatgttaccatgtttacccaatgatttctgctatttcatctttcttaacaaactgctttcttgttcgtaacaagatcgttattcttatgcattatcaggtggacctacttatcaaaaggtatatatatatatatcctttatccaaagtaggaaattaactttcttagaagtgcaaagcaaaggatgataatgttgcctaaattccaatataatatttcctttcatatctaaggttatagatgaatttcttaaccaagcggccataacctaagtgtcttttgtggtgtggaattatatagtatccaagttcatcatgaaccaatcctgaagggtccttactggaggaacggcatttgcggtcatttcctgtgctgtttaatccagaaatagtgctggagatgaggaagtctattgcaagatggtgatcctaatccattttcatttctaagcctgtggcaaactgttgctccttaaaaattgttatgttcattgaaagactctggttctattggacgaggtattgcgtggtgcagtcttattttatagcttatagctgtctcttacccttagggagttagtaaaaccaatcctttctgaatgtcatggaaattagtcattgtttcccaccaatctgaacttctcaagtggttggatcttaccctctgtcttgccaaaaagctttttaaagttcaaagcagtttcatatctaaagacatgaccattggatgtacttgtgggttcagaacttcaaatttctttataccaagatgtagaatggttattttggttgaatcctttactggtgcaatgctctatttgtagaaatgctttctttacaacagaacttcactgaagctctgaggatggtgtttgtgtgagagttcaactgaaaataaactgatgtttttcggacaatcagttaatgtggccgctgctaaatgcatgagcatcagcagtttagccaaggacctaggaaccaagttggcatgtttctgtctctttatgtcgccaaactaatttatcctgtaacttttattttattctctaagtttgtgctttcacccaagtacagggtgatgtcaaactacattgcagggaaattattgggattgttactaatgagaattctttatctaaactgaagcagatggccgtagcaactcaatataacatcagccaaagagataaatatatgagaggatgcaaacatttgagactgattaccttctggggcttgacttgagcttgtagttctagcctctaggtattattgcagcagttggcgaaataatgtgatgaaaaccctgcactaaagttaaaaaagaattattctttcaataaaacatcagaacaaaacaatgtgatgttgaaattgatatagttgtactgccagtatatacagagatctccaaaatgcagaactaaaccagaaaaaagctgttcactgctgttctatgtgattgtcgctcaaattcataactaatccccaagattttcaagcaaaaaagaactaataatctcttctcccaggaggaaaattctcgccagaaactgtataacttccaagcagacaaaaaaacaggaaaactattccagatctgagagtctgtaaggcaccaaaaatacgagaagattcagtacagatcttcgagctagagctgcaagcagcaagagatagaatctcacctcaaatcagaacaagggtcttctttcgtcagctaatccatcgaagagcagagctagtcagatgatgatttttggaggtcgagaggctactcccctctctctccctcgccttgatctttagcctgcgaggctgcgacgacttgagatcaagtcccacgcgcttagcagcatcctctgaagtctgaactagcagaagaaaccgctgcgaaagttcgtcaaaatttccaggaagaagccaagagaagagatacccactactgcagtcaatctgagccgtcggttggacggctcaatggccagattttgtcaagttcatctgggccgggtcaacgctcaacagcgaggtcaacgtcgtcaattattttcttttccttttccttttttttactagataaaatgcccgtgcgttgcaacggggagaacagat

SEQ ID NO: 3470 - DNA, 9767 bp, Oryza sativa
aaaatttgtcgacaaatatataacaaaatcgttaggtatatataggtatagatttgtcaaaatactcggttactataatgggcttagcgtgggccggaattcacttgtgggccgcactgtagcagccgaagcccaacaagcgctcgcatcgacggcatttttcacggcgagcgttttctggggtgtccggtggccgccgctggcgaatcagatccgccacctcgccctggcgctccggcggccggcgaggtgggctgcgctgcgccgccgcttctggccagattcgcctggtaactcaccgattcaatctaccggattatttgctaggatagctagcctaattcgttggttgcgtttcagatgtttgagttaggcggtatattgatgtcgtaacgagttcagttttgtctacctcaaaaaaaaaaaaattcagttctgtagatgctgttcttccttccatgttcatgtggggatttatgccctaaaatacatatggcactttcaacacaaagagagttcatacagtactagagcaatgcattagtgccttagtggtagcatgccatgtcatattgagggctgctcactgttcatactgtttcagtataaaacttcacatctgctttatcaacaagtttgtttattattgccttgagtgtttcaccgaatttttgtttgtcaaagtatatatctttgaaatgctaggaggctagatctgtttttatctctgaaatttgatgttgcaatcctgctttcctacagaggagtgtattgctgctatcgtccaacaaacaatatataaaaggatgctatgagatcattatgtaataaatccatgtcaaaatgggaataaaggatcattattcatattaaacattgcgctgcctgaaacggatttaagaactggaagtgaaacacaaggcaaagacccaaggaacttcaggtcgtgactcctgatggcaaagagactaagagagtcgatatttcatgacttgttgaagaaaaatatgaaccagatgtacagataccaagtacaccagagccaatgtctttttagagaggattgggtgaatgcagatgcacttttcaagttattcatcgaaggaagatgtagcacaccactcctaaacacgcagatctggaacatgctgcattttccggtgcatttctctatggatccaatctgctttgaagtcttgatgcagattgaggagccagagtttcttcagggagaaaagattttcaatgcccacagggactctctccagccctggcagtgaatcgttgtataaaccttcaatgactggaagtgcatcatctgcgatcttcagccggttgacatttggcatgagcttcaagacaattgtcttcaacttgggaaaggatcctgcagtaatgatcaacctgtttgcactaatcatgctgttaagtctcaggtatgtgaggtttggaacatgtagcccgagcactcgaagtggatcctctccaagttgacaccaacttagagctaggtacctgagatttttcccatgttcctgaaatatcggcaattccaatgtcccagtggcccactgccctctgacaattagcctatggaacttcttggatattggattgagattttggaatcagagtacctccttctcatcacatgcagagagaagcaggcttgaaagaagtggcatcttggacagagcagtaaaaatctttgcacaattagtagcactgatattatcaatccacaagttttgcagtttcgtcagcttctctagctgttctgctaattccttgctggcttgaacagtttcaagagtctggagttcttccaaacctgataaccctttaggagcttccactccaatgaagtatcggaactctgtccgtttctcatcagcatatctgtcagctataagatgccgcaacttcttgaccttaacaattcctcgtggtaatttcactattttggtttgcttgatatctaaagtttgcagattagagagattctcaatgcattctgggagcttacatacgttggtgcgtcttaagccaatgtaccgcagattaaacagattacctatggatgtcggcacttcactgatttcagagtcttgcagctcgagaacactaaggtagtttgatcgagaaaaaattgagttcagcatgctggtggaggatgaaacagcttgaagggacaatagagttcggaggtgcggaaatgacacccttggtgcgctatcatctttccatccacatgttgagaagcgacgaacttctgtatccagctgcgtcattgtgccattatcacttgctgagccaaacatctcctctttagcaacatcaagagccaggttgcgcacaatgtcatgcatcttacaggtactcaccctgctgagctcatcattctcaacaacttccaacatattacggtgaatgagttccatgagatttccttcagctacatcctctggtttgttaccatcttttctcactacaaagccttgtgcaacccataatcgcacaaggctctcccttgacatggagtaatcctcagggaacatgctgcaatacaagaagcagtttcttaggtctcctggcatatcgtggtagctcagatttaggatcgcccggacatgatcattttttatcatctcatttctaagttggctatatgtttgattccaggcatattctgtttgtttccttgaggacaacaggcttcccatagatacaatcgctagcggtagaccttgacacctcttaactatagaagtagccacctccataaggtctttggggcagcctgttctaccatggaaagcccttctacagaagagattgaatgagtcagtgttgcctaaaggttggagatcaaggcgatattttgaggatgcaagagctgccacttcttccttccttgtcgtgatgacaatccgactttcctggagattctggaatgcattgcgcatcatagtgtatgcttcatggtcccatacatcatccagtacaatcaagcacttgctatcttctaactttttctttattttatctgttaactcataaacatccattttattcatgtttgcagctggtgattgctctcggtatgcaaccttcataagtagagtgcatagcaattcttccacatcgtaggtctttgatacaacaatccaagcatgagcagggaagtttcccttttcccggtcgtacacattttttaccaatgtagtttttcccagtccacccatgccggacactgttatcactgtaccatgcggctcattggaatacagccatccagtcaattttctcctattttcttcaacccccacaaggtcttcatctttaataaattctggcaggcagcctccagatatttgtctctcaatatcagaaggtgtttttggactcatgagctctgccgaaagagaccatttcattagatctttaacattccttggcagatttttcaagtttgttactttttcagacagtttcgctagaacagccttggtggcttcttctcctaaagtggtaccgatctttgagatggcaaggattactgcctccgccatcagtgctgaagaacagaaacatggagtcagtcttttatgtgatatgctaacaattaagaatatcaggcaagaacatcatctgattgaatagatctgatccatgtattatgtgctttacggattatggaaataatgaacacataagccaaacaacatttaatccaatgcatgtaaaaaaaaatgaaacaaaatccaaaagcagtaacagtcaaatacagtttccagcgagatgcaagcacaatgaatatataaattcattttgaaattaaattggagctatctcttctgtatactgaaattagtatatgtgagtattaaaaaattatttaccgtaggtttgtgctatataagttccgtaggttattttacattaggtcagtattatgcaaggttacacattgtaacgaaattcaggtttagttttgaaactccaatgtattatatagaaatcaataacaaactagaaattaaatggactgctctaggcaagaccatttcattctagagtcattgtccatgctagtttcataaaaaaaagtaccgacacgattaaaaaaatacataataatctgaatttctctggaacatctaaaactccagcaaattaaacatacccatgttaattggtaccagcaagagctggccatgtggttttctatttgtacaaacgggcccatctatttccattgaaattgttagcgtagattcttgtaaaggtttgagagttgatgcatatttgttattacataactggttcataataatgagatcgggtatttcaaatcatttacttgggaggtattttttttgttttccttttttacatatgccgtacatgcatacagaaatatctaattatgagactccctgatggtagactttcagaaatattttaataaactaaattactttctggaccttgattcacttgctccctagtgtttgagctgctgcctgctggtgcttttcacatagttattgaatttgatcatattggttacaattgctcattaaaaaagtgaactgatgtgaccttgattcacatgtgatgcgatcttttatttcttcattagctgaactgcctaaacaattttatttcttaatgactataggtattttttgtctctgcttcagcaattcgatatttttgtctggattactttcttgtcattagtagtatggaccttgtcagtcaaagatatgtctggtgataatattattcaaacaggaggattatgagttaagaatcatgttgtgctagctaagattttagatagtttttctaatgacgtggattcaaaatccactgaagtatgcatcttatcatttttcttttttatgcaaaattagtgacaagccggtgtgctttcagattattttctcacatttatcttgtcttgctgaaggcacctggacactggtttctgttggagtaatgtttcaaattggctttcctcaataatatcaggacttaatccatttgtttttgacgctttaaaacagctatgttctctgtgatttactatcttcagtttgaagttttttaatgagatgtggacataaatatgaggtcaagaacaccagaagaatgcacacacactttagcaggaatagcttcattcacagtaagttgtttgtctctactctttgacgatattgaaaatggctcactttaccctctactttttgacgatatttgtctttaatgtttttctttctacaagatgtattttaagttgaaatttcggagatgaaatcaagaggtatcctctactgcatccgtctaaacggttgaaaccgtggctggattttgttgttgtgttcatccggtgaggtttaaactaggcaagtagatgccactgaggggaaaaccacgtcaaatcttcgatttttgcaagcattaaaacccacaagccccacaatgccaagaattttccatcaaacatagacataaaagcaccaaaccaaaagatacaaagcaagattcagtacaaatcaatctaacctgagctgcagatcaagagcccgtctgtaacagcagatgagctggtgatactacgccttgccctgacgatgaaggatgagaggttcagagaggcagcaaggcaggtataatgcctctcggtcttgaaatctcaatcagatcctgtcagtttggtcgcaatttctgagaatcagtcaccgacgacttgacgcgcagtctacacggctaagcggttgcagtgccattgtcgtccagtggccaagttggcgcgtataaagacatgagtccactgtggatgtttccttccatgaaatttctggtttttatgatttatatgtgcagcgtccgagcttttctaagcacatcctgtgcgttataacgggtcaaacctatataattaaagatgggcatgctttaacgtatgatactcatatagtgtactccctccgtttcacaatgtaagtcattttagcattttctactctcataatgaatatgaattcattaacatcaatataaacgtgaaaaatgctagaatgacttacattgtgaaacggaggaagtatatgctacgaaaaagaagagaggatggaagatgattgaagaaggagatggaaagaagaggattccacttttacagtagtatagttagaggcacgtaaaagttgaaagaattattgtgcagtaagagagaagatatggaaacacttaaaaagggcgtcaataattcatatcgaaatgaaaataagctaatggagaggacggtaagtaggtcatgacatatttttttctatagtccactacgcaaattaggatatcaaaatttctataattgtgtcggcacatttttgtctcagtcaattttttacccgtcggattgaagttgatgtccctgtgcaccatgcttggctgtttcatattgtaaaatcaaggagaatagcccacttgatccctaaagtttcgctttaaggttaatattgtctttgatattttattttgttcaatcagatccttgaactttatcatatggtccaatatgaaccataggtctactagaaacgccatgtagatatgccatgtcatcatcttattaaaaatggatggtgaaatgtataatttctccattatgtgtgatacgaaatattataactaattttacatgattatataatttaatctaatcctaggaattgatatatacacaaaattgattatgttgcatgtattggtagacaaatcgatatatttgagtatttgcaaatgtaagtgtgtgtgaatttttcctttttccctcttatgttgtatgtaagggtatattaagtatttcatgatagatttgtataagatgatgagatgagatgacatgcctacgtggtctttctgatgggtccaaggaccatagtagactcaaagataagactccgagaactaattcgagcaaaataaaaaatcaagaactatattgaccacgaaagtttaaggaccaaataggctatactccctaaaatcaaccaaataaggagccattagttgtcggtttctcgattacacgtcgtcagtttctttttcctttcttatttggcaaaatacgcggttgctaatttgtatcgactctagactggcctgagcagtgggccggatttcacttggggccgcaccgtagaaggcccaggcccagcaagcgctcgccggcgacgagcacggacgatcattgacgccgctctccaagggcggcgagcggcgagcgttttctaggggtctccgcctctccgccgcccgccgccggccgccggcgcatcagatccgccgccttggtaactcccgaggtcgccggcggcccgtgaggtcggccgtccaccgcttctttccagattcggcagggttatttgaggtaactcctggattcaattgcccccgcgatttagttggtgtttgcttcaatcggattgattgcttgcttggatttaatgataacatcagaatttgtttacaattttgtgaatggcattcttcttcgcatgttcatgtggttagaaactttaggatttatgccctaaaagtattgcagtacaaaagagagttcacagttcggatggtgtactgcagcactgaatttgtggtaccatgccatgtcacactgaggaagtgaggattgctcactgcttaggctgtttcagttaaattctgctacatatgatttatcaaaggatttacttattgcctttaggatttcatctaaattttatttgtcaaagcacatttttgcccgcaccgttttttattttgtgtgtttagctcatttagaccagtgtatgtttgaaatgctacgaggataaacctattttctctctctctatgatttgaaattacaatcttactttcatagagaggagtttattgtcgctactttgcaacaaacaatatataaagaaatgctactagatcactgtgtaatatacatccttatcaaaaagagaagaaaggatcattctacataattaaacaccacactacccaaagtggagaacacattgacttcactgttcacaaatgcagttcaatagcataatagttcttacaagaaagccaatatctgaaacagccaaacaacagacctaactcctgggcctcctagccaaagagagccaacatttcaggacttactgacaaacatatcaggcatgatgaaaatgtaaatatgctgttactgataacaacaaaacgaaagacttgttggaaaggactggacgaaatgcagatgcatcaaacaagtcttgactgaaggaacatgtaagttgtaacatcccactcctagacacgcaggtccggaacatgctgcatcttctggtgcatttctccatcagtccagtgagatttgaagtatttgtgcagattgagaagccagagtttcttcagagagcaaagggtctcaatgccctgaggaactctctctagctctggcagcgacacgatatataaaccttcaatgactggaagtgcaccaccagcgaccaccagctggttcacatctggcatgtgcttcaagaccattgtcttcaggttgggaaaagaccctgcagaaagggttaaagtttttgcactattcatgttattaagtctcaggtacgtgaggcttggaacatgtggcgcgagtacccccagtggatcttctctaagttggcaccagcttaggatcttcacctctcatcttggcagaaaatctttaacttgaaggaagctggagtccaactacatctcagtagtgcatatcatcctcaatcagatggtcaatctgagcgtgtgaatcagtggctgaaaacctatttgcgatgtctaacagttacaaaaccaaagaaatagcattctctaccttgatcaggttgagtgctggtataatactacttttcatacatctttgaacatatctacttatcaagctctttatggtcaaaaaccaccaatggtgggtgaagcactcataccagccaattttgttggaaggcttcagaaacagagcgcaagcaagagctgcattaattgattcagtaaaggccggtctagataaagctcaagcttttacgaagtattttgcagatgtcaaacgaagtgaaagaacattacaagttggggacatggcctatctcaaagtgcagccttatagacacaatgcattaggcctgcacagctcatttaaacttcattctcgttactatggtccatttatagtgattgacaaaattagctcgcaggctcataagttacttcttgctgaacactctcaaatccatcccgtcttccatgtgagccatctgaagtgccataccggagcaaaagctataccagaaccagggttgcccttgattgatacaaatggcaatatcctcacagtgcctattgctctgctaagagaggcgtctgatacctcgaaacaacacccctgtcattcaatggaagattcaatgggaaaatcttccaccagaggcggatacataggaggatgctttgttcatcaccaaggtttttcatgctttcaaaccatgaagacatgatacttaagggtgggtattgtcagaagtctgaaactctgaactgctgaagaagcataggaattcagacatgaataggaaagagcggaagatggacggctcagatgcaacgatccgattcactaatgatcatcggagggtgtgcgtagcttttgaggtctgaaa

SEQ ID NO: 3471 - DNA, 8496 bp, Oryza sativa
tatagtaagcaactattgcatgaattagctacttcctccgtttcccaatttaagtcattctagcatttcccacattcatatcaactatttcacctagcttgtctggcgacctcataggtcgctcgcccccgccggcggcctctccgggctccgacggccccccccagctttagcctctccacaccgccgcccctcctctcccctagttggcccaaatgccagactcctcagcccggacacccaccctcgtcaccgccattatcgcccctcccattcatcaccgtccttctccacctccccgcccctttctcctccagatctgccgccctccctagcctcccctaccctagaatgcttcccttcagctggcccttcccatcaatcccctccacagttactcctccacgccaaacccccccaagatttgcaagatccagttgaagatccggctcccgtcagcacttgcagcttgcttcccgggacggtctctggcggccacccctcctccagctcggctgctacagcattcatggcgccgcgttccccaattgatcgttctttggctggtttggtacatccaagtacaaggcgtctttactcctctgtgctgatggatctccccatatccgctgctcagtctgagctcgatcctcatcggccagctgcaccacgaccttcttccccgtcggtatcagtgctgaaggatatcaagactctcaagagtggccgacgtctcgtcctgtcttcttagaatcctcctccttcagcgcaaaatcctccggtctcgtctctggtctctgctagtcatcaattcgccgaaagcaactgggaagaagtcagaaagaagcattggtggcgaaagtctccttcattcaatcgagccaacaaccaagagtgttctcaatccagaagagaaaatttcctgaagcacatggatggaaaatgtttccgttgtctgagcacccagcatcaagtgtctgtctgcacagagcctattcgatgttggttctgtctgaaatctggacacttagcctcctcctgcctcaagcgttcgggctataagagctcgcccactccacccgttctatccacaaaaaaattcccagctcttggtcctctacgctttcccccaaaatccttctcagcttcttcgcccatccccatggacgacctcactgcccgtcctctccttgactcggtggtcgtctcagccactggcgagattgagaggcgcagagaacgtttctctgctcgctccttagttgcctggcaagttggggctctgggtgacaaagttgagcttaatgtcttcgctgacgatgttcgttctgctttccacattagaagagctgacatccaattcaccaaattccaccccgaagatttctttgttacctgctccaaccaaagtgatcgcgatgccatcctccgccaaccaaggcttgctacggcctctggccgagtcttcctctttcgtccttgggatgaaagtctccatggtgtcccagttcgctatcgctaccgtgctcgcctctgtatcgaaggtgtgccaatgcatgcccgtactgatgaaacggcggcaaaggtgatcggtcgcaagtgttctatccactatgtggaggagtactccaggcgtggcaattacaaccgcacatatgacatgtgggtttggacagatgagccgagagccatccctcggggtggttcctttgccatcacgtctgctgacaaggaaggcctccccactgacatccccctccccgagctggagccactccgcaatcctcctccttctgagccaaagaagggctggtcctacgacgtcctcattcatgtggacaccctcgaagatcttcacgctcgcaaagcctgggcgtacaagtgggactataaagtccaggacgacggcatcaacttcagagagtacccgcttccctgcagggctgagccggacccagctcgtggcccggatgatgaagacgaagatggaaacgatccttccaggggtcggtatagaagccgctccctctgggatcggctgagcgggcgctcccacagccgaagcagagatccgaaccggcgagacacccagcgacgtgaccaagaaaggaggggcagatcgcgggacagagagcgctctgatcacagataccgaggtcatcgttcccgcgagccaagcgaggtgagacctcccctgcctgcccagactgatcctcagctccctcccctaatcccctcttctgctgctgctttccccctgcaagttgttgtcccctcttcgaaacctgggttcagatgatgatgcggcttctcccttggtctgcacttctgtcgcagccgttgaaatccttcagcctgatgaaccactcttttcgcaggggcgtgtggacatcctcgacattttggagagccatctcgacccaatgcttcatgaagcagccgtgcatcattccatctattctccagatacttcctcccctcgtgtctcttcccctgtttttgtgcctacttctacaggacatgcaggagcagacacaccttctgcgtgcaaggcaatgaagattgacagcttcatcaacggccttgcaactccagtccagccgcctctcctgccagcccccgacgtcaatgcacggaagccttcccgtgcaaaggtgaaaatccctgctttagtttcggcgcaacgacacagcgagcgtctgctttgcaagcgtcgtgctggcgcgaagcttgaaaactttgcccaagaaatcctctcaaagaaatttggtatcattgatgaatctgcttcttttgatgataacattaaaaagttgtatttacagcggtacaagaagcctctctcgccagcatcactgaagataatcgccgacttggttgaaaagggagggtgcaagacgatcgggatgaagaatttgaagaaaaatgcggcagtggcgcccctgtgactgcctccgaccggcttacagttcaagcgaagcagattttgtctccaatgattccactgccaaggccgatgtcccccgagtgtagctgccatgtctttcgatgtactctgtttcgtctgcttgttagtgatcctgaaatgtgtatctgtcacctatcggagccccgtttcggctctgtctcacccggccttttaaagcatatccacctcaatgctagctgtgtttcttccagtttacctggttgtgtttctgctatgcggagtgtgtttagatgctttttagattatgtcacaagataatgtagccctgttcaattggaatgtgagaggtatgaatgccaaggccaagcaagactctgtcaatttctgcattcaacaacatgctgcttctattgtttgtcttcaagaaaccaagattgctgttgtatctgaccaaatcattctaaactctctaggtcagcgttttgttcgtcaatatgcagctttgccagctgatggcaccaagggtggcataatccttgcctgtgatgaaaacttcttctccctctctgatgttcggctgggaaattactcaatttctgctactgtaaccatgcgagaggaaagagttcaatggtccatcacagtagtctatggaccacagattgaggccgacaaaattgccttccttgcaaaattagaagatcttcatctcgaaatgaaacctgcttggtttattgtcggagacttcaatctcatttataaagccgcggataaaaataacgaccgtctaaatagaagaatgatgcaacgttttaaaggtctcattgataaattacaagtaaaagaactgcatcttccaggtcgccgttttacctgggtgggagacggatctaacccaactcaaactaaaattgatcgtgctttttcaacctcggattgggacctgcttttccccaatttgtgcctcttcccgctgtcgtcgacttgttctgatcatgcccctattttcttcgttggaaatgaaaagcttagcaaattcccaaacttcaagtttgaatcttactggttgcatgtgcccggtttcttggacgtggtgcaaaattcttggcagaaaacgattcttgccacaaataagcttgccatttttcgtttaaagctccgtcgtttagctcgtgatcttagaagatggagccgctaccaaataggagacatcaagctgcaacttgcaattgcgtccgaagtaattcttcaactcgagattgcacaggaatctagaatcctctctgttgatgaacaaaatctcttgaccaacctcaaatcgaaattcctcggactagctgtgttaaacaagctcaagattagacagagatcgagaatgacttggctcaaagaaggggatgtaaattcgaaatttttccacattaaggcaaattccaggaaaagaaaaaatttcattcacactctacacacccctacaggtatagccatctcggcaaagacaaagaggaagaattatacaggtatttcagagaaagattgggtacaagtttcaaaggacttcaagccttaactggcgtttgctaaacctcccctcccttgatctctctgagcttgaagaagatgtttcagaagaggaactaaaagccacgatttttgctcttccccctgagaaggcgccgggcccggacggtttcatcggagcccttttcaaagttgcatggaatatcatcaaggaggacctgctggcagcgatttcttcgttcttgaaccataacacctctcagctagcagaacttaactcggcttatatttgcctcattccaaagaaagacgatgcccttggcgcagaccactttcgccccattagtctcattcatagttttgctaagatcatcgccaaaatcatggcaaacaggctagctccgcggttaaatgatttggtttctcataaccaaagtgcctttgtccgcaaaagggcgatccatgacaacttcctttatgtccaaaacatggtaaagcttttccacatatcgaaaaagcaatgtcttttcttcaaaatagacatagcaaaagccttcgacacagtaaattggccatatcttttggaggttctcaagcaatatggatttggaaatcgttggctaaattggatttccaaccttttcgcctcatcttcgtcccaggtgctgctaaacggctccccaggccgacaaatcattcacactagaggactccggcagggcgacccgctaccccgatgctttttattctagctatggaaccttttcatcaaattattagagctgcggaatctgccaacgccctaaccccgcttggtataaggaatggccgcttcagatgttctctttatgcggatgacgttgctttgttcgcaattccaaccttggacgacacgacggccctttctcagattgtgaccctctttgcgaaaatctctggcctacacacaaatgtaaacaaaactgaaatcttccctatcagctgcgaaggagtcgacctccagcatgtcattgctagttggccaggacagatcaaaaacttcccatgccactatcttggtctcccacttcattttaggaaattgaggaaagtcgactttctccctttgattaataagattggctcgagattacctggctggaaagggcgttttttcacttcagcaggacgacaaactctggtctcctccgttcttagtgccatgccgactcatcatctaactgcccttcaagctccgaaatgagtttttaaaagaattgaccgtttcaggagatcctttctttggaagggagaagaccctgatcactcgaaccctggagacagtctgataaattggcaaactgtttgtagacaaaaaagtttgggtggggctggtctcttagatttggaaagattttcgagagctcttcgcatacgttggttgtggttaaaatggaaagatgataccaaaccctgggtgggtatggatttgccctgtgatgagatagattggagactgttccaagcagccacgatcatctcggtgggcaatggcgccaaaacaagtttctggcatgacaattggctgcaaaatcaatgcctaaaagatgtgtttccaaactgttttagattagcaaaaaggaaacagagatctgtccaagtcgaattaactaacaacaaatggctgttttcgttcaggcaattcacatcaatagaagagcttcatgatctcattcagcttggaggtttactccaatcagtctcgttctcccaatttccagatgacataagctggaattggacaagttcggggtcgtatacctcaaagagtgcatatctcggtcaatttcaaggttctgttgtttacaatgatttcaactccctctggtcggctccggcggaaccaaaaatgagatttttcggttggttggtgctccatcaaaaaaccctaaccgcacagaatctactccgaagacactagccatgcaattggatttgctgcctttgcacttatgcttttgaagatacaaatcatcttttcaatgaatgcccttttatcaggcgtgtgtggcagctagtgtgcaggtttcaaactatggcgctgatggctcctctcttttcccagatatttcaacctggtgggctaatcttaatttagtgggaagcaagaggcaaagaacgacgatcagaggtatacttttgactgcatggtggaatatttggctagaacgaacagaaaaatctttcaaaactcagcttgttcagaacttgcagtagctcttcagataaagcaggacttagacctgcgtagctcggtttttaagccaccttgatttaatatttttgtaaaaaggtgtaatttcctatctccccaaacctgccatgtaatcttacctctttgctgttttcatctattaaatttccggcagatctcctgccgtcgttttcctcaaaaaaaataaaatattgatgttaatgaatctaaatagatatatatgtctagattcattaacatcaatatgaatgtgagaaatgctagaatgacttacattataaaacggagggagtattggattggttataggtgaattagagctagtagtagactatactattgaacttgctctaatagtctgctattgtaccttctctaaatgattttctttttcgtgtgagggtgtgtgtttgcaagagtaagttcccaacactcccctctcgttttccgcgtgcacgtttttcaatctgttaaatggtgtgttttttgcaaaaaatttctatacaaaagttgttaaaaaaaattatattgatccattttttaaaaaaaaattagctaatatttaattaatcacgtattaatggaccgctctattttcagtgtatgggagatggttgccaacactcacctacctcatctctagtcgttgtggcggcggcaaactccttgtaagccggtcgaatccatctgtaatggggatcgagaaatataaaccctagttctagtctcgttcttgtctcgcggcgcccttaaattttctttagatcttttgctttatcttgttataaattttgcctgtaggttccaggtaggtagccactcagctcaaatctctgaatctctcaggaatccgggagaaattggcccttgcatcctgacagagccgaagcaaagcggtcgccggcggcggtcatggacgacgaccggcgatgcccttccttgggttgcgacctcccgcgcgtcggaatcggtaacgcccggattcagtcattcagttccctgcgattctgttgacggttgctcattcgatttattctggaaattctcaggtatcggttctaggttccgcgtccgttgcgcggtatatttgtgtttcagtgctttctaggtgctcatccttcttgcatgttcatctggttgcaaattcggcacatgaaaaacaaagtaatgcagcaatgcatcagttcaggttgccacggcatacagtgggtgagaatttcttcggttaaacaatagcagtaaattacgaccaagtctaaggactgcatcatctgatttagatattttctctaagatttgggaatgcaatcttgctcatataggcatatacatatgagtagcagaatgcaccctgaagacaataaattagtgctatgggaatatgggactattctgctacacattcctctcaaaattgtaaagaaaggaaaaaatttatcatatggaatactggcgtataaaggttgaaggaactgggaggtgaattacagttacatcattattagcaaatgcagttcaaaagtaaaaggacacggttccttgtccttagatgagaatcactatctgaagcacccaaaacaacagaacaaattacaggtcccgatggataagaaagccaatgtttcaggtagtgctaccaacagctccataactaagaactatgaagagataaatgcagatgcaccaaccaagatcattgcataaggaaaaaagaaacactgcactcctacatgagtagctctggaacatgctgcattttctgcagcatttctctctcaatccagtcagcttt

SEQ ID NO: 3472 - DNA, 6433 bp, Oryza sativa
tgggtagtcgagtgtctgcttggcccattgccctctgataattaacttgtggagttctttggactttggcctgagttcctcaaagcaaagtgcctcattttcattccttgcagagataagcaagctggaaagaagctgcatgtttgacaaggtagcaaaaagctttgcacaatcactataacttatgttgtcaatccatacacgtcttaatttcaacaatttactcaggtgctcagccaagtccttgctggcttgcatggtctcaagagtttgtagttcctccatattggacagatttttgggtgcttgcattcctacgaaatactggaacgtcgactgtgtttcatcagcatatctatcggctatcaggtgccgtagcttcttgaccttagcgattccttttggtagcttctctattttggtttgcttgatgtctaaagtgtggagattagacagcttttcaactgattgtgggagtgtcttgaccttggtgctccgcaagccgatgtaacgtaagttgaacaaattccctatggattctggcacttcagtgatttctgagtcttgaagctcgagaactgtaagatagtttgattctgacaaaattgaggacagcatataagtggagggtgacattgctctcaatgatactagggttcgcagacgtggaaatttaagttttagtacatcattgttttcccatccacaagatgacagacggcgaacatccctttccatttctatcattgtgccataatcatttgaaagccaaatttctcctcttttgctatagaagtgccaggtcgcgcacaagatcatgcatcttacagctactagccctgcctagctcatcattttccacaacatccagcatattcctttggattagttccctaagatatctgtcagccacctcctctggtgtgctatgttgttttcgcactgcaaagctttctgcaacccacagccagatgagggtatctcgtgaaaacagatgatcttcagggaataggctacaatacaagaaacaatttctaagatgtccaggtaagtcacggtagcttagatttagaattgctcgtatatgatcattgttcactagctcgtctccaagttgcttgtacatttcattccaaatataactctctagtttcactgaagaaaacaagccaccaatagatacgattgcaagtggcaggccttcgcacctgtccactatattgtgagccaacttctcaagatcctgtgggcacttgctgtgcatgctgttatagaaggtctttttgcagaagagatcaaatgcatcattgtgctccaatggtttgagtttgagacggtgtgttgggtatgcaagagttgccacatcgtcctgtcttgttgtgatgattatgcgacttgtttggcagcttaggaacgcatcctctatcagagtgtatgcttcccggttccaaacgtcatccaatacaaccagaaattttctatcctttagcctttcctttattatatttttcaagtcacgagggtccaaatctgataaatttgtctgttcagggtacccaattgttggcgtcgtttcgacaacaccaatcttcctaagtaatttcctcagtagatcaaccccattatatgtctgtgacacgacaatccaagaaaaagcatcaaaattgttcttctcccgctcatactcatacacattattgaccagagcggttttgcccaatccacccataccagataccgttatcactgtgttaccttgctcactggagtacaaccattcagtcagcagcttcctgttgccttcaatccccactagataatcttgtgccaggaggcagtcttggaactgtttcctttcaatataagtaagcgggttaggaataaggtcaggctgctgcagccaccgttctttccgcttcccagcattttcaatctttttctctatctggataatctcttccgcaatatcactgaaaactgtgacatatttctttttagtgaatacctttttcatggaactttcttcttccaacataagagcatggtatgaatatttgtccattacatcctgaacatggtgggccaggccccgcacctctacaatccaacccttgacaacctcatcgatgggatgtgttgtactcatcttttttataacattgttcattgtctccagttccttctttatttcatcaacctttgtcggtagttccttcagatttgcaactttttcagatagcttggctatagcagctttggtggcttcctccactaaaactgaaccaatctttgagacagcaaggattacagcctccatgtcagctgaacaaaggtgaatatactgtattacataatgtagtaacaaactaaagtaaactagcacagcccagaggatcgattcatgtaattagcaacaagtttatgaaaagaaaaacctatgttccagtcagttttcagttcatcatgttgagcctatagtttcagttcattccctacatgcttgagttttttattttgatcccctctgttcctactctgttgcgtgagggtagtttcaacaaaaaaaaaattataaattaactcctgataaaacttttctataatgaaccataagcatgaatagaatggcactgcaagatttggcgctgtgttccttattttgtgggattttagtggctgcatcgaccaggctgcttatatggagtgcgattctatgaacatacagccaaatggcatgtggcactgttcaaaagggtccatttctttaatgtttttttcctacaggtctataagtagaaaatactagctgaaaccccgcgcattgctgcgggaatttagtatgataaaaataaaaaaaataacgtgtaagatagctagataatatcagattaagtaaattaatgtggtttatgataatttaaatttaaatagtatgtagaatggtgattcaaacgtaaaaagtaaggtggtatgactttatggaagaagaaaagtagggagatagtttagaccgtagattaattatttaaaggctaaaaacaattgatgtgatatgacttaattagaggaaaaagggagaaagataatttggaccatagattaatcatttaagcactaactaagtgaggatgaaccatataagtatagaggatatcataaaatataataaagatatatattgaaacattatgtgaatcatgttggatgataatttcacatatttgtatttgaaaaactcttaaattataaaaactataaagatatagcatgtttgcatgatgtttaaatgtgatgattgttagtggatgatgatgcgacatctttgtatgttaagcttaaagagttagtgggggataactttatattaagatagaattaggaaacgggctcaattgtgaagactccactgagaactgtttagtttacagtatctgcatcacttactgtcacggatggttttgcgtttttatgtgccatttattcacagttttcattttctttgttacgctgcgaggcctagctactacgtcccagtcttccaggcttgatggtccttggcaatcacctatgctttctttggcagatgacttattctggtgtactcaatgctttcagtcttttcatctttctacaagggaattgttttgcaagctgttctttagaaactacttatgtttcatattataagatgttttagattttgaatatattcatatatggattcatgcttgtgttttatatataactaggaaggtggcccacgtatatgcgtgagcgtttatatttgaaaggtattccctccattaaataatgtaagccataaccaccattaactctaaaaaccaagaaacaattattatcatctcattgtttgaatcatcttaataaattcagtgcatgcacccaatagaattcgagattttgagaatgaaagtgttaaaaaaatataataatttagtggagaagaggtgctagttaattgcatgcatgcatgcatgccttatattttgaaacatgtaagaaaaatagttatgccttatattttgcaatagaggaagtaagattatagtttgttcaaaaattgtcttatggatagggaactaaagatcaaacaatgtccttttaaaatgatttagggattctatttttttagaaaaaatatatctcaaaaaagcattcatcgactctttgaatagaacatagattaagtttatacgacttttgcatcaaagtaaatattaaactattgtaactaattatcatgcatatcatttgtacacatactgacataccgtgcaaatatggctacaagcaaaaattgcgagatctaagagttgaatcgcctcgtgaaggcacatgacaaacaaattaagggtaaattagaagttggatttttttttctctatatataagttcaaaaatttcatattttctccatagttctgaagaactttaaagggtgttgctgcacacaaatcacctacacaatcgctttgcttggtagtgcaaaatatcaacattgtttgaagctaatttcttttgttttcacaagtttgatggttttatttgaaacaatatttgtttgaaataagaccataattatataaatttaattagtatggatagtttacttataaattttgaagtgttttatagtgaaacttatttctatcatgtagtctgcatatataaaaaatatagttttgttcaataagttcaatacaattttcatcagaaaaattaaaaatattttaaaaccatccatgactacttaaaaaattttgtttgtctattttttaaaaaaaaattcaaataagcacatattctccttcttatcgatgtcttgtctttatcataatcaaagaaaaactccttgtacaactgacatatcatgccatcactcaatcacatacagatgtaagctgtttgtcattattctcggtccacttattacttggttgtatccttcactcacccatcatcttaaacagtcgtaagaccatattttatctaatttatctacttattagtttatataaggggtaacaactaggggtgaaaacggtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttataccgatcgtttccgtatttaccgtattctcgcggaaattaccgtttcttataatatggtaattaccgtattctaaatatgtcgatattataggacatgtctatacgtgacccacagcttatagattgactgactcttcaataaaatctctaacttttgtacatggctaaaataaagttaatttataatttatatagtataagcttgaatttatgtatatatatataacatacttatgtaaagttaaatatatgtttttatagtttaatgtttccgtatttgttaccggtttccgatctgtaccgacatgtttccgtccgtattgttccgtttctggttttccgatatttccgatatcgttttcgtttccgactttaccgtttccgattttgtttccgagaaaaatatggttacggaaatggttgaggctgtttttcgatcgtttccgaccgttttcatccctagtaacaacaacacgttgcttctccctcgtgcataagacacatggtctaattttttttcgccaaaacaagttcttagttaacacatgtaatgtaattagaatattatctgtgtaatatatatgtatatgacatagggtaatttttgttctagctttaccctgtttatatacatataaatataaattaattatatataactcgcggtgcttgactcttctctctacatcacatcttcgatttgtttttatgttattaaaaaaacaataattatccattgatgatttgatgtcttcacattgcagcgtcgtgatcacccaagctactttaggtacggtgccttgtcatgcgtgcataaggcaaatacgcgcacgtgtgttgtgctgagaaaaatagagaggtcttccgaggtttttgttttcttaacaaaagatatatatggttgtccaaaaataataggttcaccggtttaaaaaaaaatgatagacaaataaaaatatttataataagttaataatagatatatgtgtacaaatcatatgaatgttagtgattctaacaagggatggaggggccaaaacgttttataacgtgaaatagatggagtatttcactaagtctattatttgtaacaccacctgaatagaatggcttccattttacctgtcaactgttttctcacatcggtaaatgtatgaaacagtttggcatttatctttagagtaaagttgtctaatagtccctccgtttcatgttataagacattttgac

SEQ ID NO: 3473 - DNA, 6206 bp, Oryza sativa
  unsure (1)..(6206): unsure at all n locations
ttagagtagtttggctttgcccaaagtcaaaatgtcttataccctgaaacggagagagtaaatgccattaccgatggattcagaaccttatatatctataccaagctgtgttatgatatttggttttactacatacttctgcaatgccaaaaagttgtgttgtatctagcatgcatatggtttagcactggtgtagatctgttgtataggcagggtcatggttgatttgttatgagatgcacttgataatgtagtggtaaggggtgcgtggttttaatcccaaggtcccatgttcaatcccaacacgctcacaatttattcttataataaaaactagcatggtggcccacgcagattgcgcggttagcatcattatgttttctcccatataatagcatatatgttttctcattatattattcaaatatattaaaatgacaacataattttaaattttgcaataactttacaaaactagtaatacgtaatattcaaaatatattttaaaaacgtggtaggtattaaatatttttaatatccaattttaggtatttggtaaataaaaaaatttctaaaaggactttagactcggggttttaaaattttttttttttaatccggaatttttggtaaatggaatttcaaaacctcaaggttcttctccaatattatttaattttaatttcggaattttaataattccaaatggaattccaatcgggcctctaaactcatcttccaatattctttaatttttaatttcgaatttcagttacttctaaattgtattcctatagtgactttaaactcttcttcccatgtttttcttaatttcaaattttagttatttataaattgtatttttatactgactctaaactctacttttaattttattatgtttattccaaattttagttagttttaaattcctatatggactctatactcaacttctaatattccttatttttttatttcgaatttctatttttttttcttcattgaatttctatatggactctatactctacttctaatattccttatttttaattccgaatttcagtatatggactctatactctacttctaatattccttattttgaattccgaatttcagttatttcataattggatttctatatggactctatactctacttctaatattccttatttttaattccgaatttcagttatttcctaattgtatttctatatggactatatactctacttctaatattccttatttttaattccgaatttcagttatttatttcctaattgtatttctatatatggactctagtctcatcttctaatattccttattttttaattccgaatttcaactatttctaaattgtatttctatatggactctagtctcctcttctaagattccatattttttaattccgaatttcagctatttctaaattgtatttctatatggactctgttttttctttttccctaattaatgtgagaatttatagaccatgagagcaaacatggaggcttctttttctattcctttaataatataatagatgtttgcccttcaaatctcgtttatctggttgacttgttactgtttctttatttggtcctagttgtttttgtcttccttttgtaatccatattaattctgtacagccgctatagtagcactggatcttttgtaaagcaacatttcaactatatcgcanattgattggccattagaaaatttcgttgggctactcatctttcatgctttgttcttggtgaaatgattggtaatagtttccacgggccattcaatttagcttaagatgtccttgcagtagatggccaacaataagataataaatgataaaaatacgggaaacatgtaattaacacacagtatttaaggtgatgcactgcanacaacagtaatcgctaaatgttgcagttgaatcagcactgaacaaaacaacaacacaaaggttctttccccatctctgaactgaaaaactgaccgtggaacttttgcactgtcatattggtgattttatacgatgatctaatgctagctcacctgctggaagatttgtaggccgactacaaaagggaggttggagaacttgcgcccaactgttggtggttggtgtgccgaaccctgcagcatgaaggaagaaacgatgagaacacatgcaagacagctgatcaattgatcatggcgttgggcaaagggtccaagaccacacacttaaccagggttcacaattccaacaaaaaccggtcgaattccgtgaaaaaacgaggttttgacaaatttacagtaggaaagaaaagaataacgaattcaaaaaaagaaaacactttcctgggccggattctatataataggcaagttagtacttcgcccaaataacagaggagaggggatgtggtcctggcgtcctgcatctgatcgctcccaaaaaaaacatcgagcagaagggtgaggcgaggccgccgtcttcccagcggcgtcgcatctcctttgccccccaccggatccggccgtccgccgtcccccccccccccccaccggatcccgcgatcctcccccgaagccgtcgtcggagagccattttccggccggaaaattcaatgtgaaaaccctagattggtatgtgctccatttacttttgattttgttggccacttatgctagctagtgggaatttcaccaaagccgaccgattttcgcgagcttatcagtaaactaaggaaatttgttttcaaattttgattatgaaatttattcggaatctactgcattccacctgattttgcgaaaaccgtcgttccgcccgagcttgaaacggaaggtcattttagaatcgtaaaccctgcgctcaacaaacaccacatgcacgttctctacgcatgatttatgcatatgtagttagaaagttggaccccaccagcaagattaaatctcctccaaaatttgtggattttttcaaatatttgtgaatttattaaaattcatttaaattcagtcaaaatatgttaaatttcaaaataattcggtcagaaaatgccgaaatccacgattttttcaaaatttcggcaaccacaaaattttggtgcataccgaaattagaaacactgctcaggggcgagatcctgggtatggcaatctagcgatccgatctcatgatgctaggtccgttagccggctgcctcactccgtcggtcgcatccgcgcctcgctgccggccgcggcggctgcaaatctgcaactgcaaagtaatccctccgtttcaaaatatttgacacttttgactttttaccacatgtttgaccgttcgtcttattaaaataatttatgaaatatgtaaaactatatgtgtacatgaaattatatttaacaatgaatcaaatgatatgaaaagaataaataattacttaaattttttgaataagacaaatggtcaaacacatacttaaaaagtcaacggtgtcaaatattttgaaacggagggagtaacatttacgctgatggtcactgctcgtcggctgaagtgcttatctgctgcgtctgcatgtgaaaggagaaggcgatcagcaactacgtacaccagataccaccacgttcccatccttgctaattgcccaagttttgttggttttctctctcctgatttgagctcagaggttgcgcttggagccttggaccaagctgtgcgcctcgtgttgctgacctagagcaattccaactgactcttcaaaccaaaatttcgtaaacttaggaaaaagaacgtgctccaatagatttgccatccaaggctgtgtttagtttacaccaaaattaaaattttggttgaaattgaaacgatgtgacggaaaagttagaagtttgtgtgtgtagaaaagttttgatgtaatggaaaagttgaaagtttaaagaaaaacttttgaactaaatacggcgcaacttgccaagccaaataggtagccaaaagtttcacttggctggccatatctagcaagttgaaaccacatgcctaccatgggtcccaccaccccaccttctctacccatctccatccctctcaagccgcttcctccaccgcacgagtgcacgctgtcattggtcgtcgcgcctccacctcccccaccgtcgttggggagtggtgcacgcccacaatcaattaattggtcagatttatagttttacagctttgtaatttatgagctcaagagctagtaatatatttttctcaattattagttcgtccttgatattatgttgtctagaaagtacgtatcgggaaagaaaaaggtggatgatttaataaaatgactgaaagggcccaatggacaaattcttaaagtaatattagaaagtttttcttgcaattcaattgcttactggtaacaagcatttatatatatatatatatatatatatatatatagagagagagagagagagagagagagatattatttagatgtgatttgtgggccctatttttagtttcactaggccacccaaatctcaagaccgggtgcgccggcgcgcgtgggcgtgccccggcgttggagcattacgacaagcacctcgcgggcgacgcagtagggacagacggtgctcgtcacagagctgaggcgagcgagatgggtggatgaaattgcaaatcacatacacaattcaccgccaccaaagatccaaccccaaacgaacaggacaatttaccagcgactattcatgctcaaacgctaaaactaagaacgaaatctcctacgaaatcaggatcaaacccaagtgcgcgagacgaagaacaggacctaccgtcccagaagagcaagctgaaacatgcatgacatccgcctaactacaacaccatggatttgcaaacgagaacatggacgcaccttgtgaactcgatgatgagagaggaggagacgaccttgactcgactccgccggaggcccgagcggagagaggagacagaagtagaacgaagctttgctttctctcctttttatggcttttacgggtcaagtagaaccaagtcaaccatcgactctggcggccaagtcaatagctactagtgccaagtggccagtggagcacgtacgtgcagtaggattattcctcatgaccatgatggcactagtaaattaatcattgataaaaaaaaatggatcatgttgaacatgtaactatttaaaattttgaataatggtacgattaattaatttgttctctatggtaggaactctgcatattcatttattcaagagagggattataggcccaaaaataaagttacaacaatgaggtagtttttgggacacttggtgagaacaaattgagcgacaagaccataaaatcgacaccaggctattgcaaaatgatttacactctatggcaggcttagggcctgtttagggaagcttaaaattatgaaaagccttctcagaatctggaaaaagctggattttccaggttctggctttttgtttattttctagattctacaactacaacttcttagaatctaatctaaaagctggactgtttttgagcttatgattctgggtgaagctgctgtagctagaaacttccctaaacaagcccttgattggtttgtgtatagatatttgtaagattgaatcacttgaactaagtttaccagagagggtaaatggtatgattaccaaaaaccaaaacttttagcagaattaaagattaccctggtgtgtttgctccagtctgactgtgccggaacttccgaatctgaccagtgtagatcctccggtccaaccgtctagcttctatcgccgttgtctgatgccgccggttcaaccgccttagctccgatgatctgaccgccaggtagccaccattctgaccgttgtgctcttgccagctgtgtggccatcgagcccgagaaaaacacaaattaaagaactctctgaaaatatatcaaatttatatttttaattgtggtatcaaaatgcagcaacaacattcttctctcaacttttgactaaactcaaaatctaagctaaaccctaagttttctctcaacacatctcttacaaaatcaattccgagacaactcaactcctcttctatttatacctagaggtggctgcccaaaagccacaaatccaactcatgcaaatagtcctaatccactagggtatgtttgagaggagaggatt

SEQ ID NO: 3474 - DNA, 935 bp, Oryza sativa
ttcaccaatcacgcatattgttctttaacctaaggatcccgcacactactggagaagtgatctttgtcgggttagccaaaaaccacattagtcccggtttgaataggaaccgggactaaaaatcattttttgtcccggtttagaacttcaatgatttttagttccgggactaaagatcatatatttaatcccagttgtttatatcaaccgggagaaaagatcaaaaaaacgcgcgcgccagagcaatctagaaaaattgaggagaggatgcgcgcgggggaggatactcgcacggttatagagggaaaaaaaatctatctcctccttatcttcttctcctctcctctcctctcctcttcttatcttcttctcctctcctctcctctcccttccagccctctcctccccctcctcccctcctccctctctgcccgagcccggctcggccggcaccctcctccctctctgcctctccagatctatgtgatgagatgtgttgattaattttccgatctgtgcgatgtgtggagtggataattttgttgtaaattttgtagatgtttttgtgattttgtgaatgatttgtgattctgtgttgaatgtgtgattcaatatgtgttgagaatgaactatgtttatgttgttgtgaatgattttgagaatgaaactatatgttgttgtgaagatttaggatgaactatgctgtaaatgatttgggatgaatttttgtaatgatttgaatataatggggggggggcggggggcgagatatggaaaaaagaaaaaaaaaatctttgtccaaccgggaataaagatctatcttttgtcctggttatttcaaccgggactaaaggtagccatctttaatcccgaatttgccatcccggttgcatacccggcacaataagagcttcccaaccggcggcaaagatcac

SEQ ID NO: 3475 - DNA, 1536 bp, Oryza sativa
ggcacagggccggtgtcctgctgctaggggttcagtcttgcctccctgtcccggaggttccggccgtaggtgggattgggtcggtactcttgtctatggctaggatgggttggaaactatgtcacgtcttccgtctgtataccgtggtggtatgtggcacgtggttgcacgtaaggaagatgtgtcttgtgggtaaagatgtacacccctgatcagagtataatctattcgaatagccgcgccctcggttatgggcaagccgagcaatgtacccaagttagtgttttaattcttaaaacctgcttaacaactaaaaggtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtatttacaaaatagctttgagcaactaaatacctttaaatgctgtttactgcaactctaaccctttataatataaccctttgtactcccttgcatttattatgcacttgtgggtgtgtcttgttgagtacggtggttgtactcagtcttgatcaatttttcccaaacccagaagaggagccccttgaagatgaaggctttggtgtctagctcgtgcctgccgtcaagcgcctgtggtcgtcgccctagtcttccactgtttcttgtttgtctctgtgtgtgctgggccttcgctgcccgtgtaataaattaactatttacgcttccgcttgttaaactctgatttgtatcaatttttggtgtaccttgcctcctgggacaaggattaatgcacgcacgtaaggaacgcccgttgggttatttccggtcgtgacaagttggtatcagagcccccttgaccctaggacgagccgtaaatcccaagccttagcaatattttcaaaaataaaaatcctttgttatttgtgaaaactgtctagtctctctctgtcttgctgcttcatttatcgccaaaatctgacctttaaaatggagaaaatccatgaaatgccattgacaagcaccctaatccaagaaatgccattgacgaatgtaacttccaggaaatgccattgtacgagccattttgtcccaaaaatgccatcaccgtcacttttactctgttaggtgccgttaattttctcaaaatgaccaaattacccttctcaacccatgacaaattaatccccttctcttccaccgccgactactcctcttcctccccttcacttcaaccgcgcgccggccactcctcttccacttcttctcccgtctgcggcggctgtcaaggaggatcgatgccgccgccgcgcctccgctcacgtcctcacccagagtaccccggtcgccctcgccctcgagctcctaccgccgcccccaagctcctgccccagcggcttccccccttccaccaccgtgcagggcccctttcacctctctctctctctcctcgacgatgacctctaatggcgaa

SEQ ID NO: 3476 - DNA, 2657 bp, Oryza sativa
cctcgacgatgacctcgaatggcgaagccaggcagtaccggttgaggcagcctcgcggctgtcaaggaggatcgacgccggcagcgtgcgcaagtggatctggccgtcgtggcgatggttcctgtcctcctcgtcgccgatggcacccctgtgtgcatcctcacccggaccttctccgatgatctagccctcgagcttctgccgccgccgctaccagccgccggccccaagctccagccgcgtccctcggcctcccacacgagctcctcctcctctgagcagccaacacgcaggcctcaccggaagctttcttctctgtgtacaacaaaaggctgatgattttgggaatttttggggaatgctacaatactaaaaaacttgggctaaaattactggaagtagatgttatcatgaacttcatttggtgaatttttgagatttttctcatgtatagttttccaatgaaaattcaaaaatcttggtttgcatatacattatacatcgaagggcaaaatagtctttgcacagtatctaactgagtacaagtgacagagtagtgacggtgatggcatttctgggacaaaatgactcgtacgatggcatttcctggaagttgcgttcgtcgatggcatttcttggattagggtgcttgtgaatggcatttcatggattttctctttaaaatgttgtttttctttttgtttttgtttgtagatggccggcagcgtcacccgtcgtggcttggacatgactggcttcatcttggagctgcggggcatgtgcgtggtcctggggtatccacatggagtggactaccaggccaggccgctcccggagcaggagggtgacgatgcagagccccacgctgcttgggaggttactgcagtgatcctctctggctctcccgagcggacttcgctggcagtcaccgcgggtggagattctttccccgccgcttgccagaacgccgctctcctcgccatcggcacccttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccatcagatggtgcgccgtgggatggtcgagaacaacttgaagatcctggagctgcgtcaggagaacctgcagctcaagaaggacctagacgcggtggaggcgcagctgcatcagctcaagatcgcccagggagaggtctgctgccccaagcgtcgccgcgtctgccgcagccagaagatcaccgcccgcaagagcacctccaggcccgagcttgttcgtcagtccctggcgtggacctgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggctggcgcgtgtgttctttctcgtttgtcttcttgttgggttgtgtggggcatggttatgccggtgtgtggcataactgtgtcggagcctgtctttattttatttgcctaagcaacttgaactttaatgaacccatttaatagcagtaataaattcaagaattatggtagtcgtgggtggttagttttaattgttagctctctctgtttgctggtctgtgtggggttttcagatggtgatgaccaggagaaatgctgccaccggtgatggcaaccaacctgaaggcagcaaccacaaccaccagggcaacccacctccacctcctcctccgcctccaccaccaccacccgataccaacgccattctcacccaaatcctcgcccagcaggccaacatgatgacggctttcctccaccacctccaaaatccgccacaacagaatgctccaccaccacccccacaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggcccggttcaccgccgctttccggaggacccatgtgcccgccggagtcgtagcccttaagaaaagagaattccgagagttgaagcaaggcaaccgctccgtgatggagtatttgcatgagttcaacaacctggcccgttacgctccggaggatgtgcgggaagatgaggagaagcaagaaaagttcttggcgggaatggaccctgagctgtccgtccgtctagtctccggggactatccggatttccaacgtctggtggacaagagcatccgcttggaagccaagcacaaggaactggagtcgcacaagcgccgcttggcaaatttccgcaatcaacagggtgctaaccaaagggtccgctacaccaatccctatccagggggatcctcttgccagcagcaacaacagcagcagcaacctcgctccg

SEQ ID NO: 3477 - DNA, 2896 bp, Oryza sativa
cacgtgatatctgctaaaggagttgctgtggaccccgaaacggtgaccgccgtcactgattggaagccacccaagacagtcactcaagtccgcagtttcttaggtttggcaggatactaccggaggtttatcgagaacttctccaaaatcgctcgacccatgacacagttgttgaagaaagaagagaaatttgtgtggagcccgcaatgcgagaaggcgttcagaactctcaaagaaaagctggttgcctcgccagtgttaatcttgtcggatactcgtaaggacttcatagtgtattgtgacgcttcgcgccaaggattggggtgcgtgctcatgcaggacggtcatgtggtggcctatgcctcacgccagcttcggcctcatgaaggcaactaccctacccatgatttggagttagccgctgtggttcatgctctaaaaatctggcggcactatctcattgggaatcgctgcgaaatatatactgatcataagagtttgaaatacatcttcactcagtcggacctgaatcttcggcagaggagatggttagaactcatcaaggattatgatgtgggaattcattatcaccccggtaaggccaacgtggtggccgacgctctaagtcgaaagagccattgcaacactcttaacgtccgtggcattccacccgaacttaatcaacagatggaagccctgaacctaagcatagttagtcgtggattcttggctgcgttggaagccaagcctaccttgctcgatcaaatccgcgaggctcagaagaatgatccggacatgcatggactcctcaggaatatgaaacagggtaaagccgctggtttcacagaggatgaacacggaaccctatggaacggaaatcgggtatgcgttccagataacagagaacttaaacagctgatacttcaggaagctcacgaaagtccttattccatccaccctggcagtacgaagatgtacttagacttgaaggagaaatactggtgggtcagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggactcccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtcaaaatcagatcctagaagatatgcttcgcgcatgtgtcctagatttcgggaagacctaggataagagtctcccctatgccgagttctcctacaataacagctatcaagccagcatacaaatggcaccctacgaagcgttgtatgggcgcaagtgccggccaccgctattgtgggatcaagttggggaaagccaagtgttcgggactgatatcctgagagaagctgaagctaaagtcagaaccattcgggataatctaaaggtggcacggtctcggcagaaaagttatgcagataaccgtcgccgtgacctggaattcgcagtgggtgactttgtgtatcttcgggtcacgccattgcggggtgtacacaggtttcagacaaaagggaagctcgcacctcgattcgtgggtcctttccgtatcactgctcggcgcggagaagtcgcctaccagttggagctgcccgcctccttgggcaatgtgcatgatgtgttccatgtgtcgcaactcaagaaatgccttcgagtgccatccgagcaggccgactcagagcagattgaagttcgcgaagacttgacctacgtggagaggccagtgaaaatcctggacaccatggagcgcaggaccaggaaccgggtaatccgtttttgcaaggtccagagagcaaccacgccgaggaagaagctacctgggagcgtgaagacgagctgaaggcagcccatcccgatctcttcgccagtccttccgaatctcggggtcgagattccgtttaaggggggtaggtttgtcgcgtcccaaaacgactctaaaatacatcctcgaaattgtgcatagaataattaaaattcatgtgaaagcctccaacaattaaaatgtgctaagttaaaagtcaaataaggcttggaggatttttgtatatttcctaaaagcctaaaatgcgtaaataaattttagtggaattttcagagcacaaataataattaagaagaaataaacaaagttaaaatggttttataaaaagaaaaaccctaaaaaatctttttccccccccccttcccctcttgggccggctcggcccagctccctccctctctctcctctcccccgcggcccatccggccttcccccgcgcgcgcgccgctgacgggcgggcccgcccgccaccctcgctgacgggtggggcccacccgtcatcccctacctcgcgccgctcccgccgcctcgcccatgccctagcgccgccgccgccgcggattccgccgcatcccgccgtccccgcgcgcaataaagagggggaaatcactccccgtgattccctctccctttccccccacttttccctctctctctccctcggattcgtttggaatcactcccgcaaacttcgccggcgcatcaatggcggccggatcttccgcggccgaatccccctcatcagaccgctctctccccctcc

SEQ ID NO: 3478 - DNA, 11854 bp, Oryza sativa
ccggttaattaagataaagctccaatttattgagggattaaatgataattcttggagggtatctttttaattaaaaataataagtaaaaaaactgccgacagggaaacaaacttgggtggtgaggttcaattcccaaactccagttaaaaaatttgagagaaagtgtgagttctttcattagattgtatctatatctaacatactatgctgttgggaagtgcttgggtcagtaaaagaaacattattatacacaagcgatgtaatagcaattcaaaatctgcttgtttacatcaatttgagtatcgatttactgtttagtacttaactataatataaccctttgcttgtctgagacattaattttgtggaacgaatgaatttgttgtgggggggtcacaacaaaattaataaatgaatcagccaggtactgaatgataaaactagtattagataagcatgtaatatttcttggaacatggttgcatttataaaataaaaggaaaagtatattttacttccctaaattatttggctgaagcagttaatcctaagcaattttaagttcgctctattccctgaactactaaaactggctagcttaactctctcgttgctttgtcgtttttgtttgtccttacacaagatgtgttttaaactgaaattgtgtgagatgatatgctcgctcagggtcaaatttcagaacaaatttcccaatattttctagcaaagagactagttagtgatccctcctctcaacaaggcgaaattcacgaaagaaaaaggcagaattttccagcagacataatcagaaaagttaaagctgatgacagctacaaactagctagatgatacaaagcaagatccagtggaaatcaatctaacctgagctgcagacgatcagagcgtctagaagagcagagctggcgagacgatcagagcatgtgaggtttaagataggcaacgaagaaaatataaagcacaaagccactagcctcaaatctcaatcagatccttgtctgtttctctgaactagccgccgacgacttgacgcgaagtcgacgcggctaagcatttgcagtgccaattatcaactggccaagttgtgcgtgtaggacgggagtccgctgtggaagcttcctttttcctgatctcaaaatttatagtataccctccaaaccgcatgcagtgggggatgctggattctttttaaatggaccagaaactcgagaaattattgctcaatagattattttgcctatagtaaaaaggaaaagaaaaagtaaatcagaattgttcatatcgaaaggaatagaatatctgtagtccagtatgcaaattagaaaagatacagttttgattagtttactgtcctgcagccagctcactggtcaggctgttcgctgcatcttggacatatactcgctttgcccaaaatataagggattttggacggatgagatatttttttagtacaaggaatctggacatgtactagtaagtgttgcatctgtttaaaatcctttatatttaggtacgaatggagtaggaagaaacatattgttatatttgaggatggagggagtaggaagaaacataccgtgtcaccttaacagtccttgtacttatgactcagttgttgaggacctagttagctagtcggcaactgcaaaaatataattccagtctccttattctactcactaatgacagcttagagaaagctaacaaactgatttcttatgttttcatccaactaaaacggccggagacctccaagtcgtcttagtataaaaatctctcaagtcaagtttcctcgatttcttggtcgtcgtcttcgtccaccttttggtatgctcgattttttaaaaaaaattatgactctttttgtaaaacttatttcataaatagaccctccaaaaatctaattatggatatggactctactcggtgccggtgagcttggcatcgaggtttcatgcacccacgctggagaccttggcatcgagttagagggggagggggagagagtgtcgatgttgtagatcacgactatggtatttgcaaagtttggggatcattcgtaccagggtataagcgagactaaggtaaaatagacggagacaaggattttcatgtaggttcaggctccttatttaacaggtaatagccctactcctgctaattgaaaccagtgttgctcttattcatcagaatcacacaagtacaatatttgggataactctaatcatcgtcaacacggcggcatgaaccaccacacgttgtcgacaacagggtagtcctcctcctctaatatgaactgggcgatatcagagatagcgctagatccctcttgttagcctctgtggcaccagattggatctgtttaggtttatctcttatgttgatgtctggcggcatgtattgatgtatattctgactgttgcctgtctatttagactcggcttgtcttggtccgtctccccctcttcttttaggggtcttgtatttataaccatagatgtccccttatccaaatagaactagaaagataaatatggatacgatccgaatagtccttgtagtttccatatagaactctgcttctccttccttatctggaataccttccatatgcaagatttgatttcatataagacttggtatatggtgggtcccgttgagcttaacccaacactattgggtatgccttacccataaaactgacagggggtaggcgccatgcttcttggtgcggacaccgagttgtcccgagatggcatgggatggcatgagtgtacagcgagcaccaagagtctgagacaccatggaatggcacgtgtttggcaacttttttgacaagtagacaaacacgatcgagacacctaaacgccttgcggtgattgtagtgtcgccaaccacctcaatctagcaaaagctagaccaagatgggttttgataaactaaaccggctagcggagccgatttagatagaacaatagataactatccgtctcgtgggtaaacggaaggtttacgggacaaacctacaaaggatttcgcactctcgtagtgaagacagacgatttatggcacaaatcgacaaagatggatgaactagactagaactagattgaaatattgaaaaagcgatttaattggctaagttggattgtgtgtagattgtatgctcaattgaaccggccttgtcccttatataggggttgatcttgcctcctacaggtcctcctccacgtcgaactcgggatagaattcaaaggaaacccgaaatatagcctcctgagtaaggaatcctgagacatgacgaaaacagactcgggcttggactctgctggtctgaccggccacatgccgccggacagaccggccctcaagcagcggtctgaccgaccaacaaacgacggtcagaccggccctatggaggaaaccggcggttttcccaaatcttagcaattttccttaatttgaacagacaaacgatgatgatgagcatggcccacctcaaccctccctcttctccatttcaatccctgcctttttatcagttgattctatcttatttttcctctatgtagctcctaatgttactacttcctctatttcatactacaagactttctagcattgctcgcatataagatagaatatactacaagacttttttttcttaacggcaacatatcctatgcacacaggccctcacgtgtacacacgtgcacaccaactaaaaaatgtcaccaaaaaatttagaaaaaatcatacacatactttcaattgtattacacctagggttaaaatcttaacgtcaaattcattatattttagccgtaacaaaaaaaacaaaaaatctgacagttttaaggttgcaattttgtcagaattttatcttttttgttattctctatatagaatgaatttgaagatgcgactttgcacgttgatgtaatactattgaaagtacatgtatgaattttcctagaattttttgtgataatttttagttggtgtacacggtgtgtacacgcgaatatatatatatatatgtgtgtgtgtgtgtgttaatgaatctagacatatatatatgtgtttagatttattaacatctatataaatgtgagtaatgctaaaaagtcttataatataaaacagagtgagtaatattttttttctatggaaatcttgaatacccatcccgaaaatcatgtctctgtcactaatagggctagtggcatttggccaagcgttggtcgggttggtatgtgcaggagttactagcacgtgtggtggaggttttttttttctttttccttgataataatttcgtagggttataatcttttgtactttttcccagctttatcaatatgaaatttcacaccatcttatcttatgtgtgggccattttggaaaaaaaaaactgagctgcaattgtatcgctttcagtaacaccagaccacgcgatcatttttaccgtgactcggtggttgatgacctatagcttagctagttggcacaactgtagatccgattgctccatacaatccgtctgcttattctaatcactactggtagctaatggaacgtaaaacgaggaagtcattgccattttgattaattaaattttaattattttaaacttaaaaatggatttatttgatattttaaaacaacttgtatataacaagttttcacacgaaatataccatttaactgtttgaaaagcatgctaacgaaaaccaaggtaaaatctgtataatcaaagttagaacggggttagagaaaagccaataaaacggccgtggacctgaaaagtttcattagaatacacctctcaagtcagtctcctctgcatcctggtcgtcgccttcgtctacctctcgcctcgccgtcgccggaagaggagctaaccggctggagatcgattgatccaacatgagtgacaatcctccaggtatgtgcatgctacaagcttaaccaatcatccataggcgaactatttcacgtttgaataacatattttctgtaaattttcttactttgtgggtgttgttcatatgcaggctacttcgttggtcgcccattgaaccatgaagaacagcaagcttcacggccggctgaggaacagaacgctcaattccctggtaggtatacaggattaattagttttctgcatacatcaatttgcttagttttctgcatacatcaatttgccggatatgatgtagcagatcttgttataacttgaggttgataagtgctttgaaaagggttcttaattttcagtcttctatgcattcttctattacctcaggctgttttgtttgctatgtcctatgatagttttcaacttttcaaatttcaaatccttataaagattaagagaaatctttatcttctgattttccttttctactactaaggctactacaatggcaatccggtcagaccaaatgatgctaagggtgcacagaggaatgaaccgggcttctttaagaaactgtaagctgcaattcgtgtacagaatatcagatgcttctgtctgtagttacccattgatttgtttttctctttgcatgatgcattggctcattgaatctctgcagcttcgggtgcttcactggcggtcaaaatgtgaactagatcaacacggctgtattcgcaatgttaatcgacagttcatcaagaaatcagtggaattttgatggagaagttatcattttaggaaatacaagttttgtttcttccaaagtttttcttttcctgcagttacactgttgtgaattgtacaatcatatcccaagcaaatgagattattccgcgttatccattagtattttgcttacctgtttggatctatcaatttactatattgctactggtctcattaaaaggattgttttatccaagtcgtctttgtcaaggaaaaggtccacatgaatatgaaaactttgaactttctcttggatggttcagaaattttttttgactcaatcgcctattaattacaacgaacaatcatttgtcattttcaacgaaaaagaataataatgtttgcaaacgagagcagcgatcaatgagatgactttgacaattgaccgacttatttgcaactgcaagtcttcaagcaattgaaccaaactgtcatggattttaatttttcagcgtttgctttgagatgaaaatgactataaattaactggaaaagttctaagactcttcgctgacaaggattgataggtattctggtatttggcatgcttgtggtcttcattaattaatcctggttcagggtaaataaacttggacaataatcaattattatactcattcaaatcaaggcctggtttaattcctaactttttgttcaaacttccaacttttccatcacatcaaaacttttctacgcacacaaactttcaacttttccatcacatcgttccaatttcaatcaaacttctaattttgacgtgaacaaacacaccccaaattacacttagaatcttatattcgccaccagtccatactatactaatcaagtagacacctttactttcatctaatttccaagactaacagccaatgcatcaaccttatggactatcatattgaaacattttatatcatgttccttttgcaatacttatttacaaatacaatcctatgaaacttaattgtaggaatgaaccccaatctcagtcacagccaagcccaagcttaggagtgaactccaacatcttagcaccaacaagcaggtcacttagttactactccctccgtcctaaaatgtaagatttttagctatgaatttggacacgtatgtgtccagattcatagctaaaaattgctatattttgggacggaggtagtatattaatcttgcttctagcatggtgccattggtcaactccaaggatttttgtgctgagatgttagaagttttagggtccatttgtgcgatcagtttttaagggtttgttcttaaaataagtattgaaaaagaacacaaatgtgtaaaatcttcaggggctacttaaaagaaaaagctttttgcagacagtcaaaagtgatttacacaagtggccagccattatgtctacaatttaaggcctgcgaaaatcatgcatctttcacattgattgatattctgtcttcaaaagcatcatacatttatcattgatatgtaggtttatgattcatcagacctatatatcagtaataaagtcacatgcctttcaatgtagaagaggccgatctctttcacttgcagccaaactaacacggcccaaatatctgtaagacaatgaagttttccctgtcatgacaacttacaagatccagagtatctgtcctaactaaaacggttgccagtacggtgaaaataaaaaaaacaaacagtggatgatttgatattctcattgcatgccatgtttgcaatttcgtggaaagaaataacaaatagtggatgctttgatattctctatctcatgccatgtttgcaaattcctgatactctagttactgagctggtcttcgagtagtagtggtcgctggttggtgatgccacttgagcaacgacttgggttttaggtcgtcgcggccgaaaaaaatatcaatctctgcgcgaatcattggcgtaggccagcctgggagagaggaaggaagcatcttcctgtgcctctccttaccctcttcgtcttcttctccatctccttgtgtgctcagtagcttctcctcctacgaaaccaaccagctgccgccggtgaccgtcgatccgtcgaccgccgccgccatgagcagcgatgttcctggtacgtgtcactcactcacaagctttctcttctcttcttttttttttgtttgtatcaatcaatcatgctaaagcctaaaggaattcttgcttctttatatcagtctaagaatttttcggtgtgtgtgtacgtttgttgcagggtacttcgtggggcggccgatgaaccaagcggagcctgcgaaagaacagcagcagggcgccgacgagcagcggcctgctaccaacgcgcagatccctggtggtacgtccaacggtgcaaactcgatttgatgatcaaattttggccgcaaaagaatcggttttgcccgatgttttgctgaactttgcttcgttttcgttttatgtaatcgttttgggacacaaaaatgagtcgattttgtccggttggtttgctaaatttttgcttcgttttcattttttgggggggagaagactacttcgtcgggcgtccggcaaacccgcagcagccgccgtcgcaacctccgcgggcgcaggagagatcgagcttcttggccaaatggtactccaatttgttcttcgaaaatcgaacaacaattgtttagattgtattagatttcatatcgatttgtcactctgatgctttgctcttgctgatttctctgtttcgtttctgcagctgcccatgcctcgacagccgagctgagggatagacgaacaagtgcggcggcgggcgtgaccgtaaattcgatgggaaaattgaagcaaatttgcttggagtgataaggctcggatctgtgtttgtgttgcaagttttgctaatagatgtttgtaactgaaggttgcttctattcatttgtataccaattgttcattcgtatcatcagagtgcgaattcgatgaaattgtccattccaatccggcatgccttttctccttccttgaaatgaatattctgctccattgctggcaaatgtcaagaatgagtttgttgttttattcagtactgatgttgattgcatggttatcccgaatttgtttcccttttttttgtgaaaataaatccaaatctttaagttcatctttgataaaaaaaattctttctttgctagaaaatatatatattgttttagtcaattttgcaacttgcgtgcatatgtttttgccacagctctccacagtacatgtacgaagcaacttgatgaactaatattgtaccaattaagaaagcgaaaatcattcccagcaaaataaaagaaagagaactatgttcggattccagcggaaaatagtttaatagtgctagaattactccatggggattatttttgatgatttatttgacagctgaatgtgagtgttaacctaatgtttgattcccccaatcttgtctgcaggatgcgagaccacttttttttttgaatgaaatgatgagacgatttgtggctttaaaatatcgtatttgttttgttggacaacctagcaaccaatcattttctgctcacttggtagcgaattttttttacttgtttgatcagaatcatagttgtatcacatggaatttgtagttctacttagaaaaaatgcccgtgcgttgcaacgggaagaaaatatgagaaaattaaggagaagttgaaaaagatttacattatgtaattaacttaaatacaaatttcctgaaatagttgatattttttaagtaggtatgtgtttaaattaatttaaaagtaaattaagtgtggaaatacaatgatatggctggatttaatttttatgaagttctccatgattaattacgctctctagaattttcttgaaattttcagagcttagttgcgaattttaataatacaaacatcatttcagcatttatttaaaaaaatctaaataaaaaccctcctttctctttgggccattttcagcccgtttccttcctcagcccacagccagccgacccacttttctcccttctcctcccctccgcctcggcccgcaagtacgcatccggcccggcaaggcactacaagtctaatcatcctccccactcctttcccagtcacgtgggcacgtggtccggtgctacagggttgtctcctacctctgtctatattgtcgcatctgcccgacgacgcctgaatccacctcctccgtaaaatccggtcacatccttggagataatctgaaattaactgagaggttttgatacttatcttctcctctttccgttttcccaagaatcaaagcaaaaccacgtcgtataaatgtcggaagcgaaaccctagttttttttagtctaggcccatttctcttaaaaaaaaactgcgcaagcattcgcgagaggggggaggaattggaccatatggataaaaaaaagtgtgacgaaaggaaaaatacgaattttttaattagttaagatactaatgaattttaaggtaatacaatagttagtgcataattgtcaagaggcaaattatatgtatataaagaaaattatattatataaaagttgggtggtaaacgccctgagggaaaaaattcatgaaaccatccgtcccaaaataaatcaatatagggttgtatgtgatattatttagtataataaatctggatatatattatattggtttattataagacgaaatgagtagcgttgtaagtatcgagtactaatccctctcttgggtaaagggacacgcagagctaccaaacgaacatactctgtttttaatagacgatgatgtttgatttttaacacaaaactttatatatttttcttattaaaaaatttgtgcaaatacattatacttaaagtatttttagtgataaaataacccacaataaaataaattataattatgtaatctttttaataagatgaatgatctaatatgtattaaaagctaacggtgccgtctattaaaagatgatgaacgtagtatattaccattcgaatttatttaagttttgcatgctccgtatgctccaactattttcttttttttaaaaaataatcaatcatcaatgtaaaagtgccatccttgtcactaggaattctctatatacccgtagcttttaactatttgccatttttagatttgacaaataactatttgtcacccctatctcaatgacatgtgggtccacatgtgtctatgacatatagatctagtggcaaaaagttaattgccacatccaaaagtggcaaatggttaaatatctccggaaatggcgccaactgaacgtgctccactggccggtgtggatggttgacttagtcagcgcactggtagcgaactatagtagtagcgattagcgatggaatggcagcgttgacttgacaaataaaaaagtgagaaaaaccaagctgcagcttgcagccagctagctcattccgtctcttctctttagctcaccctcacacctcgcccatagagtcaaaggtcgtcgcctcctctcccatcagcgagccgctccattgcgagctcatcaaccaattaatccagatacgtgatgatccatgccttcgcttgcaaatcgatttgtgctttagttaagcggacttctgcccaacatttctttctgccccgatttagacggagattaattagttttggtggatttttttgttttttagcgtttgagcatgagaagctagtggttgttgggattgtgatccggttcggatctttggtgatgaaatcgtcatgctcgcccggccacctcggttgcctgtgcgaccaacgccgtgtcgcgtcaccggtcgcccacgacgtgttcggcgtaaggcgccaaagcgaccgggagaatatgtaggccagtagcggcggcgccggcggccggattgccgattcgtgcggtgtttggagtttggcctgcagtcgatgtgatgttattattatcgccggccgcgccggcgcggccggagtgcgttgtcgcggccaccgtgccaagatgtaccactcctgctttatttctagggccaaatcttaggaaattttcgaaagttgtaatgtcctgtgcctagatggctaagctgtgttggtttacgcaaagctcgttaggattca

SEQ ID NO: 3479 - DNA, 747 bp, Oryza sativa
tttggttttcactcaaattgctgatgaggtagtcaagatagagaaggaaatcaagcaagttgtagaactcaaggataagtggttgccgctatgcccatttgtttctcacccactcactgagatggagagacagaggtcccaagacatcttcccggaacttgtcaaagatgaagatcttgtgggtattgaggacaataggagactgctgacagaatggctatattatgatgagttggacaataaggtgataacggtgtcaggaatgggtggactgggaaaaaccaccctggtcacaaatgtttatgagcgtgaaaagacaaacttctccgctcatgcatggatggccgtgtcacaaacctacacagtcgatgctctgttgaagaagttgcttaggaaagttggttacaaaggtgaaattgacaaaatggatgtttatgatttgaaagaagaaataactcgagtactcaaagataggaaatgcttgattgtactggatgatgtctgggaccaagaagcatactttaaaatatgcgatgcattccagagcaaccaacagagtcgtgtaatcatcacaacacgaaagaatcatgttgcagctcttgcttcctcagcatgccgccttgatctccagccactggatggcaatcaggcctttgatctattctgcagacgggcattttatagcaccaaggaccatgagtgtcccagcgagcttgtggaagttgctgcatctatagtagatcgatg

SEQ ID NO: 3480 - DNA, 477 bp, Oryza sativa
aaggaaatcaaacaagttatagaactgaaggatcaggggtggcatccatcccagcttgtttctgacccgctcactgagatggaaagacagaggtcccgggacagcttcccagaacttgtgaaagatgaagatcttgtggggattgaagacaacaggagactgctgactgaatggttgtacaccgacaagctggacagtaaggtgataacagtctcaggtttgggcggactggggaaaaccaccctgttcacaaatgtgtatgaacgtgaaaagatcaacttctctgctcatgcatggatggttgtgtctcaaacctacactgtggatgctctattaaggaagctgctttggaaagttggttacacagaaccaccactgtcaagtaacattgacaaaatggatgtgtatgatttgaaagaggaaataaagcgaatgctcaaagttagaaaatgcttgatcgtacttgatgatgtctgg

SEQ ID NO: 3481 - DNA, 2391 bp, Oryza sativa
gttcgtcgtctgtcaacttaccgatggaaagacagtactgcaccaattctcaaacttctacgtcttcgaaccatagtatcactgaagcattttcatcttccattgatatgttgtcctcagttttgtctcactcaagctaccttactgttctcgagcttcaagattcagaaatcactcaagttccaccatctatagggaatttgtttaatctacgttacattggcttacggaggaccaaggttaagtcactcccagactccattgaaaagttgctgaacctccacactctggacatgaagcaaacaaagatagagaagctaccacgaggaatcactaaaatcaagaagctaagacacttgtttgctgatagatgtgttgacgagaagcagtcggagttccgatactttgtaggaatgcaggcacctaaagatctatccaacctgaaagaactacaaactctggagactgttgaagccagcaaggacttagctgagcagttgaagaaactcatacaactaaaaagtgtatggattgacaacataagctctgctgattgtgataatatttttgctacactgtcaaatatgccgctactttccagtttgcttctttctgcaaggaatgagaatgagccactttcttttgaggctctcaagccaagttccacagaactccacaggttaattgtcagagggcaatgggccaagagtacattggactacccgatattccgtagccacagtacacatctcaaatatttatccctaagttggtgtcatctcggggaagatccattggggatgcttgcgtcgaacttgtcggacctcacttatctaaaactgaacaacatgcagagtgcagcaacattagttcttcgtgcaaaggcattccccaaactaaagactcttgtcttgaggcagatgcctgatgtcaagcagataaagatcatggatggcgcccttccatgcattgaatgtttgtacattgtgttgctgccgaagctggacaaggtccctcaaggcattgagtcccttaactccctgaagaagctctccctgttgaacctgcataaagacttcaaaatccaatggaatggtaatgagatgcacaagaagatgctgcatgttgcagaaatctgtgtctagaagttgcatgctttatttaccttaaagaggctctttgtaattttgtagcacccttgaatttttcatttatttaaaaatcttgtcatttaaacattttgagtataaatttggttcttatttgattttgtgccaaataggtctcaaatcctctcttagaaatcccctcgagttgttgtcaaaaccctaggacaaaattcaaattagattcctccaaaaactccccaaaatttcaaattccaaatcctagagaaaatgtgaaaggtcaaaggtcactattcatttgggcctctttttttcctttttcttccctcagcccaactccctttcctctcctctctctccccgagcaggccggcccatggccttcccgcaccggcccagcccaccgctgtttgtcttcctcctccgaccggtcgcgcgcgcgcaccacatgttcgacgaaatgtctcgcccgagcactgagtcgtggcagtgctgcgtcgcaccgagccgccctcccatgcgccgcgcgccgtgccaggaccgcatcgcgccaaagccgcgccctgccaagccgcatatcccagtgggaatcacatcccatccctcgctccggtttctctccgggagacacggcgccgcgtcgtcccgtcgccacctcctcgtgacgccacgccgtcctatcccgggctcccgcggacgcgcgccctctccacttgtcacaccgcgccttgtcgcccgtctcctaccgggaagccgccgagcccgcgcctatctctctctctcgcgtcgcgttgccaccaccgcatgacgccgctcgcgtcccctcgctctgagaagaaccctaccgctcgattcccggccgtagccgccgtccgtcgcgcgtcaccattatcccgtcgccaaacccgctccccgcgcgtcacctcgcgttccatcgccgcttcccatgacgtcgcgccgtcaccatcgtcatcacgtcgccgcgccaccgcatcgtcatccgctcgccgtagcagctagccggctatgcccggactcgcggtgcctagccgccagatcgccgcgtcccgccaagctcacgccgccaataagaggagagccgagccccatcctcaccacgccatccccatctcttctctttctctcctctctttttgccgccgctcgagcccccgcacttgccctcccaagcggaagaagatacggcactcgtcatcgccatatcttgtcctaggtggtgccggcttaggaaagggagggtggt

SEQ ID NO: 3482 - DNA, 2288 bp, Oryza sativa
cccccccccccccccccccccgggagaaaacggaaagatggagagagagagagggggaaggagtagcggaggttgaggaggtaggtgcgggagatttgctcagcgcaaagagatgactgaggggagtgattttcgtggtagggcagcctaggaaaaaattttggtggtaggcccacctaaattagataccgctacagtaaacatttgctaatgataaattaattagacttaataaatttatctcgtagttattttgttattacactacgtttaatactttaaatgtgtgtgtccgtatatccgatgtgacaaccataacttaaaagttttctccaactaaacaatgccagttctaaaaaattttatccaaaaatatcacatcgaatttctagacgcatatatagagtattaaatatagaagaaacctaattgtgtagtttgcatggaaatcgcgagacgaatcttttgagtctaattagtccatgattagccataaattctacaataacccacatatgctaatgacggattaattaggctgaataaatttatctcacggttttcaagcgatgtatgaaattagttttttctttcgtgtacgaaaaccttttctaatatatagtgaaatgtccgttgtgacatcgaacaattttcacgaactaaacccacgctaaatcccagaaattattttaggagacggaaaagacagcgacgacttgacccagacagaaataagaaaataaaagagaaaagaaaagaagaagaaccaagctgcaggcagctggctcaagagctccgggcgggtcaaggtctcctcctctctcgtcggcgacctcccttgcgattgattcatcaggtgcgtgcatcccttcacttgcagaatccatggagcttgggagcgattagtagtagttcatgctgcagagccgtttcgccgctgagcattttttgttgactccctcgatttgctcgtgctcggcgactttagtatcacccgaagatcgcgaagaactcctccttctctcgatttcgatccgcattccgttgacggattggtacgcgagttgactttgcaaggattgatcatctccccctttgggatgaacatccagtgtccccccctttgcggcgcccgccaagtgttcgtcggaatgcgcgttcccgaccgcgagtctaggcacgctgcgcgccgacgcatccggcgaagggaggccgccacgcctccgtctggtgtggttccgcggcctgcgcgcggcgctttttttttttttttggccaaatcttgtccccggttgtgcacgatcacgaactgctttgctgactgcgttctcatcctctcttgtttgatcctgcagggttctgcacattgaccgtacagcacctgcgctccagccctgttctctggtcttccagcaggtgagcaagcatataaatcactactcagtatggcagtgtatttgttgtgtgttctgttctacggatcatttttttgttcttcatagttgttagtctaatgttccaggtaatgctgctaaacttgcttgtctaatgtatagtctttctgctcactgtcttgttgatgaaccagttattttctttgaatatgtatgaactatgttcagcccacaagttgcttcagctgaagctgtatagggtgtgtttagttcacaccaaacttccccccaactcccaactttccatcacatcacatcacatccaaaactttcctacacacataaactcccaactttttttccaaactaccaactttccctaaacttctccccaatttcaggaactaaacacatgtatgttggtgaaatgtaataaatgcatactcaaattaaagtaaacaactacatacagaatagctgtacttcatgatgtataacattatagcaatgtttcttttactgagccaagcaggagagctcttccgaaagcatagtttgtccagaaaatctcgtagccgatttccgaactccaaagtaaggtgtcaaaaaaaaaatgttccaagtcaattaataaaatataacttagcactggccttcatatatgatactgtttgccattctgatttggaatcctactctgtgcccacaagcaaatcaaataaagcttgtcatttatttgctgagttgtatcttatgagatgccattaacttctcataaaacgttttatgagatcatagatgcttgtggtaaaagaattactctatggacacggtgcatgagtaccattatttcttttctcacagtggaccattattatccaagtctgaacagtg

SEQ ID NO: 3483 - DNA, 8188 bp, Oryza sativa
ccatgttgaggacgtaatggacaagtactcatatcatgctattcaacttgaggaagaaggtttcttgaagaagtacttcgttaaaggttctcattaagtcgtggtatttagtgatattgctgaggaggtagtcaagttagagaagcaaatccagcaagttataaagcttaaagagcagtggttgcacccttcccagctcaatcccaaccagcttgctgagactggcagaccacggtctcacgacaacttcccatatcttgtcaaagatgaagatcttgtggggattgaagaccacaagagattgctggctggatggttgtactctgatgagccagatagagcagtgataacagtatctggtataggtgggttgggaaaaaccacattagtcacaaatgtttatgagcgtgaaaaggtcaactttgctgctcatgcatggattgttgtctcccagacctacaatgtggaggctctattaagaaagctccttagaaagattgggtctactgaactgtcacttgatagcttgaacaatatggatgcacatgacctgaaagaagaaattaagaaaaagattgaagatagcaaatgtttgattgtgctggatgatgtctgggacaaaaaagtgtactttcagatgcaagatgcattccagaatcttcaagcaactcgagtcatcatcacaactcgagagaatgatgttgcagcccttgctacctcaacacgccgtctcaacctccagcctttgaatggcgctgatgcatttgaactcttctgtagaagggctttctataacaagggccacaaatgccccaaggagctagagaaggttgctaattctatagtggataggtgtcatggcctaccactagcaattgtaacgataggaagccttctgtcttcaagaccagcagcagaatttgtttggaataaaatatacaaacagcttcggactgagctagcaaacaatgatcatgtccgagcaattctaaatttgagctaccatgacctatcaggagacctcagaaattgcttcttgtactgtagcttgttccctgaagactacacaatgacacgggagagccttctgaggttgtgggttgcagaaggctttgtgctaggcaaagaaaagaacacgctagaggatgtcgcagagggaaaccttatggaactgatccaccggaatatgctggaagttgtggacaatgatgagattggcagggtaaactcctgtaagatgcatgacattgtgcgtgtattggctctttctattgctaaagaggagaggtttggttcagccaatgatcttggcacaatgttgcttatggataaggaagttcgtcgcttgtcaacatgtggatggagtgatgatactgtatcaacagttaaattcatgcgccttcggaccctgatctcactttcgacaacctcattgccccttgagatgttatcctcaattttgtgtggatctagctaccttacagttcttgagctgcaagactcagagattactgaagtgccgacttctattgggaatatgtttaatctacgttacattggcttacgacgcaccaaagtcaaatcacttccggagtctattggaaagttatctaacctccacacgcttgacatcaagcaaaccaaaattgagaagctaccacgaagtattgttaagatcaagaagctaagacaccttatagccgatagatacgttgatgagaggcagtcagatttccggtactttgttggaatgcatgcccctaaagaactttccaacttgcaagagctgcagactctagaaactgtggagtctagcaaagacctggctgagcaactgaagaaattgatgcaactaagaagtgtgtggattgacaacataagttctgctgattgtgcaaatattttcgctatttctttccagcttgcttctttctgcaaaagatgaaaatgaggaactctgcttcgaggctcttaggccaaggtcaacagaactccacagactaatcatcagagggcgatgggctaagggtacacttgattgcccaatatttcacgggaacggcacaaatcttaaatatctagctctaagttggtgtcatcttggtgaagatccactagggatgctcgcttcgcatttgccgaacctcacttatttgagactgaacaacatgcatagtgcaaacattttggttctttctacagtcttttccccacctgaagacacttgtcttaaagcacatgcccaatgtgaaccagctaaagatcatggatggggcacttccatccattgaaggtttgtacgttgtgtcactctcaaagctggatatagtccctgagggcattgagtcccttcggaccctgaagaagctctggcttctgtacctgcacagggacttcaaaactcaatggcacaaaaacagaatgcatcagaagatgcagcatgttccagagattcgtgtttagaactttagatgcggctggctggtgccgtttgtagtttttttccccctctgtttgcagcaggtgtcgatttccgatgagttgcctatcattcctagcttttttgcgttcgcggtgcctctgtacattatgtgtagtttcatttactttgatattcattgtatgtaagagcacatccatttttttataagaccttatttgcatgtactgttgccaatatattaatctctctgtttggagatatatgcggtggaaatgaaatgtaacaagatagtaggaccaatgttgtcaatgctattatgcatcaatgcaagtatataatatggttaggatttaagcttctggtcatccatctatatattgtctagctctctggtcactgtgctattcacttgtgaactactatatcccctatacccagcatttttgttggaagacctcacaacttcaggcttactttatggtggttgtgctacactgcgctgggcttgttattttactgaccgtcgtagtttgttttacaaattaaattacagttatataattgtgttacttaactgtcatgtctcttagtggttttactgtttgcgacatatagattaaaaaaaaatcagtttgccaaacgccaaaaaatctaaaagcgcactatatagaaataatttcctgtacaggactcactttatattgcagacggactgtaagtggtcgcgtctgcaaaaatcacgctctattttcgtgtgcggttctttaaaatgaccgcaaggaaaaaacaatttttgcaggcaggcctcttaacagatccacacgcaataataggcttattttcgcgtgcgaacctgttaagtgacccgcacgcaaaaatagcccacccacccttttagctcccggcgccacttgatctcttcccatcctaccactcggccactccaactcccactccctctccctctccctctcatcctcccatctctcctctcactcctcccatctccctctccctctccaccctcccctgtacccactcctggcgacggcagcagcctcggctagggcggcggtggcagcggcatcggtgagagcggcggcggcggcattggcgagtgtagcggcagcatcggctagggtggtggcagcggagcggatccgccgctggccaccacggggagggtggatccgtcgcctgccaccgtggggagcgcggatccgtcgccggccaccgtggggagggtggatccatcaccggcgaccattgggatgatagcggcgggcctcgggcagggcagcgacgatgactgcggtggcggcaatggtctcccagcctcgggcgtttggatccgttgccggcgaccaagcggacgacggtgactggcctcaggcaggccagcggcggcggctggattagggttccagggcggcttttggttttttttttctgtttcgattttttattttctcgtgcgggtgacttaagtgcccgcacacacgtgtgggtgcatcacccgcacgaaaaaaatcggattttcacaggcacttcgttctagacgggcggaagatttgcacgcaaaaaccgctttcgaccgcacggaaaaatcgttattgtactaatggcagctatttgcaccaaattagattatcctaatccactatgatacaattaatatcacttgggggtgtttagatccaaggctgtaaagttttggcatgtcacatcggatattatatagggtgtcgcatggggtgtttcgggcactaataaaaaactaattacagaatccgtcattaaacaacgagataaatttattaagcctaattaatccatcattagcaaatgtttactgtagcaccacattgttaaatcatagagcaattaggcttaaaagattcgtctcgcaaattagtcgcaatctgcacaattaattatttttttagcctatatttaatacttcatacaggtgtttaaacattcgatgtgatagggtataaaatttttgtgtggaaactaaccagagccttggtatagtttctcctgtgcatgtaagcaagtaggccctgtagtcttgctaaacatcactcacttttttctatccctctgattgaagggcatctctaatgtgcatgtaaatgcgaccataagccatatgataatattcttagtacaactttatgtatagggaggtgtgtttggaagagaatattgctatggctaacttaaccttaaagctagctataaggaatataaaattactttatgtcttttcaacatgtacgttggtttgaatccttcatactataagaattaatagatattattttttctagtgagtcccaacttaaggtgaagagatgatcttaaacattgtagcattgactataagtaaaaacacatatatgtgggttccgtcttatagttgttgtttggtttaacattgaggatgcccgaaggaggaggttcctctgacatttacttcccagtgatgttgtcactaactgtggacataagggtagtactccctccgtcccattttaagtgtaaccatagttttccgcgcccaactttaatcgtctgtcttatttgaaaattttttgaaaaaatttaaaaacataagtcatgagtaaagtactatttatattttatcatctcataacaacaaaaatactaattataaaaatttctcaaataaaacggacgatcaaagttgggcgcataaacttaggatccacattccctcattgaaccactcactactatgcatagtgtgatcagcatacgctctgtggttgcctactcggctcttgtgaagagttgcacatagtaatgagcatggtggtgtcaaaccacaaatttattcgcaatggcaggatgtaggtagctaggtgtgcctaaaagttaaaaggttaagatttgcaagagaaaaacaatctattgaaaggtttattcccatattattaaaaacagtttttttattaattaaaaaacataagtggcatatcagatacagaccagcaatcgtgctgcaccgcaccaaggtacaacaaaaatatagtttctcacttagcacaaggtacaacaatgtgtttctgaatatgttacaacaattacaagcactaacaacaaagaacaacatggtgaacttcattttgaccagacagatgtccagtgatttgaattgaagaaagacaaaccttgcaaattgaccagacagatgtccagtgatttgaatcgaagaaagacaaaccttgcaaattgcaattgaagtacaaaggagcacagatattgcaacggaagcaaccaaatgtcgtcaatatatcttctcaacgttgaaatgagccgtatttgtttctgagattctagtcaacagaactagcagtaccatgtaccaacacagtaaatcagctcagagcaatgacaatccacaaacaactcttccaatgtactgcaaaatcaaaatggccgtcatgatactatatttggataaagagattttcagctaattaaggtacatatattaactaaagtgccctgcagcatgtataacttgcttcgatttccttttggcttcgcaattacagtacagttactatttttctagcaatgttgcacacatgactacaaatgaaacttttccctagtagttcttgtattaatctcaccatgaaacacaagtatacaacacttaccaatcaacaaatggtattccatataacatgacacaacgtgccttaggtgggttgtgtgtggttgaaaacatagtaagtctacttaggacttcaccactttggcatgatgccgctaggcagggaatggggaactgggattgagcaattactaagctacccttattaatactattttctgttccaaaattatggcaagatatgctacgtaataaatatttgggatcgcaacctttatctcaggctttttgaaaagcgggggactcatatttttgggctagccttatgaaagccaaacaagattttcttaggtttaggtcctttcgtattagggaaagctctcaaataaggttttgggaggataaatggttgggtaatgcctcgttgagagattaatatccttgtctctataacatagcaaggcataaacaatcgactatctcataaatctttcaaaacaatcctccaagcttttcatggagacgagatttaatcggagcaaaattagccgcatggcacaatttatggcctcgcatagctgatttggtgttggcacaggagcaagatgaatttcgatggaatctcacccccaatgggatcttttcggtcaattctcattacttagctcttgtccatacgggcatcccgaatataaatagatgtatttggaaggtaaaagtattgctcaaagtaaagattttcttttggtacttacgtcggggcataattctaaccaaggataatctagctaagcgaaagtggaaaggtaataagaaacgttgcttctgtcataaggacgaaaccatccaacatttgttcttccaatgtcatgttactcgtttggtttgatccgtgattcatatggcttataacttacaacatcctcaaaattttaatcatatgtttgggcgttggtttacatgtgttcctaaggatatgagaaatctgcttttgatgggtgcaacagctatttgttggtccatttggctaagctgaaacggggcaatttttgataataagatggtatcttctcctttgcaggttattgctttagtcaccaggtggctacgcaccaggtctatcctccacaaaccgggtcttcaggtattgtggtggtatcgcgttgtttggatcaggtggtacatgagttttttaccctagagcatgggtggcgatctagtcttcggcttgatagtcactaatttcttagttttgtgttgagagtctagttagatcctgttttgtagctgtgtgcatttcatgcagaggccaggagtgagcccagttagaagttatcgaaaaaaatgaattaatgatgggtatcaattggttaaggaggtaccttccaagtactgtaaaagatctcaatgaacaaagtttcacagttgatcagttagagagtaagagcactgcaaaaccactcctccaatatgttttctaaccgctttgtattcacacaaaccctgatttttatagtcactgatatagaaacagggttatttctcttgagaaagaagagccaaactgagcatgaaaacaggttttgaaaaaacaaaagatttgaactagtagctacttaaggtcaaagctgttttctagtcatcaatgctaggttggtggctgagtcgtccaactacttctaagacatgaaatgcttacaactttagatgcaaatagcgcgttggtgttcagttgggatatgggtgcgaaaaccttttcttaggagctgtaagatctgctaagtttttcctgggaggagtactaaagcaaggcccaactgtagcagtattggacaaaattggatagagaaatataaagaaaaaggtacacatacacataatccggctaagcatttgtttaaaaataaaagaaaacagaagccatacggattaatcatcagcgacagcataagcagcttgcaatttacatggcaagattaatttcagttgatcgtaaatgcaactattggtttaaagaaactgcaactaactagattattactctttctgatttttaaagtaaatacaagttgttttagcactctcaactcttt

SEQ ID NO: 3484 - DNA, 1487 bp, Oryza sativa
  unsure (1)..(1487): unsure at all n locations
gtcttcacctcctcgttgctgcttagatcaatgggttgaatgatatttctgtccatgagcttattgaaattctcaactgctggatcaggaaaagaacctgaaggtagtgcttctacaaatccttcagctgaccatcgcctgagtagtctttttctcctgattgaatgaccactggggaacatgccaaaatatagcaagcaggctttgagagcatggcaagatagtgtagagtactcatgaatcagcacctgtcgcattctctccaaggtgtcgtcatcctccagatgattgcatagctggttgcaagcatcttcacacttgggttctcttggccagcccatttttcgcaagaattgacctactgtaagaagggcgagtgcttgaccatcacattttttcaaaatccgtactgaatcaggctgaatgtaatcttgatattcccccgacaagcatttttcaagaacaatttttttgagtgtatcttatctagccttctaattttatatacatagccattggctgaactgcaggctttagctactgattgcactgttgtggtcaccactattctactgctgaaaccatccttcgggaaggcagattcaatagtactccacaaatcttttcgcatgtcatctattacaatgaaatacctaataacatgaaacaacaaaagggaatggacattagtaaaaatccactccgtatgaacaaataacaaccatgggccaagcaagcacagcctctgttttcactgtactgtaattgtccaatccgtaggcctcacactgaattattttactgcgttaatttagttgtctgcatagtctatagtttgttgtttgtttggaagataacatgagtatataactcatggaaactatacaccgctattacactgtaatcaactaaacacacagaaaagtagagagttccaaatctagaactgaaagccaagttaccatgacacaccggagtggagttatatgacacactgtagtatcacaatatcaggttatatggtgataaaaccaatgtaccatgatagcaatgtaaaacgcaataatacctctataaacgagcatgatgctatctctatgatagcaccctgaaactcgataataccatcgtgatacggctatacaaccattacctcacctcagcacagctaccataagcctagccacctgctttcttgagagggagacagagacggatataggactgaggactggacatatatatcttcatacatcatgatatnnnnnnnnnnnnnnnnnnncgaactcgaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3485 - DNA, 7231 bp, Oryza sativa
  unsure (1)..(7231): unsure at all n locations
cataaatcgaatcacgggtatgaaaaaatggagcagagcatgtggaacttaaatcagcctaattagaagaagaattgttgatacctcaagttggtcagctgatcagtgagatttacaataagctggtccaggtcgacaacggaggcatccgatggcgggttagataccagttgtccgattatctccctcaacaccttgctcggatcaccatgtgccgcagaaacccaggcctgtttactgaaactccggccgagaccgctgttgttgtacaactcccttgcaagtgcagtcttccccaagccgcagaacccaacaatcgatatcaccttaagcttcttcggctcggcttctttcagatgctccagaagttcttctcggggcaggtcgatgccgacgagatcagcctggaggtttctcccgtcagatgcaccggagcagcgttgctcatccgagctgacaggggaggactgatgaccgacgaccaccgtgtatctttctcgccgctctttcgcttcgtctgctctcttcctcagcttcttcatctctttggccaactgaagcttcgacgttcccgtgacggaattgatactgaaaagagaagcttgctgatcccgagttttctgatacatgatgcgatctacgcagtcctctatgtcgcgagccaggtcgcgaagctcttcgatggacagcagcagcacgcttccacggctcaccgtccgcaagagctgctcgtcaatggctccggcgatcatgcggagctccttcaacagaaattctgcgtcgcctttgaatcccttgtacagattgtacttctgatctaccagagagagcatcctcgacgcgagtattttcaacaaaccgctcaaaatagctgcctccatctgcgatttctggctactcgacgggcttatcctcctattcgatccccttgtgcatcggggttgactcgttttttttccttttagtataaaggaagctttcattaatgtcaaaacgattatattaaccactccctataattctatctgtaagttcattcataattttccgtgcacaactctgatcatccgttttatttaaaaaaataaaaaaaattaaaaacataagttacatgtactattcatgttttatatctcataataataaaaatactaattaaaaaaaattaaataagacagataatcaaaattagatgcgaaatcttatggttgcggaggagcatcaagttaatagaaccattcagaaaactcatggtctctgcataagccaagaggtccccgatctcattctcaatacctgctttttttttttcaatttctttgtaaatttgttcgcaaaaaccagatcaagcccaaaagtagagattaatcggatcgtgctatattacaatgcgcagggcatccacgacacactaacgatatttctagtaaaattataaaacctggtcataagtcacaactaaaatttatactatttgtttattatttattaataaaatcgtgatcgtgatgtagttatcatgtttactttgtgtgctagcttgatctgggaaacaaatataacttgagtatactaagctacacactgtaactcaaggtggatgccaagctggctcagctcggcttagtctggctcgttatgatatcaagcagttgatgtgaaaattcgtcgtgacacacaagggcctgagaaatttgcttaactccagtgcgggcgtgtcagtcagtttgattctataactgacaacatagataattgatgataaagaaccgatagccaaaaagccgatgtaacgatactagcatatgtcgataaggttttgaacaatctgctatatatccaatgtagattctgacacttagataaagataatggaaaaacttgaattaaccatcccattcaatttgatgataatatgatgaagtaaatgtccaatgagccaatcgatcgatattgatgcaaaatattaaatgtaggctcgacggttaaacatacatcggttggaagtctatgtaaagataactgtcgggggataaactcctcaagcgggggaccttgaggcccctccttcgttagttcggcgggggacagcgtgtgtaaatcaagaaactgataagatcgaaaaggaccgagggggttgggccctcaatcaaaagggggagacaaaagggattatacaagttctggccgctaaggagcgtaataccctactcttctgtgtgatgatttttctaagcttttgaagtctctgaatctctgatgtacaagccagagctaggagttcctactccaaattgtcctctctcccacttactggacatgaacctccttttatactccaaggggttctcacatgcactgggtgtgcaatctagttctggggggggggggggtaaatattctctatcttcaaagtgcgtcttgtgctgcagcttaaaaaacgcatgtgcatcagctgccgtgcagggcctatcaaatcatgccggctgacgcaggccgacacggggaggatccccgtcattcaccatttaatggatgtggattctggggtgttagtgcaccgggaatgtcatcccgggtatgttcaaggcagtcaagccaacgctgaatagttgagaggtgttgtacccctcatcatcgtgacgggacagggcatacctaccgcacgccacctgacacccggctagagcatgcgtggcttgcactgtctcgtctgtcagtcaaccggtcacggttcagtcaggtgcgcagcacaccgcattaaatgcggcgtggcacgcctgctccgtccacactaaatgtggttaggtgggcgctgaggggcgtccatcgaaccactctcgcacgacggtcacgtggtgaccatcccgaggggtcggggcggctaccgctcgttcatgggcccgacccctggggggaaatgccacgtggatgtcgagggaggctcctccccttcaagcacggtacccccgggcccatatcaccgacaataatgtatcgacttacactctgataaaacgtagcacaaatctataaacttagccagctttagattatcagcagtaatatagaagatcagacccaaccgagacagttctagattacgtctgatcaaataagctagataagtccatagatgtatgctaatatgatcctaatgagctataaccctggcttagcaaacttgtttgcaagctcgagcgagttcatttagcttgtgagccacggggcaagagatgaggagcgcaagatcgccgacacttaaagctagacaatgcaagagatgagctcgagctcgctggaacttggagcatggggaggagctcaacaatggaggtgtcagtctcaaggataagacatatctcctatacatgggtttgtggaataggcaataccatatatccaataatatatgagaaggtatcctttagttaaggaaatacgatgaataaggaaggaaattatcttcctagaatagaaggcctgtatcatgttctatttctccgagttctacttggagagaaagatgatgttcgctattaatacaagatcttctaggaggagaggggacacgcctacggaatacatgccaacacaaaatacaagcctagacaaactaaatccggaaccacaaaggccggcatgagggatctagagctatctacaatctctccgagttcatatttgacaaagaagattacactagccgtcgatgacgtgtggaagctccatgccaccaagctgatagagactagattaggtcaatcccaaatattatattcaggtgatactgatacataaaggcattatcggctctggccaacaggagtagagttattacctgttagttaagggccccgaaactatataaaaatccatgtctcctatatgttttacctcaatctctcatataccctggttctaacgatccccatattctacaaataccatctacgggtatagccggtgataggaagagaaaagctcaagcttgccaacacttgagtcttggtccacaggaaggctcgtgctcattgtggttcgctgcgctggggccgggcggtggcgcaggtgggtggcagcatcgggtgctgggggcgtgcgatggcgttgggccgagcgatgacgcaggtgggtggtggcattgggcgttgggggtgagcagtggtgcctagctctagggacgagcatcagtagctggagacgcagggcgacggcaccatacgctccttttggtgatgacgacaggttgagcgacgggcctataactgttggtgaagagcgacggacggcgtatggcgcaagcggtgagcggccttggcgggctagcgacttggcgagtggtgatggcgagtgggtgggtggcggcgaagttgtgcgcagaggggagacaaacacggcgcacgctcgtgcatgaagaaaggaggctatgactgctgtgaagagtgaagctagggtttttaatgctcttggccctgaaagtatgggcccgtgggttgtgggctgacttgctgagagcaagtttaatagtatagccaactactaactccaaatcttctatagccaatgtaatagtcaattcatacaatagttacttacgatactattaatacctggtcctacctatcatacacacagtacgtcttagagtccgtgctgctacagatctgtagcccgctgctcttctctctcttcctttatctctttaaaatatgtttatagctggcttatagcctgctattatacttgctgtgaggtgcagtgtggctatagcctgtgggctactctcgagttgactgattatctctaacgaggtaaaatgccaaatcggctcgttacgaaaatgaaacgagtctagccgagcttgtcacgagctgagcgagctaacgagtaataagcttttccgtccacccatatatgtaacaaatgataataccacaaccattttatgattatattaataattaagaaacatatataacttgagttgtgttttgacttttgagacaatgttttatagtttattggtcacacagggcctaacggggatgacaaacaaaaaaaaaaaaaaacgtagggcacccacaatacaccacatgcagtgatcatttgaggtattgaaccatttcaatgtcttcagcaataatgtgtatataaagtactcaccaagctggctggcgctgattaggagatccttatctagaattagttttttggagtatctatttgtaaataagttttacaaaaggactcgtaaaaatcctagcggtatggacgtcgtcgtgtcggagtcgggcacacgacatacgcactactaaaaaaaaacaactcggaaacgtacgggaaagctctaccatttctgttttcggttttttttttttggaatcgaaaattgaggatacgaaaacgtacggccggaaaccatttctgttttcgtattatttttggaaatcgaaaatcccatatatggagacggaatcgaatattatcaaatacgaattggagcgaatacgataacaatatttatcgaaaaatgaaaacaactcttactaaggttctcaaatcaacgaagaaatacaactcattattttttctaaaacaataaatcaacatttttaatttctatcatcaattaataaatagtaatatacctagttgtacacttcacttttcagaactataatgagctacattcatttgtaactatggaatggcataataaaacagaaacaaatatttattaagtaaaaaaaccagatcaagtaccgaactaaaaagaatatccccatttaaattcagagtagagaagagtaaagttaatcatgtgtgtatgaacagtaattcatctccgataccgagaaaataaaatctaaattcacttcgagaaattttccgacggattccagttccggacacgacggattccagttccggacaaatagtagccttattgtattcgttttaattccaaaaataaaaaaaaaaatccaaattcatttttaattccaaaactctctttaaaaaaatttcaaccaacactttccttttccgaaaaacgtctgaaaatcaaaaactatctaaaccattttcatgcgtacacacaacattttccaagtaattttttaattgcaccatcgatcccaaaaaatatagcagctcaatggtagtagttccgtagttgcggcggggtgagggcatattctaatgtagaactacctccgttcaaaataagtgtagtcgtgagtatctccgtatccaacgtttaacactctgttttatttaaaaaatttataaaaaaataaaaaatagtccgcgcaaagtttatgatatttatcatctnatnatataaaaataacataaaatattttcaaacgagacgaatggttaaatattagctataaacagtgtaaaactatatttattttggaactgagcgaataagttttcaagtcaacgagtgagatacctttttgcgccaaggttggaacttggaagggcctccaagatcaactcattcattgaggccattctcttgaggcttgagcgagacagagagagggggggcatggagatggaggtcccgacgagtgcttccatgggtgccatggggtcgcttctcaggaagctccatgtactactcactcccgaataccagcagctgatagagccagtgaaggacgggatcgagctcctcctacaagatctggaagccgtaaaggccgccatggtggatctgtcagagatggagactccaaccatgatggcgaggcactggatgaacgaggttcgtgacctatcttatgacattgaggactacatcgacaatacgatggactcctgctctaattcaggtgcagatttggaatcattcgactgcggccgaattggggaatttggagcttctattaaggaggcccggcaacggcacgagatctatgagcttggccgttgcacatcgagatttacctgtccccaaattccagcgccaaactggaaggggataaaccttgtcggcatggggaaatccaaggtcgagcttaccaacaagctcaccgacggttccttgcctcagctgaaagtagtatccattcttggatgtgcaggtgtgggcaagactggcttgccaaaccagtgttctgcgaacttcgagggcgattcgagtgtcgagcttttgtgcaggcctcaaggatgccagataccaaaaggcttcttcgaatgatgaactacttgc

SEQ ID NO: 3486 - DNA, 5837 bp, Oryza sativa
accgacggttccttgcctcagctgaaagtagtatccattcttggatgtgcaggtgtgggcaagactgcgcttgccaaacaagtgttctgcgaacttcgagggcgattcgagtgtcgagcttttgtgcaggtctcaaggatgccagataccaaaaggcttcttcgaagcatgctctcacaatttcgacgccataatcgactaccggctgatcgctgcacagtgcaagaccttattgacaacattcgtgatcatattcaagataagaggtatgctaagataagaggtatgctaagtttaaaagattcgtctcgcaatttacacgcaatctatgtaattagttattttttcgtttatatttaatactccatgcatgtgtccaaacattcaatatgacagggtgaaaaattttgccagcggatctaaatagggcctaataattgctaaactaagcaacaccatttttctcttatattttgtagtttagtcattgggccaccggcccaccatggcaaataaccgagttagcatgctacatagacaaaaatgctctgcgaaacatctcaaagtttaatgggttcaatatccagcctaataggtcggggattctagatggaccctttactatgttagcatgataaattttgaaattatttggcaggtatttcattgtaattgatgatttatgggaaacaacatcttgggatatcattaacagtgcttttcccaagggacaggactgtagtagaatattaatgacaacaactattgaggatgtagctctagagtgctgtgattatcaatctgacgatatctgtaagatgaagcctcttagcagagatgactctctaaacttgttcttgaacagtgcattcggctctgaacaaaattgttctgaacggttgagggaagtttcaactgaaattgtcagaaattgtggtgggctgccactaggaattatcaatatagccagacttttggcgagcgaagtggacaacttggagctatggcaccatgtgcagaaacatttattttctagtatggcaacaaatcacacttcagaagacaagctcagaaatatagtccgcctttgctacagatgtcttccctgtcgtttgaagacctgtctgcaatatcttacaatgtatccagaggggtgcataatctggaaggccgatttggtaaaacaatggactgctgaagattttatcagggaaacagaaagggaagatgccaatgcagtagcagatagctattttgatgagcttgtcagcaggggaatgatgcaacctaataacagaacctacagtgacatggtgttgtcttgtacagtccatcacatggtatttgatgttgtcaaggacatgtctgttgaagagaacttcaccactgcattagattactctcaacctattacaagacttaatttcaaggtccgtcgattgtctctccatgtcagcaataccaaatatgcaacaaaaccggtgcacatatcactgtcacaagctcggtcactcaacttctatggactagctgagtgtctgccttcgactttgcagttcaagcaacttagagttctaatacttgaattttgggatgatcaagaggagtttgatctcagaggaattttcagattgttacaactgagatacgtgcaggttacaactgatatgatcgttaagctaccagccaccgtacagagcctacaatatttggaaacactgcaactaaatgcaagagtagcgaatgttccatcggatattgttcatctcccgaaattattgcacttacgtcttcgagatgtggcaaatctgcctgacaacattggctgcatggcatctctatgcacgctagagtcattagacctcagcaataactctgaacaaaatgtgtggggtcttggagagatgacgaacctgcaagaactttatctcaactgctctacagaattgtctggccgcctgaagagaaatcttaccgctctagcttcttctctagggaaacttcgtaaactaagaactcttattctggctccttcttcaggcacgagcatgtacatggattgctcgagcatcgtttcatctccgcccctctgtcttcagagacttgagttattacctaccatttgcatcttttccagactgcccaaatggatcggacagttaaagagactccgcattctgaaaattgttgttagagaactgctatgcagtgatgttcatagcctcacaatgttacaggagctcactgttctctcattggatgtccagcaatccactgaagaaacaattgtctttaacgacaaggcattcccagttctcaagtatttcaaattcagatgtggtgtgctgcgtcttgcttttcaggcggaggcaatgccaaatctccggaagctcaagatagaattcaatgtccacaggggggaacagtatggtgatattcttaccggcattgaacacctgttgaaccttcaagagatcattggacaaattggagctgctgcgggtgcagaggaatctgacaagagagccgctgagtttgcgttaagtgatgccactaagaagcattcgaggatttctagattcaacatacgatggattaattgtgttgaagaagagtaagagcttctcctttcctccaataactgattttgagttttgaaataaattacagtcctctgggtagtagcaataagtattagaatatagaacataccaaaatttcatattaccaattggggacgtttcaacttataattactagtgcatcagctattgatatcaagttcgtttgtgtaaattaatttatttacaaagtataaattaaatacaaacaattattgaaaactggttaaacaatcacagtctagatcaatggtttgcttattgaacatataatcgtatttgctatataatatgtaagttttatttctgaagtacaattggatttatcataccgatataatacaaatatattaaaaatcataccaatctaaactataacctgtctgaaaatcaatggtgtatacatttctcttttgtttgataaatgttgtgatctctaatcctacaaaaaaatatggtgatctgtagctttcacaaagaatgtggtggattcttttcacctagttttaataatattagttccctatgaacatgttcatacaaataaactttaattctaaacttttttgtatattggtacaaatacagataaattaactattcttttaatagtaattgtaaaatctagaaaattaaattaatttaattattagatcaatagttcaaaattgggaattccaaggaaaacttagttatatgaggacacaatgcaaaaaaaaattgttatatgaaaatgtaattttttcttgttgcctctggctttaattgaatttactggtctgctagtgtcagggtttccaagatttcagatttacaaggaatatcttcaagttcaggtactctactttagtccccactatgtattttgttatataagaaaactatcacacaaataagttaatagttcatggatttaacattggtctccatctctttatcgtgttttaaagaggatacctgtgggtgtgtgtatgtggtggtacacacatgaatcttccatttaatacatgtaatcgaaaagcaagaattcatagtgattgatgtggctaacttgtctcgcgtgtctagagagaacttattaaattgctttaaaccaaaatttacttctatacaagtttagatatttataaagaaaacaaataaataaacactgtttcatattaggaaagttctttttttgtgaaaataatactaggaagttgacaacaggactattagttcaaaacccttgtaaacattttcttctttgaaagcacaaacacattttttttagcttttatatgatttctaatataatatgtagtaatataatgagaaaaatcgttgtgatccatatcattattacatgcttttttcattcactggaaccagaatattaggttttgatatgttaacatgtatttaacttactagacaaaaacctattatataggagtaaatttagcaaaactacagacactttgataaaattgtcacaaaattatatattcaggttaagtttgtcttaatctaatgatttattaccattttcctctcaaaattacatatgttagattctccctcccaagcatggttgtccttactccttacagaacttttacaatatgtagttttgatagttttgcagtaatgcagcttaaaaaatttctgtggttgttttgttaaattatttgtaattttacaaatttatagtattaaatatgatctattgggatcatatagttacaaatacgtacagttttacactgaagataagctattaatgcaatttttttagatgaagaaaagcaaaaggctaatgagccaagtgggacagatattacgattgaggacgagtcgccattttctcacgagccaaattatgatgttccacgggcatacaaggtactagttgtaacagacttgtgtgtaccagaatgcttccagaagttttcaattgaatcatttcgttttttatgtagtgaatattaattctatgttactaccatggtctataaacctattgtagactgataaactttttttttttggggggggggatttactttagactgataaacttattgtagatgtaaggaattaacacgttctcgaaatacagagaatgcttcccgaatccaaataacacttaatccaagctaaataaaatatttgactctgaataaatttatagaaccattactgcaaagctgtcaacacctgacggatggtatatgtttataggtggcaaaagtaataacagataaatcccatttcagtatccgctaatctcttggctgaattccgcttagatatatcgctacaatgccctggcataataagttttcaggttctgtgggcatttgcaaattttccgctaattctaaatattttgtaacaatgccatttgaatgatattcgtggtgatatttttgtaaatttgctagtggtaagtttgcaataatgattcaaaacagtggtaaatttgcaattgctcatgtgggatattttcagttcctcaccttaatcatcaacgcctcaacagctatggtgaagtaaatttacatttatgtatgcccagaaataaacacagtaaattgataaacagaatacacgttattgtcacctcggatgtgctttatttctgaagcaataatgatagtgcataagggtgtagtggcatctgtgacaattaatttaataagataacatgttgttcgtcattcataagatatcaagccgattttctgattaatgcaaacgtaaagatagcaacagtatacatttgtaataattgtaatgaaattaagctccttagatttcattatggaacaaaaaaaaagaacacatcattaccttttcagttttcactttgcctcattttatttaccgtgaaagcctaccataagagaagttgaataaattatgtccttttcctaccatggcaggggatcatgaatgattttacgaattttatgttctatttgcaaaaacagaagctgtatatgttgcaatgatgcacatttttactagttagtaccaatgacttcattcacaggcagagatagaaagcgaagaagttcctcacgcggaattagcagatgcctctcgcacaagcgattcaatcgacaatcgtcgacggcaacgccggtcaatcgagccttctttctcccgcgatcgcctcagccagccgaggaagcactcggtcgcgtccgccgtgccaaagttcggcgagtg

SEQ ID NO: 3487 - DNA, 1172 bp, Oryza sativa
atcatggcgaacatgattgaagcactcgggtttggagtaatctagttcgagagaagattatctttccgactgtgaaggtctcaggggctactgtggagattatgggtaccccatacccacacggcatggttatccgactagttataggggataacttatatatatgaaatatgtaacacatcatgacttgggtattacgtttccctgtatattatggaacggcctaaagtcctgctttgataagattgtaaagtagatttaggaaaccgataccgtagtggttaaggtttctatcttgtaatcctgccccccgtcctatataaagtgggcaggaagccctctagggggcatgagcacatatgatcgttagatctatactacacccgacggattcaaatccccaaacaggagtagggtattacctctcattgagagggcctgaacctgtctaaatcctttgtctccacatccatccacttttaggtctcgtgcgctaccccgttttattattgccgaattcatgtttcgacagtgttgtttggtgttctttttacgcttggttaatttcttggaggtaaacttggagctcatctccgtgaacttgcagcggcggtccatggtggcgcggtcgactgggagaagggagcgtcgatgcatccgggcgagggcaattgtgtgattttactctttgggctgggataccctaggcagttgcattgtgggctgtgtagccttaactgttgctcgccctaactcaagctacacaaaggaggtcacgtgcactgtggcatgggaggccttggaccgaattgaataatgctacacatacgactacctcgtccgaccgaggcgtacaacgatgcatctccaccgtagattaatatgtacccatggccctatgccctgatggtagtacggggtgcattggatgtatgagtcagaatggagtcgtacactaaggtcgtatgtatagcacgattggaccgaattttgagtttcaaaagggccagagacactcatagagtagcttgcactgtgagtgtccttagcttggggataagccaggatagcgtggaggataagatcggcagctggtacactcgatggctgcctatacggcctaaattagggaggctgacgtggctaagtctttccttcctcattgcacttat

SEQ ID NO: 3488 - DNA, 6215 bp, Oryza sativa
gcgcaacgcggtgcgttgacggacacgccaggcacggcgcacgggcaagggaggtcgcgcgtggctcagtagcgacctggaaagagcggcgctgggtcgggaagggttcggtttgggctagacgcagatcaaacggttggtggacgatggatagagcgcccataaaaagaaaaagaaaataacgaaagggaataaaaggaaaaagagggagagggaggggctaaactgcaaaagtgaatgggagtggaattgagatgtagctctctatacgtttcggtatggggaattcaaatattttatttaaatatttgtttatttgattattcatcatttcccaaataaaactggctttacattatatcatcccaaattcatcctatatattttggatttgagaattcaaatatttaaatttgcatgtttatttatttattcatatctctacctaatgattgtagtctatattggattattccaaaattaacttaaataattgggggctttgatagtcctaaaattaattaaaatattctaatgggtccattattaatacaatagcacatcggttgaacttatttgtataacaaggtattttacatggacatgtttcatctattattccataaaatcaaattgagacttggtacaatattgatcgaaatgtttaattatacactcacataaacgtattttatatataaagcttaattcatttacatgaccaattattttatgttagtaaattttattccatgagagactcgatgaaagttctaaatattaatttaattattctagtggaacactcctatatatagagagtcattgtagtggcgactatttcatggttacttagatgtcatgacacttgtcacatggttccaatatttaatatttgacctataaattaaattagtaattaaccttctctttgtatggctttgttgtgttgtgcgtaaatatttatagggttcataatgaatatcttatttttataattattaattagttgtatagctttagcttaatattcaattgtaacaatttatagtttggcaagcaataataatcataacatccagcatgatgcaaaagttttaaaaagtttgaaattttagtgattttttattgtcagtaattttcaggatgttacacaaggcatatcaacaatattggctagaaagaattcaaagatatcagtatgaagaagatttggccaatagaattgcaaagttaatagaggagcagtttggacttaagcccaaggaacaaacttctgtgtatcggctgccatatcttgattgatttgatagagttacgttaccacaccaatacaaggttccagacttctccaaattttcaggacaaggtggtatatatacaatggaacacatcagccgattcctagcacaatgtggggaagcatcgactgaggaagctctaaaagttagattgtttccactgtctttgactagatcggccttcacatgtatttcttctttaccatcaaactctatcaaagattgggccgatctggaaaagcagtttcattcaaacttttttgctggcatcggtgagttgaagctctcagacttagtatccattcagcagcaagaaggagaatcagctatggaatatattaagagatttcgtaatgtccgtagtcgatgttatagtttgagtctaagcgatgagcagctggcagatcttgcattccaagggctatctacacctatcagagacagattcttttgccacgagtttgatagcctagctcatctaatgcagacagtatcggctcatgaaagccgattggaagaagcaaaggaagatcaattttcaagtcatcaagatcagaaagaagataattttgaagcatgagttctcatacaccaaaattggacggcatgtgttaacagtaaaatttggtaagaccctaagagaattatcacgtcgccaatagtcagattcctgctatattcggttaaggaaattaatctgttaaaggaagcttatccagtagtgaccgagttcaaggagaatgcggcatggcatgttatctattaattaggcattatttattagttttcttttatctttagaaaagtgtgtttggtgtcccatcaggactttatgttttccttttatgttttaggagagtttctttcttgtcctaaaaggactaatatctccccatgggtataaatatgtacacccggggttattgtaaaatatctccacgatcaatacaattcggcgcatcgccaccttttaccttttctacattattttatctttcggtgggatttggcacctgacgcggggctgtattggctttcgatctccggcgaaggggtaagtccaatgttccgctggcctaggcaattgtatcgtttacattggcctcgttcaaggctgcatcagtacattcgacctcttggattgctccggtttggatggtatatttgcctacatatttatcatatgtctctattaatctagtcttagcgtatcaatttagctctatcggttgcttctcgttttagggtttctgccggtatcggctaaatcgtattgctagattagattagcttagacatctaccaccctgaaaactcagtcattggcttgattgtctagatattacgtttcttttaatacttagtgctgcatcagttaagtttgatctactaagtcatgcttagaaacataatctctagcctgctttttgactataaataagggtttcatcggggtttcagccgatgagttatttggatgttgcatcggcttacaaggattgcatacaagttggatttagccgatagcaaaaaagatttcattgtttaatataatcttatggattttatgacgtcggacctccagccaatgtatgctttaaccttcggatcaatgcttattctattatatcatattgctagacgattggtttatactagattatattattgttatattatattatcatcagccgattgcctttatatcattatttactcaagtatcagaatctacattgggcatatattcgatagctcaaaactctatcgctatcggctggtatcagcatcggctggaattactccatcagcttgttagccgatcggctcattgatcttcaatttacatatcttgtcagttgcagggtcaaactgactgacatgcccgcatctcaccaacctttggtcctgcactggagctaagcaaatttcacatgccagtgtgtttttcgcgtcaacagaccctagtaaccattgttccccaccattcctgattttattattcatggtaattaataatctcttaattaactacgtagtaattagaatgaaaaaaattggaaattgggaaggatacaatgagaaaggacgtgcaaaccatggacgctattgcgtatagcatctaggcctggccacaattaagaacaacgtccacattctgaaccgcaaatcactgatcgatagtctggtttagcctgaccgcttgattgctccttatggtttagtcactttagattgattcaaaatcatgtcaactttattttttccatcagaaaatctttccaaaaaaactgttcaaataataaacttcatttgtcaaattagcacaattttcacaattgatcaacacccttatttttgcgacatctggagcaagaaaacacttcatcaaatttcacaatattttttccatgtactcaatatgacctaaggcatcttttagcttcatcttgtttagtaagcatgttgagcaattcaaaacatcatattgttcatttcactttttggcacaaatcatgtcaaacattgaactagcataaaaaacagtttgatatttttttcaataaaattttagttaaaaacaactcatccaaagtgtgtgtgcatgtcaactccaagagcgagagaagattttattctcaaatcatgtgtagcattatgtcacggccagaaattcaagaactagaatttccatgctggatgtgccttaaacccctatctaggaccaaccagggtacacaaacgacaatgttgacatacagatccacgtcttacaaatatataaaacattacaaatgcaacagaaagataaaaacgagccaaacttgaaagtttgactcctgcagcgaggcgaccccactccacaggtatccttgacggcagcgacgaaaccaacttctccgagaaagctccaactaggaaggacttcagctctggtgtggggaagagagagcaagactgagtactacccactgtactcaacaagtcataccggaagagaaggtatgatgcaggatatatcccagggaggctaaaggttcatttgcataaagcaggcatttaaaagcagaagttgaaagcagtaaaaatgttgtagtaaattaagcaatattaatcatcactgtccaatgctacaccatggtgcaacaaacccaaccaaccacttgaactacaccagttcattaagccaattattaaggatgagactaatcacgggggaatttgggttgatcgcccataaccacgggcacggctattcgaatagttttactctggccagaggtgtataactgtacccacaagacacgattccacatatgtcgccatgccccaaagtaccaccatggtactgctaatggggaaatcatgaaaatacccttcgcataaccctcccctaaccattcacaccacgctaaggtttcacccccactcctaacccggagtgggtagtcccctcgtgcgccgcggtgaatccggcagctggacaactggacaccccggctgacccaactccatcacgcccaccctcgccactggtgcttaggaaagggtcgagctatactacaagtcaagcaattagccactcccgcttgtggtaagcacggtaagtctttcagggtttcctgtgaaccggtccttaattaacatgggtgcgaccagcaaaaccatgtacccacagcccaccattcaatagcattttaattggataattatgaccaatgaaacatggctggatgtctcgagcacgtagctcgccataatgctaagtgtctaataatgtaattatcccatcatgtgaagtagtggatataagcatggctaagcatttcctaaaccaacatctagtcaaattaatacccaagttatcaatggtataagggaaacaagatatggctgagtaataggaaccatcccagatgacattgtaaaataatgcaatatttaatagaaaatgggacatttgtaaattgggcacaatatgatcaattgtatgatgtgccttgctcttgcgctgttgagacctctgcaacgtcttcaatgcaccacggagtgacgaaacggccgaaactatgtgacaaacaaagcacacaagcaaaacatgctataagtctactgaaacaggaaacaaaaccatttttaataaattctagggatttttatgaatttactaagacttaaatggacttaaacggagatcggatgaattagttatgatttttaaaagattctctgtgtttttactataaacagaaaagccttaatgatttattgcgcaataaacctaggcgaggatgacgtcagcaagggggggaggtgcggcgccggcaagcgggccccgcatatcagcggctcaagggggagggagtggcggttgactggtgggccccactgggcagcgacacaagaggggccggtccaccgtggaccaagtccacagggccgcgggtggtgcgccacatggtaccgacgtggcaccacgcgtgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggaactcctcttctggacttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtaa

SEQ ID NO: 3489 - DNA, 1147 bp, Oryza sativa
gtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttggggacttttgaatagagggagcggtgtgaatccaattccacaataaaccaacaattccagagtgtccaggtgatatgaatatttcccaaagtctatagttataaaaccacctaatgttgcctaattaacttgcgaagcatctacctaaaattatactagtggtactatgagtagagtgtccactagttggggttttgtttgttctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgtcttcccaaacgtcggcttcgacttccacgaagagcggatcttccgaagctgcagcgtctacacgaccaacggaaaagaaaaggcttaaactctaacaaattccacataacagcagaaacaaagcacaaaaatgggttcttgacttcttaaggaaaaaattagagacttgaacggtccaattccgagttcaaatggccaagttatggccatttgaagtttatatgctctttaaatggatatttacgaatttcttcatttaaattttaatttaaaatcgaattattgcgtcagccgggagagagggcgcgcggaccgggtccacgggagtggggcccacgcgtcagcctctcggtccacggtggaccgggagcacgcggctggcggcggccggcgccgtgggtcccacgcgtcagccgcacccgcgggcgcgggcggctgacggccgggcccacctggcagccgcgagagcgcgcccgaaggcggcctcgccggcacggccgacgggagaggacgcgcccgcgcccc

SEQ ID NO: 3490 - DNA, 25535 bp, Oryza sativa
tgcaagtagctcatgcacttttagggtttttctttttataaaccttttcaactttgtttatttcttttcaattattatttgggctctggaaattccactaaaatttatttacacattttaagcttttaggaaatatacaaaaatcctccaagcctcatttgacttttatctttgcacattttaattgttggaggctttcacatgaattttaattattctttgcacaatttcgaggatgaattttagagtcgatttgggacgcgacaaacctaccccccttaaacggaatctcgaccccgagattcggaagaactggcgaagagatcgggatgggctgccttcagctcgtcttcacgctcccaagtagcttcttcttctgcgtggttgctccactggaccttgcaaaaacggattacccggttcctggtcctgcgttccatggtgtccaggattttcactggcctctccacgtaggtcaaatcttcgcgaacttcaatctgctctgagtcggcctgctcggatggcactcgaagacatttcttgagttgcgacacatgaaacacatcatgcacgttgcccaaggaggcgggcagctccaactggtaagcgacttctccgcgccgagcattgatacggaaaggacccacataccgaggtgcaagcttccctttcgtctgaaacctgtgtacacctcgcaatggcgtgacccgaaggtatacaaaatcgcccactgcgaattccaggtcacggcgacggttatctgcataacttttctgccgggactgtgccacctttagattatcccgaatgattctgactttagcttcagcttctctcaggatatcagtcccgaacacttggctttctccaacttggtcccacaagagcggtgtccggcatttgcgcccgtacaacgcttcataaggtgccatttgtatgctggcttgatagctgttattgtaggagaactcggcataggggagactcttatcccaggtcttcccgaaatctaggacacatgcgcggagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatacgattttcttgggaacgccatggagactcacgatcctagcgaagtagagctccgctagcttgttccctccataggtggtcttcacaggaatgaatcgagccaccttggttaatcgatccacaactacccatatagaatcatatccgccttgggtttttggaagtccggtgatgaaatccatcccaatttcatcccatttccattctggcacttggagaggttggaggagtccggccggtcgttggtgttctgccttgacacgctggcacacatcacacagagccacgaactctgcaatttcccgcttcatgctaacccaccagtatttctccttcaagtctaagtacatcttcgtactgccagggtggattgaataaggactttcgtgagcttccagtagtatcaactgtttaagttctctgctatctggaacgcatacccgatttccgttccatagggttccgtgttcatcctccgtgaaaccagcggctttaccctgtttcatattcttgaggagtccatgcatgtccggatcattcttctgagcctcgcggatttgatcgagcaagataggcttggcttctaacgcagccacgaatccacgaccaactatgcttaggttcagggcttccatctgttgattaagttcgggtggaatgccacggacgttaagagtgttgcaatggctctttcgacttagagcgtcggcaaccacgttggccttaccaggatgatagtgaattcccacatcatagtctttgatgagttctaaccatctcctttgccgaagattcagatccgactgggtgaagatgtatttcaaactcttatgatcggtatatatttcacagcgattcccaatgagatagtgccgccagatttttagagcatgaaccaccgcggctaactccaagtcatgtgtagggtagttgccttcatgaggtcgtagctgacgtgaggcataggctaccacatgaccgtcctgcatgagcacgcaccccaatccttggcgtgaagcgtcacaatacaccatgaagtcttgcgagtatccggcaagattaacactggcgaggaaaccagcttttccttgagagtttgaaacgcattctcgcattgcgggctccacacaaatttctcttctttcttcaacaactgtgtcatgggtcgagcgattttggagaagttctcgatgaatctccgatagtatccttccaaacctaagaaactgcggacttgagtgactgtcttgggtggcttccaatcagtgacggcggtcaccgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgggagtatatcagaatgtcatcaatgaaaaccacaacaaacttatccaagtattccatgaacactttgttcattaagttcatgaagaaggcaggtgcattggttaaaccgaacgacatcaccgtgaattcatacagtccgtatcgcgtggtgaatgcggtcttcggaatatcttcttcacgaatacgtaattggtgatatccggaacgaagatcgatcttggagaatacagtggcacctttaagctgatcgaacagatcatcgatccggggaagagggtacttgtttttgatggtaacttcattgagagctctgtagtcgacgcacatcctcttcgtcttgtctttcttctctacaaaaatcacaggagcaccccatggggaagtactcggacgtatataccctttttctttcaactcttccaactgtttcttgacttcggccagttcattggctgccatacggtagggtcgcttgtgcagaggagtggttcctggagcaagatctattcggaactcaatctctcgcttgggcggcataccgggtagttcttccggaaacacctctccgaactccctgacgatgggaatttctgacagtactatctgatgcagttctgaacttctgacagaggttggggtgcgaagaaaacaaccggttgttccggtcctcggtacagagtgacggtgcgtctcgcgcaatccactactccttgaaattgagccaaccaattcatcccaagaatcacatccaagttcttggtgtctagtagaatcagatccgagggaaaaggaatcccctgaatttctataggaacggcagggctataatactttgctatcataacccctccaggggtggtgatgagcagagggtttctaagcctttctacccccaactgatttttccccacgaatggcacagatataaacgagtgggaagctccagagtcgaacaaaatagtagcagggatggaatgaatgaggaacgtaccaacgatgacgtccggagttgtcagcacgtcctcggccgtcacgtggttcacacgaccccgaatgacatccttcccgccgttgttggggcggggaggcgcttgaccttgctgacgccttggcttcgggcatttatccgcaaagtgcccgggctcgaagcagttgaagcacagacgctgctgaccttgagcgtccctgcggccttgaccaggctgcacagttggcgtaggaggacggggcgcacgagtcccttgctgattctgctgctgctgcgcctgtggtcgtcgccctagtcttccgctgtttctcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaacgcggccggccatgcgggccacggatggacggccatgatctgccgaggggcagattgggcagctggggacgggcggcgccaaggccggcccggacatggcgcacggcggcggccggcgaccggccggcggcgcagcgcgatagcgcgcatgctgagaggggtggaacacacgggagaggaaaggagaggagagaaaagagggttctcaccgtgggttggccagtgcgggaagaggcgacggcgagcggcggacggcggggcgagcggttggatgacatccagagtgacctaggggagcaaaggagaggatttagagggagagaggagatccgcggtgagcggcaatgccagccgaaggcgggggaaatggaggcctcaccggcggcgcgagggaataggggctccgatggtagttggcggcaaccgagcggcggccgaggtggccccacgtggcggcgaagctaacggcggtggtggtgtctgtcacaccctgaaaatcataaatatataaattgttgtttaaatggaatttttagaaataattttaaaagtcttaaagagaagatctagttttaattaataaattccaatataaaaaggggccagataaaatttcattaaatactttgcttaattctataattcctagatttttctgggatttatttgagctaagaaagtatttttaataaatggaattgcatttaagaaataatttaaattgaaaaaggttttaaaaagtcttcttttggctttgggccgaaagtcggcccaaaagccttctctctctcctcggcccagccggcccagtccgcagccgcgcgcgcgcgcgttcggtcgctgacaggtgggtcccacctgtcaggtccttcgtcctccttcggccgccgccgcccgaaaccctagtttcgcgccgccgccgtctccttccaaatccggccgttcctttccttctccggccgaattgatagaggggaaatgatctccgggatctcctctaccttttctcctttggaatcatcggctaaatcgttttggaaagagttggattcgagttcgtctcggattcgttcttctcgatctttccttcctcgtcgccggccgccgtgggcctttgccgtcgcctccgagcccctttaaaaagacccccggtgtctcctctacccgtcgccaccctcgccttcgcctctcgtcgccggaatcgctctagcaccatgtgccctagcttcgccgtcgccgccgccgctccagccgtgcgccgccgtcgctccagccgtcgccgtcgctcgggaaggacgtcatcgtggtcgccgtcgcgtcgccgtcctcgtccgccccttcgccgtcgccggagatcaccggagcttcgtcgccgtcgacaacccgaaggtttccgctgtttcctcctcgtcgccgtcgtcgtccgttgttcttccgccgccgttttggtcaccggtgtgttcgccgcgtcgtcctctacgtgctggtgccctccgtttgcgtcctcgcgccgccgttcgccggcgagcgtgcgccgcccgagccgtctgctccgccgagccgccgccgctgtcggtgacgtcaccgctgacgtcatcggggtcgtccgccgtgagccggtcgtggaccgttcgatctcggccgtccgttttggattggttcgatctcggccgtccactcgcgtgaaccgccgcccgtgcccccggtccaccaaaaccctagccgctgacgcaataaacctccttttccttttcaaaaataattcattattgcgtcataattcaattttaaccgatttaagtgttttaatccgatttaatctttaaaaattcgtaactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgattgtcattgggtggaattaacctattctttgttatagcccttttgttcttgattactttattccttgataccttgggttataataatttgactggttgaactttatttatattggttcaactagatattagatataattgcttagccctgcttagaaacattagcacatttatgggataactaatgattcactattatttcatgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgtgaggggtattgtcacaactcctttccgaggtaccgtggtggtattgaggcacatggtgacatgatgtggggttgtgtcttgtgggtacagtggtacacctctgatcagagtaaaactatgagaaaattccctatctagcatcaaaaaaagttgctcttccctctatagcacctaaacttaaaaagttccctatctaggcacttctaaaatttcccttccctatgtagcacttctgttagtttttatacttgacggtgttaactagcgggagaaaagacggttttgcccttctttagttttcagacttgcctgtacatgatgttcgttattaattacttaagttaattaatgacaagtgaacccacaggaggataattattattatttttcaaaagagtggattgacatgttatatttgcagtgctacgttaaatcaagagaaagcacgtctaaaataccaacgatcatgtacgggcaagtctgaaaactaaagaagggcaaaaccgtcttttctcccgctagttaacaccgtcaagtataaaaactaacggaagtgctacatagggaaggaaaattttagaagtgactatattgggaacttttgaagtttgggtgctatagagggaagagcaacttttttttatgctagatagggaattttctctaaaactattcgaatagccgtgcccgcggttatgggcgggtcgaacaatgtctttcgtgattagtcccacacctctcatcatagtaataaatgctttaattggtaataatttgattagctcctggtttggaatggaatattcctggtttggagatagaactgtgcagccgggatggttgttcagaatggttgggcctatacaacagggtatgttgtatagtgttggattaatattgtttaattattactcaactgttttattaaattctcaaatgtttgctaaatgctgtttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtactcttggtcaagctgcctgtggagtggagccgtctgcgccgtttattttttttccgctgcttagatctttattgaataagaggaactatctacctctataatgacattttattcgcttattaattagagtaataattgtactctattatcaatttgttattgtgtgcctcggctgattcctggacgagggttcacacacatgtaagcgtttggaattttggatagaaattccgggcgtgacagtgtcaacactttcaaagatatttgagccttggaggcgaaatcacaacactttcagaagagataactaaactgaaacgtttggagacacctgatgtggagattatggataccccatatctacatggcagttatagttaggttggatatagggtaccgaatatagataaaatatctttataggaactcgggtttgtttcttaacttgtatgtcaagaaagtacccggggtcttagttggttacgattgtattttatctgtaacctcatgttccgttagggatatggactatattttgttatacggaccccttctcctatataaggaggggtccgggtccttcttgagacacgatttcctccaagatcatataatcaataacacactcggcggattcatccccggacagaagtagggtattacttcttgaataagaaggcctgaacctgtataaaattccttgtctccaaacccatccacttttctaccttgatagccacccccttttagtattgccgaaatcttgtttcgacagttggcgcgccaggtaggggttgcgtcaagtttttcgccgatcagtgcgatgggttccgtctctggcatcgacgacttcgtcttccctcccggacaggcgtttcggttcggcagcctcgacttcatcaccaacaacttcggcaagatctctttcctcgactcggattcgaaccagtcgggaaagaaccaggtctcagccccgttcggaattccaaactcggccaagatctaccccaagtacatctcgatcgagtcggcttcaaaccactcggacgagatcccatcttctccaacaccaccagatcaagacgatggggcctacccaccgatcctgatgaaactccccgacgatttggcggccgttttcaccacaacggcgtcttctccccgtaggcctaggcggaagtcggctttaacaccgatcccgcctagctccagggaagtcggcgtcatactccagccactcggcacagtttcaacggatcaattggaaggctacttcagctcccccggcgtcgactcgcgtccaactgagatcgtggagtacgacgaattcggctaccgccacgacaaccacgacctagacgacttcgacgaaagcttggaagacaactatacccctctctacttcggcgtcttcatggccgacaacgagacggaagaacaacgccaagcccgagaagccgaagcacgacgcgtacagcaagaagccgagcgacgccgactggaagaggagcgtcaagtacaagaacaagaacggctgcggtgtgagcaacaagaacgcgagcgggctgcaaaggaggccgaagaccgacaacagcgagccttggatgcatggcgacgagcacaagatctcattggccagcaaaacgttgaggggacaccggtcttccgcaccccacaacagaacgctatcgccgcgatcacccttctcgacacccttcttaaggaaaacgaactcaatcaatccgatcacgtcgtcaacatcttaaaccagaccaagaccatgatcgcagctacgatcccggttaactccgaaagcgtccgcacgccgactggcagccgggttccccatcttcgatctcaggattaccaccagccaagcctcagcatcgccggcgcaggatccaatcgcaggagcaggggccacaacgagcgatctgttcactcgcctcccgagcgacacagggagcgaagagttgaacggcctcgctcgccgccacgccgacgtcccgtcgatcttcgcaacacgatcattcagcgccgtgcagcacgaggtcaccgccattcaccggatcgctgcgacgacgacgtggatggagtcgccgccttcaccaacgacctgcgtcgagtggattggccggccagctttaagctgactagaatagagaagtatgacggtaccaccaatccggagtcttggctcaccgtctacggtctcgcaatccgcgcagcaggaggagacagcaaggccatggcaaactacttacctgtggctttagcggattctgcccggtcctggctccacggattaccccgtggcacaattggatcatgggcagaacttcgcgatcacttcattgccaacttccagggcaccttcgagcgccccggcacacagtttgatctttacaacgttattcagaagtccggagaatcccttcgagattatatccgacgcttctctgaacaacgaaacaagatctccgacatcaccgacgatgtcatcatcgccgccttcaccaaaggaattcgccatgaagaggtggtcggcaagttcgggcgcaaacctcccaagactgtcaaacttatgtttgaaaaagccaacgagtacgccaaagccaaagaccccattatcgcatcaaagcagtcgggccccagttggaagccaaagaaggatgcaccgaccacaggagggggtggaagtaacaatcacaaggaccacaagcgtaagcccgaggaacttgttgcgaccactacacactcctcccgacaccgttcgtgcgtcaacatgtacgacaagatcatgaactcccaatgcccgcatcatcccaactccaaccacacggccaaagattgcttcgtctacaagcagttcgcagagcaatacgccaagaatacacggaagaactctgacggggagcaaagcacgtcgaaaaagaaggatgatgatgatgcccgacaggttttcaagaccaccgcaaagagctcaaccacatcttcggcggccctttggcttacgaatccaaaagaaagcaaaagctgactgaacgggagatcaacgctgtccagcccgatacgccccaatatcttcgatggttagagacaacaattaagtttgaccgctcggatcaccctgaccgagtggtccacccggggcggtaccccttggtactagacccagtggttcgcaacgtcaagcttcgcagaaccctcatcgatggtggcagcgtattaaacatcctcttcgccaagatcctagacgacatgcagatccctcgcaccgagttaaagccgagtaatgcgccctttcacggagtcatcccagggctatctgcaactccactcggccagatcactctcccggttaccttcggtacccgggaaaactttcgcatggagaacatctgcttcgaagtcgctgatttcgagacggcataccatgctatactcggacgcccggcgttagccaagtttatggccgtcccgcactacacctacatgatgataaagaagcctggtcctcgaggagtcttatccctacgaagcaacattaagcaagccgtcacatgtgacaaggaaagttgcgagatggcccaaacccgcgagatcgcgaccgccatagaagacatccgactggctgcaaccacggcaagcgaaggagaggtgcctacaaccaaggtttcaaagagtggagaaagcgaagccaagactaagaaaattcccctagatccttctgatcctactaaaactgctgtaataagcgccgagttagattgtaaataggaaagcgcgctcatcacctttcttcaaaataataaagatatctttgcatggaaaccatccgatatgcctagtattcctagagaggtgattgagcactctttgcacgttaaggaagacgctaaacccatcaaacaacgactccgccgctttgcacaagacaggaaggatgcgatcaaggaggaattaaccaagctgttagcagcaggcttcatcaaagaagtccttcatcccgactggctggctaacccagttctagttcggaagaagactgggcaatggcgtatgtgtgtcgattataccgacctcaacaagtcttgccctaaatatcctttcgggttgcctcgcattgaccaggtagtcgactcgaccgccagctgcgagctactcagttttctggactgctactcggggtatcaccagatccgactgaaggaatccgactgcttgaagacttcattcattacgcccttcggggcctactgctacatcaccatgtcattcggactaaaaaacgcaggagcaacttatcaacgcatgattcagagatgtttctcgactcaaatcggccgtaatgtcgaagcctatgtggatgatgtagtcgtcaagaccaagcagaagggtgatttgatctcggacctggaagaaacctttgcaagcatccgcgctttcaggatgatactaaaacctgaaaaatgcaccttcggagtaccgtcagggaagctgcttggatttatgatgtctcatagagtcatacaggccaacccggagaaggtcaacgccatcctcaacatgaaaccgccaagctcccagaaagacgttcaaaagctgactggatgcggttcgtctcacgactcggcgagcaggggatgcccttcttcaagctgttaaagaaagcagacaatttccagtggggacccgaagcacagaaggccttcgaagacttcaagaaactcctcaccactccaccagttttggcctcgccacatccacaagagccgctactactgtacgtatcagccacctcccaggttgtgagcacggtcctggttgtcgagcgtgaggaaaatggccatgtccagaaagtccaacgaccgatctacttcgtcagtgaggtcttagccgactccaagacgagatatccccaggttcagaagctgttgtacggtgttttgatcaccgtcaggaaattatcccattacttccaaagccactcggtcacggtggttacatcgtttccacttggtgacatactccataatcgtgaagcaaatggacggatcgccaaatgggccttagaactgatgtctttggacatatcgttcaagccacgaacttcgatcaagtcccaagctttagccgacttcgttgccgagtggaccgagtgcaaggaggacacccctgaggaaaagatagagcattggaccatgcattttgacggatcgaacaggctttcgggcactggagctggagtggtcttaatttccctaactggagaaagattatgctatgtgctttggatacatttttctgcatcccacaatgtcgcggagtacgaggcgctcctccacggactacggatcgcaatttctttgggaattagacgtttgatagttcgtggagactcacagttagttgtcaaccaagttatgaaagagtggtcttgccttgacgacaacatgatggcttatcgacaagaggtacgcaagctggaagacaagttcgacagactcgaacttacccacgttcttcggcacaataatgaagcagccgacagactggccaattttggatccaagcgcgaagcggccccttcggatgtgttcgttgaacacctttatgagccaaccgtacccaagaaagaaacggttgaagctgcagacactcaagacatagccatggttgaagccaacaagagagagcccctcatacgatttttaacttcccaggaactcccacaagataaagatgaagccgagagaatttccaggcgcagcaggctttatattattcatgaggccgagctatacaagaaaagcccatcaggaattctgcaacgctacgtatccttagaagaagggagacaattactgaaggacatacattctggcatctgtggtaatcacgctgctgcacgcaccattgtcggcaaagcttaccgacaaggctttttctggcccactgctgtgtccgacgccgacaagattgtgcggacatgcgaaggttgtcaatttttcgccagacaaattcatctaccagctcaagagttgcaaactatcctgctgtcctggccgttcgcggtttgagggcttgacatggtcggccggttcaagaaggcagtcggcggttacacgcatctatttgtggctatcgataaattctccaagtggattgaagctaaaccggtcgtcacaatcacggcagatagagccagagatttttttcatcaacattgtgcatcggtttggagtacctaaccggatcatcaccgatgtcgcgtcccaaaacgactctaaaatacatcctcaaaattgtgcatagaataattaaaattcatgtgaaagtctccaacaattaaaatgtgctaagttaaaagtcaaataaggcttggaggatttttgtatatttcctaaaagcctaaaatgtgtaaataaattttagtggaattttcagagcacaaataataattaagaagaaataaacaaagttaaaatggttttataaaaagaaaaaccctaaaaagtctttcccccccccttcccctcttgggccggctcggcccagctccctccctctctctcctctcccccgcggcccatccggccttcccccgcgcgcgcgccgctgacgggcgggcccgcccgccaccctcgctgacgggtggggcccacccgtcatcccctacctcgcgccgctcccgccgcctcgcccgtgccctagcgccgccgccgccgcggattccgccgcatcccgccgtccccgcgcgcaataaagagggggaaatcactccccgtgattccctctccctttccccccacttttccctctctctctccctcggattcgtttggaatcactcccgcaaacttcgccggcgcatcaatggcggccggatcttccgcggccgattccccctcatccggccgctctctccccctcccaaccctatataaacgctccccgtgcctccctcctccgtttccgccactcgccgctctctctccccgtcggaatcgagctcgcgccgtcgccctctctctccgccgtcgccgccgagctccggtccgccgccgtcttcgccccggacctcctcccgcttcggcatcgcctccttcggcttcgccgcaacctcgccgacctcggccactcctccgtttcgcccgccgaccgccggaacgccgccgtcctcgtcgacccgagccgcgccgccgccttcctccgctccggtcgccgttcccgtcgtcgccgtcgacccggggtgagccgtggaccgccgtttcgcttcccccttccctcccctctctcggccgccgctccgccgtgcctatggccgccgccggcgaccataggggcgcgggcgcgccgtctcccgtcggccgtgccggcgaggccgccttcgggcgcgccccgtggctgccatgtggggcccggccgtcagccgcccgcgccctcgggtgcggctgacgcgtgggacccacggcaccggccggcgtcagccgcgtgcacccggtccaccgtggaccgtgaggctgccgcgtgggccccactcccgtggacccggtccgcgcgcccctccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatttggagtttattagagtaaaagccttttcttttccgttggtcgtgtagacgctgcagcttcggaagatccgctcttcgtgaaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattattgttattgttattattaccttgttcaccctagaataaacaaaaccccaactagtggacactctactcatggtatcactagtataaatttaggtagatgcttcgcttttaaataggtaacattaggtggtttttcaactctagactttggggaatattcatatcacctggacactttggaatggtttggtcattgtggaattggcttcacaccgctccttctattcaaaatccctaaaatggttttaggctgggctcggggtgcatggttttgatagtagcacctcggccatataaggaccggtcttcgggcctctgttgcaaagcactaccatacttccacatgtctagtgggtaaggcttagtttgtggctcagtctagttataaacaaaagtacacggatggagatggaagaagtcgggggtcgatggacatctctaggacaaatgaaagctacacgagctgcggcccggtagtcgagatgtcatggcacagggccggtgtcctgctgctaggggctcagtcctgcctccctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaaggtggaatggttggcctgggttggcttgggacgagctgggacccagggtcgggttgccagttcggtctgaatcatcgtaggccttgggttaaggcaggttcgtgtgggttcacggccttgataaataacattgtatagttctaggatcgcatttacaaaatagctttgagcaactaaatgtctttaaatgctgtttactgcaaccctaaccctttatattataattcccttgtactcccttgcatttattatgcatttgtgggtgtgtctggttgagtacggtggttgtactcagtcttgatcaatttttcccaaacccagaaaaggagccccttgaagatgaaggctttgggtttagctcgtgcctgccgtaagcgcctgtggtcgtcgccctagtcttccgctgtttcttgtttgtctctgtgtgggctgggccttcgctgcccgtgtaataaattaactatttacgcttccgcttgttaaactctgatttgtatcaatttttggtgtaccttgcctcctgggacaaggattaatgcacgcacgtaaggaacgcccgttgggttatttccggtcgtgacaaccgataacggcactcaattcacaggcggagtatttaaagacttttgtaaagacttcggaatcaaaatctgctatgcctccgtatgagcaatgggcaagtcgagcgagccaatggcatgatacttcaaggaataaaggcacgagttttcgaccgactaaatccctatgccagcaaatgggtggaacagctaccatagtactttggtccttgcgcactacccccagtcgggccacgggccagtcaccattcttcctagtctatggggcagaagcaatgttgcctagtgaagttgaattcgaatctttgcgttttcgcaattttcgtgaagagcgctacggagaagaccgagtggatgacctgcaccgattggaagaggcccgcgaagcagccttaattcagtcggcccgatatttacaagggttgcgtcgttatcataatcgtaacgtccgatcacgagctttcctagtcggcgacctggttttgaggaaaattcaaactacacgggatcggcacaaattatcccctttatgggaagggtcatttataatctctgaagttactcggccaggttcctatcgactcaagcgtgaagatggtacacctatcgacaactcttggaatatcgaacatcttcatcgtttttctgcttaagtttatctctgtatttccctgtcttgactgacaacatcaagcttctccttgaagttatcagtcgggggctactataataataatggagtgtgatctttatcaattcaatttgcttacttggtttatcattgccttgctcgatttttcaacttagtttacgaggactgaaagtttttaatagcttttgcgggttctaggatcaacaaggcttgacaaaggcttttaagaaatcaacagctaagtatgaaacaccaagcacagcataaatataccagtattgtacaaattgtgcctccatcatctatcatcaaaatcaattgatacatcaatcagtgtcagtcttttcatcatcagaactgccagggccaatctgccgaagatcggtatcttgaaaccgctctaccacatcaaccgcaattttgtcggctgctttctgtgcatcgttgatgagatcgagagcagcttcttcgctcgtcccgtctgcaaagccatcaacggcatcaatgtcaatcttcgggtacaaggacttggtcatcgccagcgccaaacttgctcccatactcccggcttctttaatgttcttgaagtacgtgtccggagcgactctcaacttgtcgaagacttcagaagcatcgaatctactcggaccattgttattaaagaacatcgcctagacaagtagagtagcggcgttggcaacctcgtccctggctccttcaagtcttttgaatttgccgactaagacgtcaaactgagcttgcgatttgatcttgcggtctacatcaacaaaaccatatcaatgatccggcataccaaagagaaactcagagtattgactgacggtaccttcaacgtccttcaggggcgagtccctttgtttggccagctcagctttctcattctccagagcctgaatctgtttctccagtcgggatatcttggcggcttgcactgtattgtttccagacaattaaagtcacaacgatgacagcgtaaactaactggataagttttgtgtttaccttttgacgagccgcttagttcgaaattagactcttgaagttgagcaatccgatcccatagatcgtgctctgtcttcctggcgagctctttgacttcgctcagctgatctctaacagcttcaagagtccctagatgaggaaccaattttttcagggttatggtctttgcctcattcctgagatggattctctgcatgatgactttgtcaatgatcttgccgagaaggaaacgaggtagttgaggtcaggagtcagaggacttacattgacaatacgagttgcttcaccaagtgccttcttcagctggcacacctcttcatcctctttctgccggtttattattatgccttcaggccgcaagtcatcattccaccacttgactaggatgggagggcgagagtcttcagctgctcttatccgaggaatttcttcttcatcgccgaccagtggtcctgatgcatccacggatgaaagtcaaataatcaattgaagttactcggatcagcatggtttaaggcaaggtgttacctgtgataattcccgaacgagggcgagtagattcctgtgctttagccggggatccaggccttgggtcgctaccagcgtctggcccttgagagctatcagcctgagcttcgacttccgggatttcttggcctggccctgtttccgactagtttccagtcgggggctcctgacaggcttcggtttcagcctcggccgactggtttccagtcgggggttggtcacccgggtctacattgtcggttgtcggctagttatcactcggatggccttcgacagtcggcccagtttctttggaggaactcgtctccgtgttagccggattagagtcctttctagatggatctatgtcggatggtttcctacaagtttttgttatcagtattactttcatactgggagcgcatcaaaacaaggaaaggcgttaaatggttcgtacctggaggattttctaatctttggcatggggcgactagacgttttcttctttggagcagcatgcttcggcggttttctgggtgattcttcatctccagatttcttgccattgtcgccttcgtcgtcgctcagcactaattttctcttgcgggaatctgattgcccggctggattggaggttttaggctgaggttcggacctaatcttcggtcccccactcccctgaacggtctgatgacgaggagatcggcgctgagcaattggggggtcggacttcaccaaagcaaactcctggacaggatacccgccactgtcagttgattcaacaggaagacaagactatattttgagcaaagttggaaaattttgatacataccggtggaggtggattgaatgcgttatatggtacgactggcagcagatgcgtatagctgacgacaatggcgttagagaagattttgtacatcctctccttcatgatcttaaaatccagggagtctgagtcttcgtgatttggatcatgtttgccatcaaattcaaaagccgtgcgggatctctctttgattggagctagccgacttttgatgaaatgccgagtgatctgctccccttgcaaaccttgctctttgagcttcagcatatgttccatcagttctacagcttgggcagcttcatctcccatgggcagcgaattccatgtgtcttggtagaccggaggaagacaggagtactcggggagtgcaggctcagggttttgaacatagaatcagttggcatgccagcctttgtttgaagttttgaagggcatagagaagtatttctggctcaaagttcccctaagttggaaaccagcccctccaacaacacatggtttgttcttatttggctggggtttgaggaagaaaatgcagcggaacagagcaaaatgaggcctaatgcccaggaaagcttcacaggcgtggacgaaattggcaatgtgaactatggaatttggattcaaatgatgcaagttgatcccataaaaattcagtatcccacgaaaaaatctcgaagttggaacagaaaatccgccataaaagaaatgggaaaagaccacgacctcatgtgtatcaggggttgggaaagcttcaccaaataccggatgccacccgatgatctccttcgccggaagaacgccgtgcgccaccatctccttcagattttcttccgttacatcggacggcgcccattgactctcgaaactttccttttcttctgccatcgattcgacctgaatgggttgatttggttcgaggaatggctggggagggatgcggaatcggagcggtgggtgcgcggagaaattttgtggatttttgggaatggattggggcggattgacgaaccctagtttcgccgacgcagctctgtactgtagcaaggagtgggggaaatggtgagagttccggcggggaagacgaagcgtcacttagacttcggtgttttgttaagggtatcgaaggtgctaatgggcctaggcctgtacagtacttcagcccaatatcattaacagcgtggcccgttgtgatccctagggacttaggcattttttgctttggcaatttgtgctcacaatggtgtgacccgatgttgtcaaaatcctttttctcgcggttagataattctttggaattactacgatgcaaataaaaaggtgcccgacaaaaaagtgttatactacttttgcaagcctttttaggctacaaagctgtttgggttgatttgagatggctcgttttttaatagtcattctcttagcatgttatatgcttgctttgattatggtgaaagtcatagcttaggctattagacttgttaattaccataattttttataatatttgatggatcattttaaagagtttttactcggattcttgtcaaatatacctatttgtggaccctttgagtatcattcactcgggctctttattcttgatataataaggctgaaaagcagtcggctggatgtttattgaaagccgtacatgcttggctatatgatgtttggttgtgaaaccatttggttcttgactacatgtttagttttttaactaatcatatagtcgggggctacacctaattatgtgcatctattcgatgcaccatgttttattttcgcccttcacagtcttcgattatatcactcggcaggctggagtagcaagaattaaagcactcggattattcttgagaaggctatttcgtcgactgcaaaggactcgggggctactgtggagattatggataccccatatctacatggcagttatagttaggttggatatagggtaccgaatatagataaaatatctttataggaactcgggtttatttcttaacttgtacgtcaagaaagtacccggggtcttagtcggttacgattgtattttatctgtaacctcatgttccgttagggatatggactgtattttgtaatacggaccccttctcctatataaggaggggtctgggtccttcttgggacacgatttcctccaatatcatataatcaataacacactcggcggattcatccccggacaggagtagggtattacttattgaataagaaggcctgaacctgtataaaattctttgtctccaaacccatccacttttctaacttgatagccacccccttttagtattgccgaaatcttgtttcgacacctgatcttaggagaacggaggtgaatatcgtgtcaaccgaagtcatcaagctactctatttaactagtctgcttggaaagtttaagcttcaaaataaagccaagagattgaacgaactgcagaaatttttcagcactgctatacatacgattgtttttatacgacatttgtacgatgaaacgtttctctcctaatgatttttagcgttgaaacggatccctctccactgctgagcccatatccaaagcccaacagctcctgacttcctagcctgctctctcgttggcatgcctgcacagccaaccaaagcaatcttctttctaattatatacttcctccgttttacaatgtaagactttctaacagtgggcaatgctagaaagtcttacattgtgaaacagagggagtattaagcaatcttcttcctaaataaatcttatatagttattgtacttagcgctcatttatcatgtggcaggttaggcaaattactcaaacatttataatcccaccttggacaaggatagcatcaaccctagttggaagtactattccatcccataaaaaagcaaatcctagctacgaacctggacacgcatatgtccaggttcatacctaggattagattttattttattttattttattggatggagagggtagattctaatggccacaatcggaattggatgcagaaaaagttcatatacgaaccaatgtcaaacaagatttacatatgtttggatagagagagaggtcctagagacaaacttaaagccaaagtatagtgctgctcaagtttctctgaatatagatcttcctgaagtcctgacttcctgctgcatatagatctttaatgctgacatgaacgtatgatcggtcatcttaatcacttcttttgtttatgagagatgcttgatgcatgctccacggcaataatctccttttattttctttgcctgatgttccatgatcagtgagctcttttctccttccattattgttggtacaatattgttcttttgtaacattcagtttttacaactttggttaatgtgtcctgccaacgcacagagacactatatccaagaatttttattttatgacttgattatatggttagataatgttatgtaagtgtagaatcatgtgacgatttaatcttggtgatgaacaattgtcaaaagtaagttgtcgacgggtggtacccgtagaccggatatagagggtattggggtacgttggtacaaggatctacgtaatacgacatcaagcagacaggagacaagagttatactggttcaggccccttgataggtaatagccctaatccagttgatgtgggattatatggtgaaaaacacaggttacaaaggaaacaatggaactcgtcggatccggcgagatcgtagtcgagttggttcgactagatctcgatggcttggctcctcgcaggctccggcttcgtaggctgtgtgggttgtgttggctctgagattcgatgtcataagcccttcccgggggggtcccttttatatcgcagatctggaggtctccaagtagaacgcggaggtatcagaccctatacgatacgtcaatgacccagtcctgtccgagtaggattcttcccatctgtagattccgtgaaaggtttccttagaatatacaggaagtatccgcatgcgcgtgggtatgccataccgatatgtaacgtatatcgaagggtaaatggtatgcctaacccgtaaccctgacataagtgtttattgaaaatacagtgaatagtatattcagatattagtgaacggttttgttggcattgtgaggccagtcagaccgggtgggtgccaccgatcagaccagtggtggtttgtcacgcccggaaattcactagtaatttccgaactaatttgtgcataaaatcctcgtccaggaaccagccgaggtacacaaactgacaatttaatatacaaatccatcataataataacgttacatacttacaaaagaaaagaaaaacagcagcggaattaacggtctagcgatggcttcagctccactcccacaggcagctcaactggggtataaaccaaacgtcttctccttctggatcctttatcttcaactgaggtttgatgattattgcaagaatgagcatatgacatactcaacaagccacacagcaaaatatgcaagtgcacaaggattccaaaggatggcataatataggcttatttgcaaaagcagcatttagcaaagatttaagataagtaaaacagtagagtaattaatcatcgattttaatcaacactaaacagcacacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcagtaccaccacggtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgttttacaacagtagctcgcgaaccggtccttaattgtcatgagcacgaccttcaaaaccatatgctcacaacccaccattgacaagttttaattaccaatt

SEQ ID NO: 3491 - DNA, 833 bp, Oryza sativa
cccagaaaaatctataaaatagaggagcaagtatagtatttaataaaattttatctaacccaattttatattgagatttagcaaattaaaattagatcttctcttttaagcttttaaaattatttctaataattccttttaaacaacaatttataatttaaggattttaaacaagaaaaactcttaacaattataattagatcattattgatcacatatttactgaactgttctttgtatcattaaaattaataattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattaataatttattaaataatttataaatcctgaaacgaaaatcagggtgtgacatggttggcagtccgaccggggagcacgacgattagaccgacagactccgggagggagtcgcttttctggttgtttttgtggattttctagtttgctttatggatatgacttctatggtttctatttgtatgtgatactattgtgcgctggtgtgagtccagttggtgtgaacttgtactccgatatggagtttctttgttgttcatgtggaggtgttgcttgaggccatggaagtatagccggtgatggatcgagactaggcttgggagaagttgaggtccagacggtaaaggatatcaggcgggatgctcaggctagagaacaatacatgtggtggtgaaggtttctatatggcatacacgtggtgttg

SEQ ID NO: 3492 - DNA, 747 bp, Oryza sativa
  unsure (1)..(747): unsure at all n locations
tgtcctctaagttatcatggcaaattgcagcatgaatgcacacaaatacatgagaacattgcagaacaaaaatgtggaaaagaaacataaaaataatgcaaactgaaagacaggaaagacttacgtcggtaagagatacttgatgaactgaattaaatctgttttggggatttccaagtcagcagattttagttgatccttcagctcgtccatgagcaaatttgcatccctaagattcccttgtgatagataccttaaataaaaatgcagtatatcagaaaaacaagcatctgagcacgtctttttccccaaaaatttcttatttattcatcctataacgaaacactttcttaactttgatttttctgaagttagctttgatttttctggtccccagtgcaagaattttgacacttccttttaacatactatagtactataaacataataaaataatatattatgtaactatttccgaagttcgatcaaattctaatattttaccttggatggagcactttatagtgtgctcctgtatgtgcttaagtatccaaaggagatttgtatataacttagcaggatattgtattgatgcatattgaggaaatatatcctaatgcatgatttgctagcacattcctaaatatgtatattgtttactcattgtaaacagaacatgaaatagagaactccctatgaaattcggtttctgcannnnnnnnnnnnnnnnnnnnnnnnnnnnnnnnn

SEQ ID NO: 3493 - DNA, 958 bp, Oryza sativa
aaatctactaagacatttaagttatcctactttattagcatgcagaattaatctacaaccaagcaaggcagttgcgagactgtgtaaatgttaggagactactaggaaagaaaaatcaatcttccttcttaccgtcttcttgctggatgaagaagtctctccactaccactttctgaaacctgcatcagtcaactcattagacgacaatactacttgttaggcagcaaagtgtcaaaagaaaccattgcaacaaacttagcaaaagcttacatccatggcgtcattatctgcacccctcttccttttctccctttgttcagatgtgaagcagcttgctattctgcgcaagtcagggccaggggacgactcgcgtgtccaagaattttgtccaggcacctgaaataaaccaatggcattgtccaggttgaattccaacataagctgcttatcagcaatgagtaagactaggattaatagcaaatgagcagcaggtgctcttggaagcggcaacatacaggcacacagtggaaaagatggcgctcccagagatgtgaatcacaagggtgtggcattgagaacggcgaggaatcggagaatttgtttgtcctccaagtggagccatcctacacaaataatggttcaaaataagcataacaagcactaaaatgcagctttacattaacttatgtactaaattccaataccttgaaagcaccaacatagaactcgttcccgagcatgtcctgaaccatcccccggaaccgaacaagggtattcggcttgatcaatccaagatttgattcatccaacaccggaacctggaaaggaaaatattcccacattccgtcattccctgaacttcctaagattcatttacacccacaatacaaaatatcctctttctctcttttttttgggacaagctcaacataaacatatgtgacattctaagtatct

SEQ ID NO: 3494 - DNA, 1616 bp, Oryza sativa
cacagttagtctatccttacttctttttggaaaaatcttattctttaattgtttgatttgatattcatgcttccaaataactgtctatgaaacatgtctatagaaatcgaatggattgcaaaaattaagttcctccgctttctttttttttttctgtttagtttatctttacaatgtcagaggaatttgattattaaagaatgtaagaccaggcatggaaatatgcgtgtattcggtaaaaaaacaatgatcactagcatcattttccattacattacaagatattgtgcctaagattcagcgctgtgggtcttgctacctgagtggcagtgcactggacatctgaccaaccctacttgagtctttctttttcctttctatttacttagttatttttttactaagatttacacctgctatatatatatatatatatatatatatatatatatatatatatatatatatatatatattgaaatatatagcaatgtgtacatgaatgtcccgcagcaacgcgcggggtgtcatctagtatttttaattttaatgccatataagcgccacgtcaatgccgcatgagacaaagacccaatcaacagcgtcatgtcagtgaaatcatcctccaaaaccactaagggagtcaaattacactggtttcattagttcggggagtcattttatccggttttctagttaaggggcatgaattagatttgaccgacttttaagggagtcgaagtagactttttccatcccacaaatagcttgttgtttgtgagctcgtggccctagagccacgtgatttgatccaacaagcaaccccgggcggctttgggtcgtgccaaagtgagactccacctcaatttggcccaaacagcactccctactaatatagctggaccaacggtctcccgtatagatggccaaatgggccgcccggctcgtagctttaattgccttgcttcattttcgccatattgagattctatggaagaaatgaaacgttatccgcctacttatacttcttatagcaagcatcctcttagccaagaagtcccagaagtgaagcccctttcaagctttagtctttctcaagtgctcgatcggggcttttctggtgatttctatataagaaaacacttttgagaacttggcatagagtcggtgatcctactttcatagggcccatcctagcccgccctaggtcctgtcgtgcccgggccaagatttgtcgggccggcacgacccgacctacacgtcggctcatgcagtgctggcccacgtgctccaccaggccggcacgaaggcacgagcagcccatcgtgtttttttttgaaataagtctatttaccctccatctctttcggctgtgacatatatatagctaaaataagtctattttgcgtccctactctttgggccgtgccatataatatgtctatttgttctctctattctttgtgccctgtcttacctatggttgaaaataagtctatttcacttctctaaacttcgtgacttgccaggctagcccaccgtgctgaggcataggtccagacatgacccaacagccgggccgtgccggcacgggcctgacagcgattgggttgtgc

SEQ ID NO: 3495 - DNA, 610 bp, Oryza sativa
aatggagtgttacttaggatcatgaaagttcaggtgtttaactggaatatgaaggaaagttaattcgttcttttaaaacttttgcttccgcgttctgcaaggaactgtgaaaatatttcatcacatgacacgtactgaaaaagtttatcttttcctgaagcctatctttcttccatacttacacaaggtacataatttgcctcttgctttctgaacaggagcaaatgttgaagaaaggatgtgcatggcactatactgcctatgaccaacgaccagagctggccaaggtacattgaaaccatacagctacacagatcacttgagtgaaaagcaccatgaacattcaggttgttctgtatcatatttctaaatgagagcctttgatttttcaatctatcagtgggagaaacaggcgcaatctggcaggaagggcttgtgggcggcgtcaaggccacagaagccatgggaatggaggagggacaagcgcaatggtacagcatgaacatgaaccatgaacaacagatgattgatttataatattagctctttcagacttgtagcccggagcaatatatgctttacaccacagtagaagtgtagatcgtgtagt

SEQ ID NO: 3496 - DNA, 4291 bp, Oryza sativa
agctacgtcatgcgcagctaccggttggagtccgaatcttaaagtagaaaatggaaaaacacatgtttggtgcacccaccgcgatggacagggaaggcgcccacgtggaccccgggcccacgtgacgcacacgtgtcagtccgtggcgcgacggatccgatcgggcacggtgttttccttcccacgtgtggacaaacgtacgtgcgtggccgtgcctacgaacgtaccgttcttcgtacgcgcgtacacgagcatgttttaaactcgcaacttgccgatcgatctctcgcacagctcaaacacagtaatgccgcgatcgagctaggaatctactcgcagtggatccacatgagtagccataacaatactataattagattccgttctactccttccgtttaaggttataagtttgactaagtttataaacaagtatagtagtatttataatactaaattaatttcatcaaataaataattaaatatatttcataataactttgttttgggttgaaaatgttactacttttttctacaaatttagttaaacttaaagcaatttgactttaaccaaagttaaaacgtcttataacctgaaacagaggggtagtatattgtaaacattaactctcatttattttccgttagcatatttccaaactgttaattaaacgatataatttttaaaaagtttatataaaagtttttttaaaaaaaatgaatgaacattttttaagtttataatagttaataattaattaattataggtcaattgcttgctttggtttccgtgccgcataaaagctcagttcctacgcaggaaaggcagcatgtggaacaccttattttttacaataaaattcactgtatttatatatacacatattctaatatatgaatactttccatttcaaaaagtttttttaatcatgtatagtccatttttaagtaattcttttttgcgcacaaacttagatgtacacaaccatatttataaataccaagattatattaatttatacctagtagtaaggggtgtcatacatttatatatgaagttgagccataatagttctcctagcttaattcgccctgcctctacttgcatggatggaacaattatgcaggtcgtcggctgtggtcgatctgtcgagctaaattgtaaagctagcgatcgagcaatgcaaacttgtcatgcaacgcaatctagctgaaacacggtggcaacaagcatcaacgcgtgcaatgcgttgaccgcactgatgatctaagccagagagctactactctacctgcacaataatttttgtcacagcttggcttgtcgttgcgttcagctcgactaatcactcgattagttcagcgtatggtagcacgtcgaattaacatactaactaatcatcgtctcaaaaagctaggtagccattatatatacaatccatcagaagtaacaacactatagctttcttagcttgtaggctagcatatggtctgttccatattcaccttaattctactacgaaaaaaaattaagatgttgcacggccaggttcatatgttaattaacttatatagatgaaggcaccaaacaactaatcaatggaggcccttaaacaaatccatgctacctaaactcctatatatccaattgagcattcacactcgtagtataatcggctagctagcttgcagcactcatgcatgcatgcatgcatgcaatggaagcacactcatcagagggtagcatggcatagcatattagcatacaaccaaggtacagcaagggagcatggctgtgtccatgatgctcgaatcattgcagccagcagaagaaaaaaaaagaaaaaaacacagcacaattaactaattaaggcactagctgctaatcttgaaaaaaggaaaaaaacattagaacatgggttagtacttagtagaacccagcatctctccatgattagacaaacctaattgttgtttaggatctagataaggtcatggcacacatgactgatgagtagtagtgaggtgagatgaggtgatctcaccaaacggtgaagtgatgaaaaccctactgttaatggtgttaagtctctctctctctctctctatctatctctctctcttttgcttcttttaggcgtgtttagttcccaaattttttcccacaaaaacatcacatcgaatctttggacaagtatatagagcattaaatatagataaaataaacaattaattgtacagtttgcatggaaatcgcgagacgaatcttttgagtctaattagtccataattagtcataagttttacagtaacccacatgtgctaatgatggattaattaggcttaataaattcgtttcgcagtttccaagcgagttatgaaattagttttttcattcgtgtccgaaaacatctttcgatatccggttaaatgtccgatgtgacacctaaaaattttcttttcgcgaactaaacaagtccttaatttgtcattttgtcctctcctatatatacaatccatggccaacctcaccgagctcaacacagtgaagagaagagaagagaagctaagctagtaggtaggtggtgggttagctcgatcgccaagtgttcgaccgaggagcgaagaagaaatggggaacaacctgagatgctgcctggcgtgcgtgctgccgtgcggcgcgctggacctggtccggatcgtgcacctcagcggccgcgtcgacgagtacgcccgcgccgtgtccgccggcgaggtgctggcggcgcaccccaaccacgttctgagccggccgtgctcgtcgcagcagggggcggcggggcggatactcatcgtgtcgccggagtcggagctggagcgcggcgagatctacttcctcatccccgccgcctccgtccccgacgccaagaggaggacgagcaccggcggcggcggcgccggccgcgggcaccacgtccgcagcaagtcggagggcagcgccgtcgccgccgatcggttgggcagcccggccggcagcgcgtcgccggagacgacgaggatgatgagggcgcagaagcagcagcaccaacaccggcggcgcatgagcaccggcagccatgcctcgccgtggcagccgcacctctcgtgcatcaccgaggatccctgagctagcgcctagcttaatttctttttcttctctgaattcacagtggtttttttgcctggtgtgtaaatttcctctggtgcccggtaaatatttttattcaccttttgtgttagtgatgtgccgattttacattctgaaatcaacaactgtgtataattttcgaagcacaaagcgacttccattctatcttcttgtatcttcgaacaacattttgcaacttctttttaaagttcatttgggtttaccaaagcgaacgaacttgttcatacaaaattaaacaagtcggcagctctgattgatgcgaaattaaatgaaaattaaaccacttgcaagttatatatatatatgaactcaactcatgaagtgaggttgtgtgtcatgttggatcccccccccccaaccccggccctcttttttttttcttttgtacatgaaaaaaaaaaagaagttcagataaacagcaacgagacccatcggtttcgatgataccacggcagcaggcaatgctagatcgatggacgctgagattcccggcaatgatttgggaactaattcatgaatactccttggaaatcacgcgagctctgcatctgatcgtcgtcctcacgctcgattgatcctgattcctgcggtccaagttaatttctgggcctactatacctttgaagggcccagtttgaaccgctaccagttgtagacttgtagcggtctgattttcgcaggggataaagttcagtttatatcgctcaacttgcgttgagtttcattcagatcctcaagcaggtacaatagtagactattagtgagctgtaaacatattttaataagataaaagatgagagagaaaagtagtgggttacatatctgtagtcgcagactccaaaacacaatatgtgtatgacaggtgggaccatatattaatagtatagtaaacaactattgtatgaattgactattaaattaactatagataaattaaagctagtagtgggctatactattaaacttgctcttagagatctcttagcagctagggatgaaaacggatcggatacggacggaaactagctctaccatattcattttcacatttttttcggaatcggaatcggaaaccccggatacaaaaacggaatcgaatattg

SEQ ID NO: 3497 - DNA, 1231 bp, Oryza sativa
ctgtacgtactgtatgtcacacccacaaacggatcgatctatatatgtgcgcgcgtacgcgtacgccggcggcggcggcggacgaagcagcaggacgtacgcgacgcacgcgggatatggagatcgatcggtgcaggcgaactgatctatctatctatctatctatctatctatctatctatatatatatatatatatatatatatatatatatatatatatatatatatatatatatatatatatatatatatatccgtaccgaattaataaataagtaaagctttcgtatcgtacgcatttttggtctgtctttttttctttcctttttcgctgttttttagttcacacggttcgctgccgggccaaactctaccgcagctgtctccacgtcgatttgtcaaccaatttaaggagatcgagaaagattcagccggaggttgaagagggttgttcgaactgataccgtggcttcacttatgggctgggtcaaagagaaacgggttgaggactaatattttcattagtttatgggtaaaaacccatttttccttccttttcagtccaaaacaatgaagatttttcattaaaattttcaattataatgtttatagcaatcataatgctttaatttataaactttttcattgactttttcttcatattgtgaattcttatattgtttgaaccctattaaagaagctaagtgacgaaagtcactcaagtagtaagtttgagagtgaccattagagcgaccacttgtacttataggccttggcaacctatagtcttgttacgcaacacagcttcactcgattcagtaaattaatagttcaaaccagcctcgctcttccttgaaagaaaataggaatctatgtactcagcaacattctagtagcataaaaccttttgagtgaaatacatggccggcccctaaacttgtgtggtggtgtcacttaggccctgtttgattcagcttaggattattataatctggattattagatgtaagctaaaacaaacagatatcttattataacagattattacaatctataagccagattaatgtaatatggtaatctactctaaaggtgcctttttagattattgggtggctaatagctaacaagcaactaataatccagagaaacaaacagctaacaacttattttatgtcggcttattataatctagcttatagtaacctggctcgataatctagattaca

SEQ ID NO: 3498 - DNA, 596 bp, Oryza sativa
  unsure (1)..(596): unsure at all n locations
cgcggcgtaggacgaggtcgtcgactcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgtccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagnnnnnnnnnnnnnnnnnnnnnnnnnnnnnnnnnnnnnn

SEQ ID NO: 3499 - DNA, 590 bp, Oryza sativa
ttgaatttcactggctttaacagagagagtgtttctatatttggaaaccagctaaataatttgttccagaggctactaccatattcacaagttattcctctgtcaattgagtatctcaacacagccacacttcagcctagaaaggacaaccaatcaggaaggtacatattgtttgtttgtcttatgaagaatttgttactcctgatgttttcatcattcaacaatcacttttaacataaccccacctaaattttgctgcagattggttacaggagttttacagttacctcagggtactcacctgacctttgatgagactctcttgcagtctggatcattgacatccaaaggtgtcgagaatactatgctgcttaagaacttgatggagtcacagaaggtaataagcctcatgacttcatgaggctacaaattatctttgccgaccaatttatctataacatctttaaacatttttgcaggttgagtatgattttgagttctatctctctccttatgttcaggtactattcgttcgtggaatgagcccccgcattattactgatcccctttcgcctcgaaaccgtaggccc

SEQ ID NO: 3500 - DNA, 2961 bp, Oryza sativa
agatctctttcttgttcccgctcgatggagcggggggaggggaggaggggagattgctccgtgcaagtgaggtgagctgggattttcttgacttgttttttttattctttttttctctcgtgatgaatctctgagcattgctgagagcggcgctgcttgtggttgttgtggagtagttgcggcatggaatcgatgcatgcttgtgtgcttactttttatcggtagtaattcttgttatgaacatgttgaaagtagaataaggctatctgtttgtccgtctaattcgtttgaagaatgtttttgtttccctttcgtcaagtttattattagttgggaattatagctggatgagatttcaggacggcgtctagtagctttcatgtgttaaatcgggtggaatagtgacacccttgaaattgaaattgagtgggaaatcttctgtgttcttggcggtgcacgtgctgttgcttgtggaatgccatcgtggcgcacatgaaaaagaaaagaagtattttattcttagggccgcttaccgttgattgctgatagcctccttgatttttggacaaatgaaaaggattccgcttttggtttgttgtttttcataatttcaattgcatgctgtttccatttgtgtcttgcaatgttcagctttgtggaattattgagttacctcattgggtcagtaagaagagaacgcgaaggaaaagcgatggccctgattcaatcgctgaaaccatcaagtggtggaaggagcaaaaccagaagctccaggaggagaatagctccaggaaagcgccagccaaggggtccaagaaagggtgcatggctgggaaaggaggtccggaaaattcaaattgtgcttaccgcggtgtcaggcaacggacatggggtaagtgggtggctgagatccgtgaaccaaaccgtggaaggcgcctatggctaggatcatttcctactgcgctggaggctgcgcatgcatacgatgaggcggcaagggcaatgtatggtcccacagcacgtgtcaattttgcagataattccacagatgccaactctggctgcacatcagcaccttcattgatgatgtctaatgggccggccactataccttctgatgagaaggatgagctggaatctcctcctttcatcgtggctaatgggccagctgtgttgtatcagcctgataagaaggatgtgttggaacgtgtagtccctgaggtgcaggatgttaaaacagaagggagcaatggcttgaaacgtgtttgtcaggagcggaagactatggaggtatgtgaatcagaagggatcgttttacacaaagaagtgaacataagttatgattatttcaatgtccatgaagttgttgagatgataattgttgaattaagtgctgatcagaaaacggaagtacatgaagagtaccaagagggagatgatgggtttagccttttctcctattagagtagtagtcatgctgcgggtcaataggaatatttcattctagctgctaggggatacttcaaatatcgggaacctgaagctttgtgtagtcatttacggttttcgtcttactgggtaatagctttatatatactataagccaactggtacaagaagttgtactgtgtgttgagtgcactgtggtaaaaatgaatctatatttaatgagcttactctgtcaatatttttgcttattttagtgtggttaaactcaggttagatattcaaaacgagtggcagatacttcaaggactttaggatcgaattaaattctcaaacaggtatattaggaagtttatttctgcatgcataaaagtatgacaaactatgatagtacaattttgcatgcatatggaattttaaatacttaaacatactactatcgcattatagcgctctatggtcattccaagtaccaaaagatacatcatggagatttcataaggggaagttgcagacattctctgaattcaagcctccttgtttcactgtgaaaggtcttctgtttgttaggccagtaggtcagccaaatccagcctctaatctcccagtccatggtcttccctaatgctgcaccacagatcttccaccagacgctgtctccatattcatcacgtgcgaaaatgacaccacccttcttcgtgaatgggcgatacacggtcgagtacctgtcacgaaaccaggcccgtggctgaagcagggagagcttggaaggctttgaagaataaacctcccttccgtttacaccatcatggagaaaccagttcaaggttgtagtgtttccatgcacagactgttcaaatttccagggtttcatggtcagtgtgaggctttcgctgaccgatgcctttagtccaaatgtgtttgggggctcgaatgaaccttcaatgcccttctcaaggccaaactcatgcgtggggttgtcggaggacttgctgactgaaaccgacaggacatctgattgttgcataggtgtgatttgcagcataacacgtgatggaaagtgcttctcctcagagccatgtccacgttcagtcatgaggatctcggagaccaaagagtccacatcacacctgagatgaatccactgtaagtgccgctcttggttttagatgatacacgtatgggtgtttttttttccttgtgcagtaattgtaactttgaaacaattcagtttgtagatagactgcttttcaaggtctataaaactctgatttaactacctaaattgagttcttcttcagctggtatacagggagaagcatgttaccgaactatgcataattgcttgctcaatgttaccttactgtaggcaccaaccaaattatttgctagttaaacctttagctttttttaccaaacatatgcagctacgctttgcatgccgcaaacttaattggttcccccgagtgatactactgtcaccttaagatgagttggttctttattttcacctaa

SEQ ID NO: 3501 - DNA, 1358 bp, Oryza sativa
  unsure (1)..(1358): unsure at all n locations
attggtttccccgaagtgatactcctgtcacctcaggatgagtaggttttttattttcacctaaattagtaagtgtgtatacagttcatatgagatagaatcaaatccttgaataaattactgaccttatgttgtccacctttatctcgacatcaatccagttgtcccttctgattgttttgtaggcgagctgaatcacaccttcaagttgctgataagtaagcgagaagagaaggcgctcatcctgtgttggcactgcaggatcttccatgctcatggcaatgagtgggcagtatagctggaccttccagagcccacttgctgaaagagcatatgagaacagtggcgatggcaccccaaatgaatggtgtgaggatcgttgctcaacaatccagttagtcactgcaagattcattgtctgcatccattgctcctcaaggtttgctcccaacattctgacaaaggtctttgcagcatctttgcactttggcccagtcagctgagtcctcagggattcgaggcatcgacagcgaagagcatggggagcctcatagatgcaaactaggaaggccagggacaagaaaactatgttaaacacgtcctttagattgccatgaatctgtgccctgggaaactgaaaggacagctttttgtttggtccggatctcagcacccagtccacaatgtcaacaaacaactctaacatctcttgttcgtctagagactgctgggtgtatgatttcaggtggactggttttgacgtccacagagaaattggcacacggtaatttgcaaagatggagaaggtgacaaaggagggctgggtgggaggggttttgacaactgataggttcaccgatggctgtgatgattctgatgctgatggtgtggggcagatgcaaagggacatggcgttggagcgccattgggagaacggaggcaggttggtgatccaaccccatacatcaagaggtaagctgtgagccattacgttgttgaaaacttgagcttgttttgcaatgtgggagtatcccagtattggtgtggttttatagatggaagagatgatggttccgcagataaaattttggctcatccatgactgagtctaatgaagcacggcataatttttggtaaagcggattcttggttgttagaagaggaaatcaagtcattgagctgaggaatctttgttgttaattggagtttgaagaatcttcatttgtgctttgcacaggtgctaaagccaaaagttaactgctatacggtaatatgatatatcaaacccaagttggttnnnnnnnnnnnnnnnnnnnnnnnnnnnnnnnnnnnnnnnnnnnnnnnnnnnnnnnnnnnnn

SEQ ID NO: 3502 - DNA, 1209 bp, Oryza sativa
ctcagttgtctgatcttattgagaattgtaggatccaagctcgtgcatctcggagccagcatttggcaacaggaaaaatggctctaatgaacccagaaatgcagaaaagcggttcgcgtcatggtcctgtttctttcagcttgggattattataatccagattattagtagtaagctgaaagaatcagacaacttattgaagtagcttattataatctggagcccagcttattataatctgataagctcatttaggtgagctttttctagattattgggtgaaaaattacccaccatatgccaccccactccctcattatacttgcaaactcaataatctaggctctaataatctaggaaagaaacaactaacagcttattctactatagattataacaatctagtttatagtagattataataatttcaagctgaaagaaacagggcctatagttagagagaatcctccacctgaatttcgtgtactacctgcctctgaaatctcgtacacgcagcttgtccttcaagctcgagcaaaacctttgctcctgtgctagtactaggcagttaggcagacctgcagctgcaggttaggatatgagaggttaggctcatattcgttgcttagcatcgttgcactgcattccacaccaacacacgaacactgcattgttccacagtccagattccccacgaactgatctgcctctgactagtacacggcgcaaaggagaattcagcaccgccaacagtagcagtaattcactggattactggcgaaattgttgcagctattattcccgcctgctcccagcaagcagaacctgaaaagttgcttcaaaaaaaaaatcaaaaattataccagcttccaagcctcccatatgtactgctatcaccagctaaagtttgttcattcgaacttctctaagtaactagtgtcctgtagacagttcagtttgctccgctacaatcaggtgacaaccaacaacacctatcttcagtgagaaacaacaacgggcagagttaacgcataccagaactcgctacggtgttgtttctaaaatgtaaaaaccgtatgactgggatgcacagaatggatgggccgtcaggcgtcagtgctcagcaatgagcggcaatatttcgcttgagagaaggtaatactgtgaggcggggttgggaactggtgctgtacaaaaccggcccggggg

SEQ ID NO: 3503 - DNA, 1324 bp, Oryza sativa
aacgtggtatttctattcaggccacccagagcatgtctgaaaatgaaattcccatgttggatgttaagtcgtatattatcaggtttatatcgagacgtcaaataaaagatagtgatataaggctaatagtagcatctaactgccaggtggaatctgtgtgtgtgtttttttgaaatcacatgacctctctgttgattccacactcagataaagcgagcgaaactcacagtgaatcccccaagacaactactgaatgggatcctcttcttgtccgcatacgtggaagttgggtccagaagccttcccttggatcatacctttctgctgacctgtgcatatgaggatcaatcattcaatagaaaggtctcagaatcaaaatcaagtaaagcatggagagaatggtgagggtggatcgtaactgtaagtacatgttgccatcataaccaccaattacatagagaacgccatttaattcagccgcagcaggagcacatcgctggaacaataaaatacatgttggtgaggtgggtatattggtcaaaaataaaaatacattaaaaatatgggataatatttcatgcaaggtgaactggaaagttacaatgtatatgcctcataaatcccatgaaattacatgaattgcaatttgcattccataatttgaaatagcctgaatttgaaaaatatttattgcctattcaagtgctcaaaatgtagcttagattagatttgcaaatggtccaaccaaccctgtaagactagtgctcaagcgaatgtccaactcacagtcagcttgcccactactgctcaaacagctatctaaattctaaatcactcagcatagttcaccacgagaacaaacttttttactgatttacgacacgtaagaaatgattgaaataatagtagaaactgttctgtgagcagcactattcatcttgtaaaagattaagaacccaaagatgtaagtgattataggaaatgcagttcaaacagcctctcttcacaacatgtttttttcctgggccatctaataaatcttgagccttatcaagaaaatcacagtgagaacatagcgaagaccaggaccctattaaattggccaaaaaggctggtacattctactctatacaagtgttataagggagtagaagtagaaccatacaggttgctgcatggacaaactgtatatccatttccccactgctggatcaaacatctctacttctgaaaaagactgagacccatcacccccaccaatagcaaatattttaccattcaaggtagctccagcaagatgccctttctcatgattcaagcaggg

SEQ ID NO: 3504 - DNA, 823 bp, Oryza sativa
gcggcagaagtacaagacaagtacagatcgcgaccctgtatttgaggaggtagctatttcatcaaatatagtgttagcttgctaaacagctgtaaaacatgcaccaaaacatcttattctttcaaagattaacttaacaagaactgggaaaaattatatttttcatgttccctgcatagttgtcataaaacaatgtgttcacaagagttatattagatcatgtaggaaactctacaatttaatccaccaacaaccttgttatcatgtgctgtccatagggaaatgtaaacagtgttgataaaggaccatctgcacttataatgtgcttaatatttaactctactagcagagtaatatgtggatagaacttccattacattaactagcagagtaacttgaagaaggtagttaatgctttctatcatatatgaaaaacaagctgaaacagagctcacgtgatattatggttgggtttcagttattagatgaaatagccgcaaaattttatggaatacggagccagagcgctttggaaggactttttggtgatatgttcagggtaagatttacatctttcatctatcattcattcatgccgattgctagtacattgcattgattacttttgaagttgagtacacaccagttgcttttcacaataactaccgtcgtatgcctttagttccatatcagtcatgccgaaattacgtttcatgaagtgcatatcatgtttagaggaaagaatatatatttctataatttgaaattgcagttgatctaagcattcaggaattgaagtgcaaattttatgtagcttatgaag

SEQ ID NO: 3505 - DNA, 2019 bp, Oryza sativa
cttggagaacaccttgctccccgccggcttcagctggagcttagacgcctcctcctcctcctccttctccttcttggccgccgccatggatggacgcgatcgaggaggaggaagagatctcgagctcgaggagagggaagctggagagagtgaggaggaagacgagagagcgcggcggcgagtggcttcttcttatgctgcgctgcggtgtcagtggccgggagtaatacggttttattagtggagattagttgggtgtttaattaattagttaattaatttgcacgtcctcttaatataattaatccgcttgctattgctatactactgctgctcacctcttcactcactcagatccgaggtagcagagttgactgttgacttggtgttggcctactaggatttattaggagtaggatttcccagctagaatttcagtgggaattttctgctcaatggaaatggttgagaatttaaatatttttttaaaacattgtacaaattcgtagatgctcttaaacatgtaagcacactcacccttgtaaacgcatacatacatctaggggtgaaaacggtacggaaactttccggatttcggacctattttcgaaaacggaatatgtcggtcggaattttttcggaatttttcggaaacggaaacgaatttggaaatattttctcggaaacggaatcggaaatgataagggcagtttccatcggaactcggaatcggtcgaaaactttccggaaattttctcggaatttctggaaatttcctcggaattaccataaattttgtgactgaaatacccttaattccttttttaagcactaaatagtgaataccatggtgtttggctgttattttttaaaaaaatatttgttatgcaaatctaaaattacataagaatattttttgtgctacattgggatttatcaacaacattactcttttaaacatagataatttatttaattagatttattagtttgaggggttttttattccgataaattttcgttaccgtattcgcgccggttcgttttcgctccgctttcgatttcgataatattcgattccgttttcgtatccggggtttccgattccgatttcgattcggggatcctctagagtcgatttcgattccgaaaaaaaatatgaaaacgaaaacgataaagatggtttccgtccgtttccgtaccgttttcaccccctacatacatcttaccactatgagcatatctaactcttcaagaaattagagtgacatattttaagatcggtgaggttatgataaatgttattattgttaacatgctgctgaaagaataattattacaaatacgaacacccatttcatgtttaggacttgcggatgagcaagttccatcctaagaaatctgtaatcagctatgctatgttcagtttgcgtgagattttaaatattagaaaacaacgttatttttggtccagtgtattgtttaacctttttccaatcatcatgtacaaaaactacaaggttaaatttttaaatgaagtttattcaaaagataattttgaaacgagatatatctgatctattataattcttttatatatttagaaacatatggcacaagagttagtagtacccactagtacattagtacaaaagcgaactggtactaaaactttttaaactactcatttcaaaaccagcagcgacaagaacaaatggaaagacaagcatatcaacacaaagtactctatccgtcccataaaaaaccaacatagtacttactctgtttcacaatgtaagtcattctaacattttccatattcatattgatattaatgaatttagacatatatatctatctagattcattaacattaatatgaatgtgggaaatgctagaatgacttacattgcgaaacggagggagtatgaaatatgatacatactagtattttgaatctcgatatatctttgtccagattcattgtggtcttatttagatttcaacttttcttttcaa

SEQ ID NO: 3506 - DNA, 1144 bp, Oryza sativa
aaattttagttaagcaaccggagggtaaatctgtctagtcaaccattttggggaaaacttctgcatgattgacctctgagatgcattctggtcgtctgatgcacacagcttcaactttcagttggatactttggagttttaactttccagcttctgtttctctaatctgcaattctgcaagcaggcaaaatgtgttccataaggagctttgcttttgtgctggtattagcattttcagttgcagtcgcggagagcagagattcatttaatgtattgggtaagtcatgaattcattatgagaatgaataatgttactaatattttctccattcttattttcatatcaattggtgtttctgatgataattctaagtagatcaagcgccgcaatggcaagcaatataacactctctacagttctaaaatataaaggaatacatttatgtgttgatctacattaattattccacatcacgttatatgcgttggtctaagattgcacaagcacataatagtaaaattggtatctgtgtgtttgctgatgacgaatgttatgagaattgcatttctgaccagtcttgcttgacacatctgctgcatatcagacatcatgagttacatttattttatctatttttgttttcattttgaaaactcttatcttcacctgtaataaaattgtaattcagatatcacacagtggtcaatatatcttcagcataagaatgattccgttctacaattttgttttcacttgaaaactctatcttcacctgtaataaaattgtaggtcagatatcacacagtggttatatcttcagcataagaatgatttcgttctacaattcaacttattagtttttgactctacggtcaatttgtcatgtatttcagctcataaaagctttccccttgaaaacaagaagacagggttaacttcagccaatggaaagctgtgtcaactatgcgagcagtactcaacggaagcactgttctacctccaacaaaatgaaacccaaactgagattcttagcatcctccaccatgcatgcgcaaacgttggacctctaaaacagcaggtctgaataaatttcaatgcccgccttggaatcagaacatgctaatttcgtcagactaatttttg

SEQ ID NO: 3507 - DNA, 2311 bp, Oryza sativa
  unsure (1)..(2311): unsure at all n locations
agatggtatttggccacagttaggtctcttcctcagtcaactgaaactgatacataccaggtgattatcccttgctcaactctatcaagaaataaactgatatgtttgtcaggaacatgaacagacttaattaaattgcataatgtttgcgccttaattgtagatgattcaagatgaaatggtcaatgccatgcgtgatgataggagcttgggttgttctgaacttagcaggtgtgtgccgctgatgcctgtcagtgtgggcaatctggcatcctacaccatctccagttacttttacatgaggattatgaaatgaaaccttttgctaaactaattctgcttatgtggatctgcagatggctaacgatggcacagataatggctgcaagctttggtgagaagagtctctccatggagcactggcagatggtgaaggagctggagaggctcaggaaggagaggctacaatgagatgagatcacagtaaaatgtgcttgtaaaatccacttgtggccgtggcccaatgttatgtgtataccactagggtctaaaatctaaatcaagatgtggatctgcaacatcttctgtgatcctatggaagtatcaatgccatttgataagttatctgacctgaaaagcatctcttgcaatacctgtgaaaaaaaaaattgaacttgcacctacaggcttgccatccgatttgccattggtttcagcaaattctacagcctgaagtgctgttctagtattggatggacacccaaatatttttatcaaccaagtgaaccttccatgccatgtttcaattatctttgagccaaaattttaacatacaattttccgtgtatcacttgcaatatttactctttttttcatatatttgacctaccattggaccagccagagcaacagagaaacactgaataataatagtatgaatgtttgtcaaatgataatgatacaatgcgataattgcacatgtaacttccaaattcaatgacatcagacagtttgtaactttgtatgctcgatcatcgatgaacggtggtacagctgctccatgcttcaaacttgagagcagtgtaggttcaaaatatacaacacaaatctctacatacaacatttttttttgcctcactcaatactgtttcagcaatagagtaaagaattcccacaggcatctgatcttcaattcattaccggttcaatctcttgggaaataagtagcaatttcttgatttgcattgttttcacgatgcggcagacagaagcatggtttctgcagatgcttgtgtccccgttttgcatgcatgaattgtagagcagacgtctgtcgtctcaagaaacttctgagatttcaccagaatcaaaggggtatattcaaggaccatcttcttgcactgcaaaaattacaaataggactgccatgagaagaacagaactagaaatgggccttgcaaatggttaaaatggcagtatttcatcaggaaaaccattcagctgatacaaagttgcaggtaactaagctaattacagataaatttctaggtgctgggcttgatcagcgacatcttaatgtctcaaatcggtatatgcaagcacattcgagaaaagcattatagcatttgaaatgctttgcttacaggatgttaagtgattttctgtataaacaaccatgaaaaatgtgtttgattctttagtagaggctgatttattttgtatttccataaatgtgactaatttacctgctgtacataattatctgccttgctgcatgctttgagaaatatctcgactatctccagctgcaaaattacgaattcgattaagtatgaccccagcaatacagaattggttgtgaccattgaaaatctgaaatgatggcagttacctgcatgtcaggatcctttagcatgataagaacttcaacaagaacatgatggcatatgccgcatgtatctcctcgagatggtaggcgaagcatcgttccctttctgcagaagnaatttggggcccnaaaccccgttacaaattttagtgtacatcgaaacctccaagaagaaaaggggaatgtagtagtcaaccagagtgatgcactgtaacagggtaaaccattggcatacaaaaattagtctgacgaaattagcatgttctgattccaaggcgggcattgaaatttattcagacctgctgttttagaggtccaacgtttgcgcatgcatggtggaggatgctaagaatctcagtttgggtttcattttgttggaggtagaacagtgcttccgttgagtactgctcgcatagttgacac

SEQ ID NO: 3508 - DNA, 675 bp, Oryza sativa
aattccaataccttgaaagcaccaacatagaactcgttcccgagcatgtcctgaaccatcccccggaaccgaacaagggtattcggcttgatcaatccaagatttgattcatccaacaccggaacctggaaaggaaaatattcccacattccgtcattccctgaacttcctaagattcatttacacccacaatacaaaatatcctctttctctcttttttttgggacaagctcaacataaacatatgtgacattctaagtatctgaattgaaatgtttgcaagaacagcaaaaagcagttatctttcacccaacttagatctgagagcatagtacttcctaaccacatctactgatgattccaaatttaccctaagaaaacctttaatctccccgtctcatattcattatagacattcaaagatcactaactttgacgatattagggtttcagcgatctaccaaataacatcattttcagaaatcgacagctgcggcaaccatcaacacggggggggatcagacttcttaccttgtcaagcccgccttgctcgaagagaaaggagcggaacacctcggtggcgccccagtctttcccccggaacgccgccaccggctcgtgcccaccggactccgccgccgccctctcgaaggtggagcgcaccgcccccagggg

SEQ ID NO: 3509 - DNA, 3734 bp, Oryza sativa
  unsure (1)..(3734): unsure at all n locations
nnnnnnnnnnnnnnnnnnnnnnnnnnnnnnnnnnnnnnaaatcgacagctgcggcaaccatcaacacggggggggatcagacttcttaccttgtcaagcccgccttgctcgaagagaaaggagcggaacacctcggtggcgccccagtctttcccccggaacgccgccaccggctcgtgcccaccggactccgccgccgccctctcgaaggtggagcgcaccgcccccagggggttcccgacgaggtcgtactgcggccccaccatcctccctctccctctcctcgctctctctctctctcgttggggagattggggagcggagcaatggcgggagaagtggtgaggtgaggagggagaggagttatagcgggtggggttttcgcgccactggcggcggcgcttcccgccgttttctccccctcttcccgccaatgcgcgcctctcctggtacttggaccttggtgcgtctattgggcctaatgggccgtcctagcattcggcacgggagtgcggcccgtctgcgggtgcgcgctgctgccgggccgagatgcctccggcccatatgaggcctgcttattggttagcgatccaaatctggaaaaagtccactttgactcccttaaatgtaaaacgaatctaatttgtacccctcaaccagaaaaccggttagaacgactcccccaattactaaaaccggtacaaattgactccctcggtggttttgtaggacggttttgctgacgtggcgctgatgtggcgataccaacccggtcttcattccacgtggcgctgacgtggcgatactaatccggtcttcattccgcgtggcgcctacgtggcattagaattaaaaaatatctgtgggacccatctatcattcacatataaaatatatcgtgggacccaccgacatgtgggacccactgacatgtggggcccaccgacatcctttctccttcccttcttctttctcctccctccctcctctcttttctctcccccttttctcttccccattcggacgcatcagtggcggcagcggccgggtggattggcgacggatctgggcggcatggccggggaccctgcgcccccccccctcttttgggcgtgggtttcctcgccttgtgtgataactaatactcccactagctgctactactacatcactagctgagctaatgacgtcggcaagcaaccaacaacactaaattaaccaacttaatacaagcttattaagctagtgtcgtcgtcatgttgcctagctagctagctagctaattactactccggtgagtggatggcgccatgctgccatggcggggcaacaacggcagcacatgtccatgtcagcgtcgtcgtcgctggtacgagcgtttttggaagcccaactccacgcgaggggagccccgaccgcggtagtggccttccagagggtgtcggcgacggcgatgtccgcggtggagtgcaccgggacgatggcgacgccgtcgttgctggaagggagattcgggcggggcgggagctcgcggcggcggtcgagcctgaacgcgttcgacatcatctccttctctccggcaactccagcgccggcggcggaggtggagctgtaccgccgcggcagccgcacccggcatccgaacttcccaccgccgccgtcgcctcgctgcaggatacgcgacaacagcgaccgcggtgactggcagctctcgatgccgccgcagcgccgctctgccctgccttcgcgccggccttctccacccaccgccgcccacggcttcacgcactcccttgccgccctccgctccgccatccgttgcctcggcaagctctccgcgctgctcgccgacgggaagagaaagagagagataagggagagagagggggaggaagaaaggttggaaaggctcgccgacaggaagagaaagagagagataagggagatagagggggaggaagaaaggttgaaaagagaatgatatcgggaccccacatgtcagtggatcctattataatttttgtgtgtgaataataaatgggtcctacatatatatatttttaaatctaatcttacatcagcgccacatgggacgaagaccaagtcaacactgccacgtcagcgccatgtcagcaaaaccgccctccaaaacaaccgagagagtcaatttgtaccggttttagtaattgggggagtcgttctaaccggttttttggttgaggggtacgaatcagattcgttgtacatttaagggagtcaaagtggactttttcctccaaatctcgcgcacgcgttgaccgttagatctaatcgtgtggttcagatcaagttgtggaacgtgactgagtgaagtatattttacacataggcccttcaattaatttcataatattgctagagagcgcgggccgatggttgagccgtccaagagcggcggcggcgcggcgctccggcgagcggcggccggagtcgctctcccggttggcgttgtgtatgtgatagaaggccaggaacccgcgccattgctcttctcaacaggagcaggtgagatctctgacctgtcaacggcaaggtcgtcttcctcgtcatggaccttctctccctcccatggcgtcgcccacctccgaggtctgtacactccataaaccaacctctcctcctcccataacgcagcgttgccggatctacgccctccagagtctgaacccctccgaatcctctccgttgcgtgtctctggggtaaagtaggctatggaggagcaacttgctttctatttacttcggatgctaagattgttcatctcaaattgctaatacatttcgcataaagaaattgctaatacatgcctccagatgccttttttttctcaagtcatcctactgagttggcgactagtaggtgttaattgctgctagttttcctactgaacatacctaacaatactgttatgggtgaatttttgtaggctcagattttcttactgaagaaataacagaagcaatcgatggaataactcaacaacatctcaggtgtgctccgaacctcactgccaaagcaaaattctattgttttcactagtaagcaagtgttacctataaatcacacatgccaactcgttgattcagaacatcactagtatgtaatgtaaactctgtatatcagtatatgatgtgtgcatcctactggcttgtgtaactctaaagtaaataaatataacaccattatcacccatacttacagtgattcaaatattatcttgcgacaacactgacatggccctgattacaataatgcactgcaagtgaccttgatacagaaaaaagtttatttcaatacatgatacagagggctctctgtcttactgtagcctgttttctaatgggtattccccatgatactacaacagcaatggccaacccaaggccgaatcccaatccagaaaagaggaacaacacaatatctacggatttcttcttggaagggatcacattcagaattgtcatgttgatgcaacctttagatagcggaggaccacacaaatcattattccccagaaatgagctgttggtgaatgtcaagaaatgaagtgattcaggtatttttcccttaagcttgttgtaggataggtttagcatttcgaggaagtctaaggatgctaattcttgtggaatgactcctgaaagctgatttgaagatagatccaaagcttccagctgcttcagcccaccaagtt

SEQ ID NO: 3510 - DNA, 3043 bp, Oryza sativa
ttgatgcaacctttagatagcggaggaccacacaaatcattattccccagaaatgagctgttggtgaatgtcaagaaatgaagtgattcaggtatttttcccttaagcttgttgtaggataggtttagcatttcgaggaagtctaaggatgctaattcttgtggaatgactcctgaaagctgatttgaagatagatccaaagcttccagctgcttcagcccaccaagttgagatggaattggcccagtgaggaagttatgtgacatatttatcccatgagttaaaacaagttccccaacaatttctgggatgctaccattgaatgcattattggagaaatcaatgaatacaagggttcttagtatttgagcaagtgtggtgtcatgacctttgtatgtgagtgaggctttatatctatatactagtcctacacttggcacagcatgatccatgaccaatgatgtatttgtgtctatatgtagcatcgactccaacttcttaaaccacttgtctttgggcaacggaccagagaagttatttgaggatatgtcaataattattgcatttggaaatgcacatgtgctttcttcatcggtgagagattgaacgacatgtccaaatagcttattggatttcagtacaagcacttggagtctacgaagtttactcatccagcatgggaaaatgtcatttatttgattgttcccagcatcaaggatctccaaattttgacaagcaagtagggatctgggtagctgtccttcaatcctattgccactaaaatatagtgcatgaaatgagcagccttcctttatagtatctgggatctccccatcgagttgatttgcatttagatttaatatttgtattccattaacgttctcgatcaaacaagatggtattgagccactaaagttgttgttagagagatcaaggtattgtaattcagttgcagtacagaaagatggtgggatttctccggagaagttgtttccaggggcattgaaaagtgtgacatgactaagatgggcagtgaaattaaaaggaatcgatgagaacatgttgtttgagtaatctagcaatcttgcagaaccttgaggtataggtatagtcccctcaaacatgttgttgctaagatcaagccaatcaatttgtaaaggaataaaagggttagatccaacactagtaaatttattatgtgctaaaatcaaactagcaacgccagaatcattccaagactcccatgcccacgatggtatagccccatggatttggttttttgaaaggtcgagccaaaggagttcatcttgactcctcaagaaatcagggaatttagtgatgttgcaacccgataaagctaatatttgtagtttagggatgtgtgttgatgaagaatcgacttttccatccaccaccacaagattattatcagatatatccaagtaacggaggtgttgtagtccccataatgatgcaagtttcattgtaccgacaagattgtttgaattaaggaagagtgtgctcagattggtgaagtttgagatattttgtggtagttttcctgaaaagttgcattcatacaacactaattttctcaatttcgttaacttacctaaaaaagaagggatagatccagttagaccacacctagagaattgaaggattgttaaagaggtaaggtttgtgatccatgatggtatggttcctactattgttgttccagaaatctccaacgaattcaatgatttaagccacccgattgatgagggcagctcccctgaaaactgacttgcaccgacgccaaggttcttcaaatatttgagatttccaatggaacttggtatttcaccgtagaaactagtctcagtgacaaatatattttccaaattactagcaactgagaaatttggtaacgaatcagatagttctagattattgtaaagatcaactgttactaatttcttgtgttggaagattaatggagatacctgtccttgaagaaaattgtgtcccagttgtagaacacgcaaagaggagaaggtggcgaagtttggaatgggaccagacaaatcattaaaccgtaggtcaataacagcaagcgagtgcatggcagaaaaggatccacaaataggaccagagagcccacagtttggtaagctaagaacccgaaggttaggagtggacgaggatagagcatcgcaccatgtcatcccgttgtcggacaagtccacagcgccgaggtagagctccctcaattttttatgatttgcgattaaagtttcaaagtttggctctttgagcacgctagattcaactgaatcaaaggacaacacagaatgaccttgtgtgaattcttctacttcaaatcgagtagataggtcgagagatactagatttgttaggcgactgatgctagcggtaggtacctggcccacgaaatcggagctggagaggttgagataggtgagcatggtgagccgctcaaaccctgtctgcgggagttaggatccattgaagctgttgcaagcgaggttgagggaggttagatggaagatcgcaggatcaagaccgccgctctccaatctacgccctcccaggtccagagacgtcacacgcccatccccattcctgcagtggatgccctcccaatggcaacagtctgtgccggccttccatgacccaaaggtggaactggagtttttggtgatggagaaagaacgtttcaaccggagcagcgccgatgcctggtccggcaagcatggaacaaccgccggcggcagggctccggtgtggttggcgtacgtagctgctgatgaagaagggacaataatgagctgggtgtgtaagaggatcagcatcaacggcaacaccaatggcttgtaacgggtcattgtggagtagcaactagcaagtacagcagtttgattgggtttactgctagtctgctatacgtaagagggtgtatcgatcggtgtatggacggaggattctaccgcataccctcgcacattcttatacacgataactcgccaactcggattcg

SEQ ID NO: 3511 - DNA, 3007 bp, Oryza sativa
cccccagacagcaaatggccatgacagtggtatgatctgcagggcctgggccggctgatggatttgcttggcgtggaactgacacgctctgcaccgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaagggatcgggtcgcgccgacggctgggtcagcctttcttcaaaggcgcccggtggggtctgggctcgcgaggacgcgagccgtgagagttcgtcggctatcatgttatcccttctgggtacatgccgaagttctatcccatcgaaatggcgctccatacgccgcacttggcgtacgtaggcgtccatctgtgggtcagagcaccggtactccttacagacctggttaacgactagctgggagtcgcctaataccaagaggcggcggatccccagtccagctgccaccctgagtccggcaaggagtccctcgtactctgccatattgttagtcgctcgaaagtcgagacggaccaaatatctgaggacgtccccgttcagagaggtcaacgtgacccctgcaccggcgccctgaagagatagagaaccgtcgaattgcatcacccagtgggcggcatgaggcagctgtgaggggttcgtgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacccttcggtggggccgatcctctctgctaggggccgtacccccggggcgttcttcgtccaagtggcctctcggggggcactcgtcttctgtgccgatgacctcggggtcggaggacgacaggagcggccttccctcagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggcctcggggccttcctgagggtcgggggcacccagcaccgtctgacaagcgggcagagggccgtctccggtcgtcaggggccttaggccaccgtttgactcgggggcctctcctccctgcttgctcccgggccaagttagcacagaatgggggtgcgcagaatgaggattgtcctcatcgcgttccacaaccaacgctgcactaactacttggggggtcgctgctaagtaaagtagcagggattcatttggctccggggcgactagaaccggaggagagctgagatacgccttcaactgggcgagggcattttcagcttcctccgtccaagtgaacggccccgaacgcctgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaggtttccgctagatctgaaagtaaagtttcttggttgcgcgtttttacaaccaagtcatcgacaaacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcaaatctgatgataaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacatcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggg

SEQ ID NO: 3512 - DNA, 1893 bp, Oryza sativa
  unsure (1)..(1893): unsure at all n locations
ccttcatattccagttaaacacctgaactttcatgatcctaagtaacactccattaaacaaaactgcagtataacaactgcaagcgaaatggcacatggcgcaaactatcgcagtagtactttctaagcttctcccattggtgcacaatgtgccattgcaattcaacaagaacaaaagtgttctaacgatgaaattgatttcactgcatgattacctgcacaaacaccccatcgcagtagatatctccgacgcatctaccataccggtcctcatcatacacatagaccttcaggctctttccctgcaccattttcagaagcgcctcttttgcctccttgccgtacggcatggcgctctccggcgcatcaatccccctgcattttcatttcatttcatacgaccacctcaaacttgagaagaagaaaaacggcagaatcatttgctcattgatcgagtgatcaagagatagtagcacacagaccttagcctgatcctgtacttctttgcgagcacttcctcgcctctcgcattaggaacttgcctgcattgaaaacttcagaattgtcacacagcctgaaccattaaccatctctgaaaatttaacaaaaaactgattgatcgatgtgaagtgcaagctgatgacctatatcctgcatcagctatcatcttctgcaacccgtcggccttctgataatccctggccgcgcgcgcccttgtccgttccgccgccgctttctgaatttcacggggaacattgccggactcccgaggatcggccgtgtcaatgtacacggtgatcgtgtcgccgtcggccacggcctttgcatcgacctaagaaactagcaggtgcacttgtcagtccaagagcctttcttggcatgaaaaattcagatgatatttgttttttttgcgaggaaaattcagagattagaaagtaataatcagtctcaccgggagagtgtgcagctcaaacttgcaaccttgaggttttgggacgtgtgcagtgtgaggcgcaggggtacttgctgctgcatttggaattggaaggccatagaaaaccaagaatccctggacaagcataaacaggcatgcatcgattgttcagactttcagaattcaagcgcctagaatatgagtatgatgacattggaagtttgaatctttgagatatacctcgacgtctgctttctgatgattcttcagcgtggtgacgacgagccgcgcggcttcctccggcgtcctcggcgtcggcctggctttcttccatgtcactatcagcttccttgtacctacagcaccaggaaattttatcacagtagtactagactactagtgtccagggcttacaaaatcatgcgattatcacgcgatttatcgcgtctaataatcttttcagtttttaaaaccacggtaaacacggtaaacacacggttaccgctaaaccatgaggtgacgataatcctgatcccaaacgatttagtaaaccctgctagtatcatggcagcggtttgaggaaatcctaccgtgcctactggctaatgacaattactgcaagcatttatgactgatttaatttaccgaattctccactgcctgattaagcttcactcaattattgcggttcagtttagtaaagttatctctcgatacccctcgacgtactgaaccacaannnnnnnnnnnnnnnnnnnnnnnnnnnnnnnnnnnnnnnnnnnnnnnnnnnnnngaaaaagaaaggaaattctcttttccaaaagaaagaaatgaactttgttttttcaaaaaaaaaagaagagttattttcctcttgaacacgtcgctttcaaaattttcacacgcccaatccctcgcgattannnnnnnnnnnnnnnnnnnnnnnnnnnnnnnnnnnn

SEQ ID NO: 3513 - DNA, 2340 bp, Oryza sativa
aagatggttgtgaagctaattcatcatgaagtgtacccgtgtttcttaacgtgcctggccctaatgaacacacatgctatttattacagtccaagttttgtttaagaaagatgattgtaggcttatagttatagcccagttatttacaataaaaaatcaagatatttagttatgactagaaaaccatatgacaaagtgagtatcataccgtcgtatccatccatcattcgtatgccatgcagcatttatcaagactgtcagttgtctagtcgacatcgagcatccactgccataggcttcattctggtcgagtcctgaaacaaactacttccaatcaacgttatctcaagtgaagcactggaacgacaaagaaaaacatgtccgaaaaaataatatagttgtgcttgatagaactccgagagattccttacactgttctacgagcagcaccattcagagtacttcagccaccactgtcaccaactatttgcagaactctttccttcagatgctgaatcatctgcaagagatcaacagaaagtgacaataagactgtccatcttatcagaacaggatctctgtggtgtgaagaaacttacaggatgagaatttgaagcccatttttcagcagaagtggcagcctctttgagatgtgattttttaggtatctcgtgggagagactataggtggagctctctgtcgcctcagctacccacacgtgcctcatctggtctttatctcgcttgaccagattactaaaaccaacctgagaaacaaacgtaacagtgagttaaagttgcacttgcactacaaaggggtaaagctgaagaattatgtgaagggcctgcagaaaagaaactgggatatagctcgtctacacagaaaattacacgaggcactgtttaattcataactactcgcatttcatatgggactcatgaatttcggacttcaaagattagtcaacttgagatatagtcagtgcaatggaagatcacatactatatgtccagaaagggcataattgaagaatgcagaatcctcgccagtggttttggaagaaaagctaactgccagaagacagtcatcttgctcttcatacttttctccagagataaatttagatccatctgtcaaaaagagccactgcctattctggttgttcaataaataaacattcccaacatacaaaataacacctgcaatgtcaaattcgctgaaacaaaaaggaacggctcattataaaaggttcataatacaacaggagattcagcaagtcagcttgagacagggctgaccttgtaagtggcacttcaccaaaatgtgacaattcaactgctttacgaggggtgaaaaatggtctgcatcatgaaaaagggacatggttaagttttctaaatgcagtgcaaccatcatgtccaatgaggtctcttactcaaaatttgtagtctgtgcggttgctaaaggcgtccatgctgtagatgatcctctaccactcaagtagaatacttctgtaaagtagcttgaagccaacagtcctgtgacagaataaatttgtccttccaccaggtcggatttctgccagtgggcaatacagaaatgaaaattgttttaggtatatttgctcattagcacataactatggaaatattgcaaagaaaataggcatgtgcatcttgttgtcctaaagacatatagcaggtaacgctacacacaaaaatatatgacaatcactggcttgttttcttgatgacataacaccaaatcttttgttctttttttctgttcataagaaagaataaagatgatttctgacacttatatgctgtagaattattgtaccgtacttgcttctcggtagggttccaaattgttattaacccttccctgcagccagattttgtggcggagtgtttgctgataaggcccgtcaccctcactttcaaaaatggtgtaacatctcttgaactaagcccagcaactttaagagcattttcaaccttcttagctacttcattttgcctgacaatctgcaacataatggtgtagtttaaaaaacataaaatattagcagacagatgagatgctatagttatgcgtccagaccttttgcttttcttgataatatgagaaagacagcagctgctctgaattcatgctggacataagaatttcaggctcagctgccctctctagcattttgcatatttttgccccttcatcgttatcatcagtgttgtcgcagtgttctctcatgttctgactgaatgtcttctgcaatcttagacactctgcataagggaattattattattataattataatttataatggcata

SEQ ID NO: 3514 - DNA, 2870 bp, Oryza sativa
cttagctacttcattttgcctgacaatctgcaacataatggtgtagtttaaaaaacataaaatattagcagacagatgagatgctatagttatgcgtccagaccttttgcttttcttgataatatgagaaagacagcagctgctctgaattcatgctggacataagaatttcaggctcagctgccctctctagcattttgcatatttttgccccttcatcgttatcatcagtgttgtcgcagtgttctccatgttctgactgaatgtcttctgcaatcttagacactctgcataaggtaattattattattataattataatttataatggcataaaaagggaagtattggtgcaaatacacagtttgtgctactcatgaatattactacgtccacatttaaatatatgacgctattaactttattcggtctttgatgtgcaattttgaccactgtttttttctattataatattgtaaaagtacttataaattaaaaaatctacccatatgacatattttcaaactaaatattttgagagctattgacaaagtttcaaaaatttgagcaaataaagtcaaaagtgtcacatcacatttcagtgaactagactgatgatgaaccccaaaacatattgagaaagttttggacagaaaaaaaaaaggcaaacaggaagtatgcttcaagaaactggatgtatccatgcatgattgcttgtcttctatgggaggtgtgataagcatccattgcacttaaattgtgttaagtttactccaataggagaaataaatacctctggtgatacagctgtagtgcttttctttccatcctttcagacctcaccacaaaacgactgtcagaaaacttgaaacaaacaattcagtgtgtgcaactgagagagagtttagtaatggatttatgtccagtagtacacctctccctgtacataacaggataaatccttgtaactccaaccagtgtcctaggaactctgccacctgaagcttttatgcacttgaatgccagtgggactccagcatgcttgcctgagatgcgcacaataggttataaaagacaacccagctgtataaaaataatagaacagaagtgtccagttttgtgctcaaattacatacataaccccaaagtctcatcccatcttgcacgataggtgccatttatgtggatcattaatttgacggtacccgatgcctgtaaagtgagatcaacaaaaaattgattatatggttcaatggtagtcaatgttcacagctaatgaggttaaaagacttagaagattagtcaaacctcatgaaatgacacaggcccagcccacccacatagtgaagctaaaaaactccatatctgccaagatgaaatacatattaggtgctatgagtaaattatagtcatgtctcatgactagttgaaatagcacagtacccgaagcttctgtcctataaaaagttttcttttctctagttgctccaaaagtgccagatctaatgacgcatctagagaatacctgcgaaaaggaaaaggttctaacatctttcagcttcaactcgtgcaatacagagaaagcaaccacataccatccatcagttagttcaatctttgtaggcatgttccttttagcaggtctcaagcttttattctcactgttgtcgtcgtctgtatgtgccctatcatcctctggcttactgttgtttaggtcaggacaagagtaaatagcagaaatgcacagcaccatcatcaaagatggtgaagcattcccttccaaaattttctttatggctgagcggtggccattgttcacttctctgtcatacctaacatgcttgaaattttcattaatcaatcatatgcgtccatacagtaggaatggcagaaaaggcatgtcaactatctcacctgtacttcagctcttccaaaacattaccaacttttaagaatttgccagcagctctagttggatagcatctctccaatgaagcaagcttccaaacaatccatttgtagtggttgctgacccatctaaaaaggaaattttcgagtgttgatgttcaggatttaattgccatggagtctctcaaagaatccagcctaaatactatgatatgcccccaaggaatgcattatcacacttataaatcgcatgccataggaagaacatgtaaatccatttgttaatcctaacaatgttttgctatggaacagagacagaaaaaagaatggcaccgaggagacatgaaaaagatattcacaaattatgccttcactagaaaaaagtgaaacagtaaagtaataacaaacatgtaccagcatctgaaggccaaccttgtatagtgatattatcagtatgacaatgaaaaacgacgatcagaattaagaatgatgcttactctttagttgtgtatgtcaatgaagcaccacaggcaagaagcatcttctgaaattcttctgcaccagtatctgttttaaacttgtacttctcagccttttttgcatccatgagcttcacttcatctgttacatcttctgtctggtcacaagagttataagttaacaatgtgaagaatatagtgcacctacagaaattaactgcaacacaataaataccaaatatttgaagcatgggggaccaccaaaatactcttcacacgattttctttgatgttgaaaaggatagcatgaagatagctttgttcgacagggattaatctgaataggtagtttggatactcctgtgaaaattagttcaactaatcaagtaggaaggaattttcagaatgttctgacatgtctaggccatcagcttaccagaaggggatggattattgatgttgataggtgcgatgaacctaacc

SEQ ID NO: 3515 - DNA, 3951 bp, Oryza sativa
ggcttggatatctttggaatttcattgataggatgaaaatctcttgccgcatgaagcctgacggagtttccgttagccaaagtggcatcaggtacagcatattccaaggaatctgtgtgcttcctatcaggttttgctggaatggaaaattgtgctggctcagttttgctgttccccctacttttcaataaatcaggttcaccttcttttcgcagaccagttgaattttgtatattctctttacaagcagatgctgaagagtggcctaataaattatttggtgaaacctctaaatccgattcacccagaagatttttcgcacgctgaagtgcatcactagaaatagccattgttctgccgccagcagtgctgaacctgatagcttgctcactagaatcagagaacgttgttttagaaaatgcaaaatgctgatgtggatccataagtacttggttttcagctgggccagagcttatagggcagccaccagaaattccactgactgatgctacaccaaactggtgctctgaattttccctctcaacagttatctttgtacctagcttatcacccacatgtcctaaaagttgtgttgaaagggtattctcctccaaacccaacaaagttgcagctcgagaaacaccaactgaagatatatgtacagtccttgcatagcttgtcttgagaggtgaagtaaagatcggaatatatttgtccacattgctaagttgtttgtgattttctgaaaaataatacctcaaatcagaaatttctaaagaaaaaaaatacttatatgttgaaaagtgcataacaaacatcattttcaaatttgctaatactatttgataaactagccatattactacatcataacactacaacaccttattagaattcgcatgctgatcatactcatacatcatgcatttggaaatctgtactcatgtgaatattcatttactaacaatgacataaaagaagttgatacagcttcctcaaaacaactagatacataattctgattgaagagtgcacaacatcggttgctcattgctagttttctcctccagtgaagtgggcttaattttcaaccaaaaggcatagaaatagtactacaaatttcataacaataaccgcccatccatgatttaattattccacaaagaaaccacaggagcacagactagccacctcaacaatcgaacacacattcatgctaaaaatttatgaaataacagcaatctgtgatgatctagcagacactaatcaactcataactaaagctactctacttatccaaacaactgagaaaccccagatttcacaggatcaaagaagatgaattttctatcaagatgataatgcatctttaaatagaaatctgtacagatacaccctacttttactcattttcatggatatgaagtacagagatggcggagaaatgcaaagattggtggaaagatgtgaggtgaaacaagtggtggatctatttctcaaaaaaaaaaaacctcagaatatttccattggcattatacacacctttcttcataatgacttcttcctccagaaccacccttgccttctgcacggagctgtgactaatcaagactgacttcccagatccagttcgaaacattggtggttcgtttccacggtctatgtatacttagaaaaaaaggtcatgttaatggaacagaaaacaaatatacctggtttgcttttattttttctgaacaaaaatttgaattaactgtgcaaagacacgctaaagcgcaacccagcaattaaaaatttaccttctttcatagagctcccttgctccatgagggtgatcgccttatgacttgagtttctattttggggtgcaaacttctgcattccagcatggagcattggagcaatggcttctccagtgtcattatttactgatatgcacatatgaaatcaatattaaactgagagttagctgtgaaaagctattcataccaactttttttgtgaaggagctatgaattgagaacatttatttaccattttttactggttcctcgccctctaagacaacgtgggctttctttctagaattttcacttgctgtgatagaccttcctgatccagttttgaacattggagtggcacagccatcatctgagtgagcttcatctaacagatgaactttttgttaacatgctacatgcctcctttatccttggtagactaataaaaacacatttcaatggcaaaaccacagtaagcaacatgttgagtgaaacctaccttccagttcttttgtaatgttccttggctccagaagtgcacttgctctcttaattgagcctttacttactgaaatggacctccctaacccagtttgaaataatggcaagtgaccatcagcctccaaaaaatttcctgttggatgacagtgattagtatggcaaatatctaaaacgcatcaacagtaaatatttttattgttccaaatttgactagatagtaacacaggtttaaatgaaatgaaaaaaaagccttttacaggaaacttcagaaaaccatgtaccttgcattgaaacacccccctcaggtgtaacagatctatcattcatagtcaggccaccactcatcagaacagacgttggtgtttcagtttgaaaagtagtggtggagacattagtatctccatgtcctgaacccaatagaaaaataagcaaagctgatgaccttgtgcattatgcagtaaaaaaatacaagcctgcacacaaagtttcttaccacttcttttggcacattcttgatctaatactgtccttgccttttgaattgaggtctggctcaccacaacaggcctccctaaccccgtttggaacactaggaattcacggtcagaattcaatttccttcacacagagaagaaatcactaataacaacagctacatttacataactccaatcttaccaatattttcagcacctccatccttcaccacagagctagatctttcactgatcaagactggtcttcgcgaaccagtttggaaaatcagagattggtcaggcctaccaaaatcttccgtgttttctactatgggaggaaagttcattacaaccagaaggcgcacatttctcaataattaggtagaagtatttaactcaaaattaacaagcaggacaatctaatcttatcctcacctgtattattttgctccaggacagccttagctttctggatagatgctacactgaccgatacagctttacctgaaccagtttggaacaatggaaaattttccttgtcatacacatctgccacatctcctgaaagatcagccgttcaaaaagtaaaggcatgattagaattttgtgtaaaattttgctagatgaaattatagaatattctgtcaacagaataaccttgttttggatttgtttgtccctccaaaacagtcattgcattatcagtggagctcctgctgactgggtctggcctaaccaatccagtatggaacatagactgtacagcaatgacagaagaattctcggcatttcctgaataatagattacgaagattcattatcatgatagattgtcgagtgctacacagctcaaactatcctaaattaattagagccaaatatatgtcaccatgcccaaagaaatgaaacattctgcgtaattacacagaaagtaagcagatgacaaacttcctaccttctaaaacagctctagccttctgaattgagcccttgctcagtgaaaccattttacccgatccggtttggaacatcggagacaaactatctttatgtacaccacctgaatttcataagatgcaaaggcgaattataccattgaacctcgagaatgtgtaactaatcagaactttgtacttctacctacagttgaatcatccaacctgatctccaagggtaccgagctcgaattcgcc

SEQ ID NO: 3516 - DNA, 580 bp, Oryza sativa
gccgaattccccttagcaggattggtgatggctgcatgataaaaaaaattgggattagttattttaaatcaacgctaaaactgttaaaccaacttctgcattcaagattcagtgctatgtacctcaaccgcaggaggccttggtagaaaatcatgagcagataagtttctccataccaagcagtgaagacggggaacctgtacaaatatttacaagcattagaagtcagaaaaaaatacaaatatgaatacactttcttttcattgttagatatgaaattgatcactatgtagtatgtacttttgatgcatgtaccttactgggaggcagctgagcggttacatcttccataaggtcaaacattatatcatccgaattatcgttaggagcagcaagttcagggtcaaatgtatatacacctatgaactcagaaacatcgttcagtttcacctgactttcaggcatatcatacacctgcaaagaatagttcaatccgtaaaccatagaaaaaaaagattgaatagaatgcatttcatgcagaaagcttaggagctctaccttcactaggcaggaaaaggag

SEQ ID NO: 3517 - DNA, 3357 bp, Oryza sativa
  unsure (1)..(3357): unsure at all n locations
nnnnnnnnnnnnnnnnnnnnnnnnnnnnnnnnnatccactgaaatctgcagttaatggcctagttagcaacaaactgatatcaatggaatggacagtaaactagcagttgatcagtgttaatatgctatactagtcgctgccgacaagagacagacaggattaaataaaaactctcagcatgtgagatttcaagcttacacacattctgaagttattgcagcagtgcaaccgtgtggcttgtcaacttctgcagcagggaggatgactcctattataagttcacatctagctcgaggaaaaatataatcagaagaacagatctggtttcatccaagtggtaagctttttagtagtaccagcaaaagtacactgcaatgagtttacaatgtgcagaagatgaactcctatgcaagaactggaaaccggtacaggacattctactgcgaatcttcagagggtcagaaatacacatggccaaggtggtaaatgggctggtaaatttctgcagctaaaaaacagagaagaaataaaatacttcctccagtgaaaaattacagctctccatcactaacattttctcattttatagtttattttcgtttgtccatagcaaatttagtttacattcttctgtcagccaaagtcttcagtgaatcacggcttcatgtcgctgtacatccttgttcaacatttataagcagagggtttggttgaagagctacagaattgcccatgccaccataatttgtgaatgcatccaaagctttccatatcggaaccatcattttgactggtggatacaccttctgcaaattaagggactccgtcagtcaacggattcctcgtagtgcacttgaaaccaactgaaagcaggaaaaatttaccttaaaaacacgcacgagtttgtcttcgctgtgtagaagcaacactaagctccagtaacatgtaataggggtcacatgctcattcaacactggctttaggagcttgccaacgggcacaaattgacgatgaactcttccactataaaaggtagctttgatgaagagaagataaaagaaaataaatctacgtgctgcagcatatataaaatctaagaaacatgggaagtgtctctgcaatgcctgtattcctgaaaaactttgcatgttcagtacattttctctcaaaaaagagagaagtatttgtagttatttaaattttgaagacttcacttccactaccatgatacccctatctatttgcaattgccaaagtccccttggggtgtcactaaaatttgaataagtaagagtggaacttattgcacccctgtaaaaatccaaattggatcttcatacctccaaaagtgttgttctagctgaacaccaaaggttggcatgatcaacaatgactctgcacaggattaaaatggtatcaatgaggagcacacaattgcacttccatataagcattcctaatcaggatcctgagtaacaagggtatacatctttatccttccttcaggtaaaaaaataactaaacaatcagtgcaaaatgcacaaaatagataatacagacactgcccacctacctttcttcacaggcttatattttaagcattttgcaacggcaaaagcaaatgaaatactccaaaaagaattgatgcatagactctcctgaaacatttgagcacagaaagtcagaaactcattaaagtcacaagcgtatggtgacacctttcttctctttctgaatcttaagtacccaaacaaaatcaacatcatgtgagtatcactgacaaggcatgtatgataagcttgtttttgaagaacctcacatatctattcacatcatgaaaaatgttggcattcagcaatcagcaaataaattttttgggagaatgcagtaggtcactgaaatagtgaagactcagctaccacttgggattatcatccgagagaacaacgacctttaacagcaaggcatgcagtacattcgcaaagaggaaaatttcgccgacataagagaacagcaccctgaatttgctcctcttgatgtagatttcatggatatcgaatcctccctcgcagtgatgtttatacgtgtacacgccactcgacatctctactgctcgattcttcatggtttcaggctttcagaacatcaaaacactcgaagtcccaaccaatggcgttcatttcagaagctttcaatccttgaacgaacctaacaagaacaacacatccgcccaaatgtctagtgaatcccatgatctcctaactgctgatatagagaaaaaaaacgcatcactgcaaattaattgcgcaaatttaatacggggagacacgaaaaaaagaagtctgtatttctacatagcattatcaagtatggtgatgaaacaacatccatgcccacatcaatgcaccccaaccacccaaaatgtacagcaaaggatcgacgtgagcgcgcgtacctgcgaatgaaacgcgagacgggtttggaggagtaaacgcagacccgccgccggcgacggcggcggcggaggagtaggaggacggctgaacgggtaacctaaccacctgcagctgcaggctgggatttctccgtgaattctaacgcgatgcatcgtagccgtccgtttgtagaagtaataaattgagtaaattacagtttggccaatttttattacaatgccaaagtttcactgtgaagtttgaaccaccattccaactaatgtttttattttataaactagataatttaccattgttgtactttaggccaccttacttttttttcgaacgcgtaaaagaattacacgtcaatatattagaagaaaaggagatttgttacacaacgcaatcgagcaggcaggcctatgctagagaggagggaaaaagaaaagggaaaaagaactagtagtgcaaaaagactactccaacatacaagagggagggggcggagcacactacactcctagcaaatccccaaagcagcaatgcccgcagaagaccacagacggccttccgagtgaatgggctcaataagcacagagaccgaggatagtgccgagtcaaaaaccctggagttccactccttccacagttgccaagagactaggaggaccaaggagtcgaagcctaagcgaagatgctcgggtaagcaagccctagaagatggccaccaatcctgaagcgaattgccatggagaggggagagggcagtccatccatgtggcgacaatgcacggtgtcatgtctaccgagtgaacacacgatcgagataagtcacttgactcttttttcaaatacatcaatgatctagattatgtcggtttcttgcatattgataaagttttgaagctttatgtagac

SEQ ID NO: 3518 - DNA, 896 bp, Oryza sativa
tggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaatctgccctccccgggcaacacacggtgggtggtcggtctgatcaaaggtgaggaccacctccgaccaccgcgcccgacgcgtcgcctcatgagtaggggccatggccagaagctctcgcttcatagccttgaagctccggcgagagacgtgagcacacgctcctccatcgacggtggcgatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgttcagccaaatttttgactgcgcgacagtccgcgagatcgtggagggaggtgttgtggacggagcaccacctgccggcggggcgctccttgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgcccagtctgagcggcggatccgggggcggccgaagctgccactccggaaccgaaggagttccatgtccacgcttcctccttacgagccactcggtccgcgagctgaaaaagctccgcggtagtctggggctctttggaagcgatctttt

SEQ ID NO: 3519 - DNA, 612 bp, Oryza sativa
ttgttgattttttttgtgcaaaaattggtcttgagatgggctgaaatccactgtattgggattctgaagcgttcctgtaagatctaacactagatttggaatgtgagagaggaggaagggatctatttgaggctttcttttggccatatggagaaattttagttaagcaaccggagggtaaatctgtctagtcaaccattttggggaaaacttctgcatgattgacctctgagatgcattctggtcgtctgatgcacacagcttcaactttcagttggatactttggagttttaactttccagcttctgtttctctaatctgcaattctgcaagcaggcaaaatgtgttccataaggagctttgcttttgtgctggtattagcattttcagttgcagtcgcggagagcagagattcatttaatgtattgggtaagtcatgaattcattatgagaatgaataatgttactaatattttctccattcttattttcatatcaattggtgtttctgatgataattctaagtagatcaagcgccgcaatggcaagcaatataacactctctacagttctaaaatataaaggaatacatttatgtgttgatctacatt

SEQ ID NO: 3520 - DNA, 1600 bp, Oryza sativa
  unsure (1)..(1600): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatcactctgcgtcgacgacctcgtcttacgccgcgtccaaacgcgcgctggattgagcaagctctcaccaatgtgggagggtccgtatcgagtgatcggtgtcccccggccgggctcggtacggctggccacgggcgacggcacggagctgccaaacccgtggaacattgaacactttcgtcgcttctacccctaaaaggggggggtcgggtgtcaggttttggctcgggccaaccccgcacccccctcgggtgtgcggggttagccgggggctaccacacatgcacatatattcctttcagcatttcaataaaagcagtttcaatttcctaaaggttgtgtctgtgctgttctttccttttgaagaatcttgacttaaaataaggtcactcgtactcaaccttgccctcgggggttcggttcggtcagctaaaatcgccaaacggggcccagaaccgacccgtgccccggggcgtggtgaactccgggggggaatcggcaaaaacccacaatcgggtcacccataaccctcggtcaccacgttcccggcctggccagtctcgacatgtggatctccccaggcactagccccgacccgagccattcgaggaccgggacttgggcgcgagcccttatttcaagctaaggcgcaaaaggaccatggcacagatcatcctcaactcatatgcatagcaaaataaagttaacatagaaaatttttcatcatttttgattgcagattaagttgatctatacacaaaagaggcatgaaggccttagaagaaagaaaaagaaaaaaagtaaagattggcgggggcctgggggctcattcaaatgcacccgggtcgctggcctcgtcgccaccgtcgtcctcgccgctggcgtcgccctcctcgtcggaactgggggcgaacgcgagccgagatccccgagccctcgaagccgttgacgatgtggtcggcagcatccccgacccgcgcgcgcgcgtcatcctcggtcccgggagggaactcctccagcgccatccagggagagaagttggggtcccgggcctggtaactcgctagcacgagttcgaccgccccccgggcgaggtccctcgaggatgccttaatggtcttctcgagctcctcggggagttgctcgagaacccaagccatcctgttgaggtgcggagcgaggccttccagattggtggggggcaccgacgtctggcctccccagagtcccgcttgccgaccggcgcgcttcatgcgggagaccgcatcccaaagcatgtcgggcccaatctcgcccgccaagcgaagggcctcggcctccccggtggaggagtccagcgctcgctgcatctccgcgacggtgtgttcggcagctgcgannnnnnnnnnnnnnnnnnnnnnnnnnnnnnnnnnnnnnnnnnnnnnnnnnnnnnnnnnnnnn

SEQ ID NO: 3521 - DNA, 587 bp, Oryza sativa
cccaaaaaaccgaaacattctttggcccattgcctttgggcggctccacaaagtattttcttaagtgcttctagattctgaccatttgtatgttggcccgccccatttgactgtgggtgcacgacagacgcgaacctaatttttaggttaagcccttcgcacatttctctgaacttatcagagtcaaactgctggccgttctcagtaatgaactctttcggcacccctaaatggcaaacaatgtttttccatacaaacttctgtactgctgccgaagtgattaacccaaggggttcggcttcgatctatcaagagaaatatttccatagctacaattgcaaatttatacccgtttcgcgccaccgggaatggcccaataatgtccagtccccatctggcgaagggccatattggtgcaatgggctgcagatcatactggggcacggcttggctttggccatgacgctggcaacttttgcacttcttgatttgctcaacacagactttcaacacagtgggccaataaactccttgtctaaacactttggaggccactgttcttgcagcctggtgcgaaccacatgata

SEQ ID NO: 3522 - DNA, 22002 bp, Oryza sativa
  unsure (1)..(22002): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctcataaatgtcaccatcataagggtacccatgtaaattccccagtacacattaactctacggtgcatgagcttgtactaaggctataaatagccccctaggggcatgttatggggggttctcaaaaaaattcctttaattaatacatattgctttactttctagtgtgtgaactgtgtgaaccacgtctttcgatgtacgcagttgtcattcgataacatatatattatatttacttgttatatatttgaacaatcgttgttacacaatgagtttcgtgtgttttcatttccaaaggtacttgcttgggtgaaggaaaagagatcgagcgtaaggaatgcatggatgatcaaaaaagttgattaaggaccaaaccaagaccttctccaagtccacttgtacctcaccacgtcacttttggtccatacaagacaatagataaagttcaatacgttttggattcggatttggacctcaggacaggatcaatttcaaacggacctagccgctgatctagaaggaatctcagggcccatgagttcttgctggaaagcttatagtgtctactttgagatggtttttgtcccacgtcaaaattcccatcgagctgtcgggaatatacaaaacaagccacatacatccagtccgaatctgatttgagtcttaggtattataattatgtcgtgggctaaacccaatgggttctacgccctagggaaaccataggacatcctaaatcatatttattcagtagtcatcatagtttggaattgggatttgcttaaattatttctgtcattgtaatttcgccgctagatcggtttgtggaaccccaaagtcaagtgcttaatcattgatatgcaattgtgttgcaatctatcttgctcttgctttgtgttcttcgattcgcatgtagggattagccttctcggcaagatcaatcgggcagtgcacggttgataaacagaggagacgtggtgctgcgtttgtagggattggatcgtctttatcagaagccagaacatatatgtcaagtttttgccaaatcgagtgttgtcaatacctatcgaaagatttagacctagtttcctaattagtatctacggtcagactgatctacatcgattcgaggataacttttaactccattaaaagttttggtgtttgggtactataaccatattcatcttctggttggcttagtttgccgtgtgtagtgtgtatgtacagtatacacaaatatgcggccagacaatcagacatgctgtgatgcagataacatctaaaaacaataaaagaaaaaggaaactagcggtattgacttgatgatttttaaatgtctctgcggtaacgaacagaccgggataagagcgagatgaatggaggagcggcagccaacgagaccttaaaacaaaaggaaccccgatggtaataagtacatgatgacaacgaagagggggccgacgacaacggatggacgaatataggggatggaccggcagggtcaacagatatagctactccttccgttaaaaaaaaaacttatgactcatccagatacataatcaaatttattattaatgggaacaataaatgaatcctatagaggatatttttttataaaaattcattacagtgcgcataattatacgaaggacaccctacatatcataatttcagaaatcgatggatcagtatgcgtaggttatttactcatctatatgccaaaccatttggtaattaattaaggctttggtcatgacatatcttattgtggcattcagcattagagcaagattaatacaccctccggttataagacgttttgactttgttcaaagttaaactaatttaagtttgactaattctgtagaaaaaagtttgactaattctgtagaaaaaactagtcagcataatttcattaaatctataattgaataagttttcataatatatttgtcttggttaaaaatattactattttttttataaaattagtcaaagttagagtagtttaactttgatcaatgtcaaaatatcttataagctaaaacggaggtagtagcataccttgctatatgcagcagggccagttattagtttgtagatgagctacaagtttgtagtgatttatatatatatatagttcacattatccttgctcaatgttaaatattggctccttaattataaatcaatctataaatcactacatatgctattttaatcatattattgttagatttttttatctaaaaaaagtttatgggaattttattttgatagtattgatatctaagttggaacttctatcgggatgatagccatatcctataagttgttttcttatggtcttgtaagaattctgaagcaattaggagtccaactctcgtcccagttaatatgcatgattcttgggaagagaatcagcaaaaaatcaccttggacaatttatttgcaaaaaatgtatgtctatttaaatcgcacataaaaaaatcaggtcaaattttcattgtaaatatagatttctttattatataagagcagctaaaccttatttgcagccactacaggagcaaccgttcatagtcattatggataaatcctttacataggatgtttttaaaataatttcttatacgactccttatatattttgaaaagtaaacgaacttaaaaatcgactcaaatactaacgaagtataaaagtatcagccaaagcatctttaattttctttaatttttataataatagacaaaacatctttaatttttttaatttttataatagtagacatatagatatatcctcgcgatagcattgtttttgaatagtccgtaacgcgttttacgccctcgaattaattataatcgcgtagactgactaggtagagcctcgtagaaattaatgatcagctgcctagcaaccagggcgaacctggtatcggctaatgcttctctatcaatgccagcgcaaaacgccatcaaatgttaaagacttcagattattacaatcaactgtggttcttacacgtttcttgttgctggacacaagcccagaaaacggcaaatgctccgtcgtaatcagataatggctgcactatgcgctgaccggtcgagagaagactagtgtagtaattcgaagttaatttaccaccagctactcctcctagctgtacagatttatcgtattagacgaaccgagggagtattttacatagagttttatattttttttactataagattgtttagtaaaaattaatttcttatgtacttatgaaagccgctataatgtaacttatacgattcaggttgcacgtacgcattcaaattatctctgttcaataattaagtagctataatttttgcaaaaattatactcccaccattccataatataaaccacaacttttttaagatgtttcataatactccctccatattttaatatatgatgccgttgactttttaacaaacgtttgacctttcgtcttattcaaaaaatttatgtaattataatttattttattgtgacttgatttatcatcaaatgttctttaagcatgaaataagtatttttatatttgcataaaaattttgaataagacgagtagtcaaatatttgttataaagtcaacggcgtcatacattaaaatagagggagtataagacatgcatgaatatataccattaactagcacttctttcccactaaattattatttttttatgtcccccatcctcaatatatatgtttaattctattgggtacacgcattatatttattagggtaatttaaactatgaggtgataacttataataattatttcttgaactttaggttgagagtggttgcgccttatatttcagaatggagggagtactgctaattactactacgcattatggtatcatgatctgatgcaaattaatcatcgacgttgttggagtccatgtcgaagttgtcttcagatacggtggaggctgcggatcgacggccaccaccatggctcctgggtccggtcgcgggcgcgcctcgaccacgcccttgcatcagccgtccggtcgcaggcgctctacggccacctccatatggtgaggaattgccgcaagcggcaatggcacctcgaccaccgggagggcaggctgcgcgtaagccaagggtctgactgacgccgcagccacgcacgagagggaggtcagcggagccgcctccttttgaggcggagcgaaggtggctcccagatccgccgacgtcacctccttgtgcatcggcccaaattaaaggtggctcccagatccgccgatgtcgcgtcctcgcgaaccggagcgaaggagaccctcgtagctttctagatccggccacccatccccactggagttgaggtcaagggcggccatgcctatcctagaagcaccgccgctgccaaatccagtgaactagtgcagggagtcggtgtaggggtcgagcccatcggcggaggcgtgtgaatcggactgtgacatgaagtccctcgtgccggagccgtcatcatatccgtcgccgtccatctccgcctcggactgttgcggcgggcaagatcggccgaggtagaggctgccgtgagcagctgcggcgggcgagatcggcaggggcagaggcaggcgtgattggcggaaatggaggcgggtgtgaacggcggtggcgggggagatcggcggaggaggaggcagagctggggaggaggaagcgggccacatggggaaattttgggtgcaagatgagagagagcgagcaagtgagggtgagagagcgaccggggcatgcagtgagcgtcccgcatgccttccaaatgacaaatgcaaagttgcccacttttgataatagtgtttagatctattttaccaaaaagtagttcaaaacagtaaaaattttaccattttggagggtctaaataagccctatatatacggctaataataaccatgcatgatatcatcgcgtgcgtggcattatacgtccgatcccacgggagtttgactgaattttttcatatactggacgtcacaccaacggtgactgctgcgattcaattttagtatatacatagcttaaatccaaaacttatgtactgtacataaatatttgcttggtcgccgattaattgatgcctagctatatatgtccaaatcaagataggattatcaaccccgcaaaaaaaaaaagataggattatcagtttgttcactagtaacgttagaccagtccgcgtgaaatatcagtttttggatttatatgatgcccctatatatcaatcttatgcataattgtacatatttagaatttcttttgctaaccgaaatgcattggatgaatgttaaatggatagtccccgtttaaaagatataaagcatattagattttgacagcgtccaacatttgaccattaatttatttcaaaataaattatcaacaactgcaaaatagtatgaagatatttctaaatacgagtctaatgataataaaggcatgatactaaacacatgtatgatactaaataataaaaatggtcgatcaagatgtagaaagcttgagtcagtttgatctagggagttgtttgagtcagttaaacccttttgtagcttgaggatgtgctgcttgaaaggaatgatgcaatgttatgggtgttggttgatatctggccaccaagccagaaagtgaagcaaacggtttggtccagcaatgcatacgcgtgctccctagcgttgaggagcgagtcatacacatttctctccttagcgctataaccagatgcgtcgtttttttcttgagaaggaattattccagatcccctcaacacacgtaaaaaggaaccttgatcttatgcacgagtgacgactcacgtacgctaagccattcccaaaaccatcagactaccgatcctaaggtgcgttaaaggggaccgaagggcaaattcccatcatcactatcgcaccgtggggttcccgtcaccactgccgcacggtgatcccatcaccggcggcctactaccactagaccgacccaacttatggttttagcaagatccggtcagtaaactataaaattccacataagaggtgatcatgcatagcctaagatcatgtttaagaattgactctaataatagcatcgggcctagagactagggcccacgggcaacccagctcaaagccaatgtatacagtaccctcagatgaattgtatttactattacaaaacaccacatagtgaccggtcttataggtgctggtttgcttaaaaccgacatctatgaagcttttttcacctttttacaatataaaagtaagaactggtacatataatcactcattggcactggtttataacaaaactgacataattaatcccccaaatcataggtgttgattctttttataaaccggtacctgtagacatcacacaggtgctggttcttataataaactggcacatacaagtgcgatgtcataggtaccggtctttatcatgaaccattacatatgggtatcacatatgagtcgtttcttaataaaaaccaacacttataagcccaaaggtgcatgcttactattgaaactgatgacgtaattcatatatgtgtgttttttatctaactttttcatataaagtcgaatgaagaacaacgctataacaattgtagagctcaatgatatctacaattgtgtagttgatgacttttttatttaagatcgtttggatgtccaaaaatgtgttaaaaggtctcggatctatttgcataagtgattttttcaaatttctaaacgatatcgggtaaagacaaaaactatatcaaagttgtagctctagatgagatctacaattttgtagttgataaacttttcatttgacctcatgacagtagtctcaaaagaatagcatttatttccaatacatgaactgtttgtacgttagatggtaaggaagctttagatggagagaaagttcttatattcaaatctttcttaatgaagcacttacaaatcgggtagggtggaaaaaaagctcgggctcgtgagctcagctcgggcttggctcgagcttggttggcttgccttggctcgtaggccaaacgagccaagcccaagcctccttttcagctcattgctgaaatgagccgagcccgagctggctcacgagccgcttgttttggctcgcgagcctagcccatcatgtgtttatatcgagtattttattttttatgaagttattatttgtaaacttgaaatttattattaagattttgaagaattgaatatataaacttatttaaattttacatgttgatgatttgttcttgcttttttaataattataaaatatatatgaagagatgtttcaacaggaaggcttgcaagccagcttgagctggctcgagccaggaaacaagccgagccgagcccaagttttagcttgtttccgtaactgagccgagccaagccaagcctagtttgttgtgagccactgcaagccgagccggctcagctcgtttccacccccttgtaaaaaacgtttcggtactgaaaattctgaagcacaatcaaaacatgtattgaaacattttaatacactgtatgaaacaatagttttgaatatattggaacataaaacacatcggagtaaaaatcgggcgttatttcaccccttgtaaagaaaaggtttcagtactgaaaaaatctgaaacacagtcaaaacacgtaataaaacacttttgatacaatgtatgaaacaattgttttaaacatattggaacatgaaacacatccgagtacgacgaaaaaaagaatgaaacactatagaaaacctcactgcaacatttcaatccaactaatgaaacatcatggtacatgggccgatacattaaaaaattagagagaaaagcctagatctactgcgagctcgcccgagtccgctaaaaccacgtggccatcgtcgtcgatgccgtgccaagctcggacgagtccgctacaaccgcgtggccgccgtcgtcgacgctgcacggagctcgccatgcagagctcggccgccgtcgtcggtgccgcacggagctcgaccgccattgttgacgtcgtgcagctcagccgcgtccgcgtgtccgctatcattgatgacgcacggagctcgtggccaccgtagttgatgccacgcggaactcagctacgtccgtgtggccgcctccgtcttctccgtcacctccgtaaccccgtcgctgcctgcgtctggactgaatctaaaggagttgatgaaagggtagagagagaagaataaaaatataaggatgcggttgtgttggcggaaatgagataaggatgcggttgtgtcagtggaaaatgaggtaggggtgcgggtgcccgatatttctgtcgatgggggataaccgtagaccggatatagagggtattggggtacattggtacgaggatctacgtaatacgacatcaagcaaacagaaggcaaggattatactggtttgagccccttgataggtaatagccctaatccagttggtatgggattatatgatggaaaccacagattacaaagggaatagcggaactcgatgataccgacgatactgtagtcgagttggtttgactagatcacccggcgacttggctcccgtaggctccggcttcgtaggctgtggtggatatgttggcagtgagattcgatgccttaggtcctgcctagggggtcccttttataccgcgggtcagttgatctccaagtaggactcggagatatcggacccttacgatatggtaaagaccaagtcttgtacgagtaggactcctcccatctgtggattctgttcctatcacgtgatagatttccttaacgtatacagtaactatccatatacacgcgggtataccgtatcagtatacaacgtacatccaagaatagagggtataccttatccgtgactctgacaatttccttcatgcatcgggcacccattgataagcattttttctttcttaaacaaatatctatgaatatgtgttgaaaaaatcatgtgacttataggaactgaagtgtgaccgtatatgtgcctaataataagaccaaatatttttcgggttttttgcaccaacaaaaataaaaaacaggtacacccttacaagtgtcgattctatattagaaccggcaccgtgccgttttttgacaaattgatcctttataaaaacttattttgaaaatagcccctgccaaaaacttcaaccaaaactaagccgtcggctcaacgccatcaaggttggcgctgaggtataacgtctcagcgccgataatgttggcgccgagatttttgttgagctggcattgagccacgtggcacggcctagaattcacttcaaattcctgtgaaaccatagacaaaattcaaattcaaattcctctcaaatatcctcaaaattcaattctacaaaccttgagaaaataagaaagttcactgttcattttgggcctctcttcctttctctcccaggcccaactctcctcctccttttctcggaataactgcactttgactccctcaaaagtgacctgaatctaattcatgaccctaaaccgcaaaaccggatatctcgacccccgaactattaaaaccggtgtaatttgactcctttggtggttttggaggatggtttcgctgacgtggcgctgacgtggctgtgttgacctagtctatgggttaacgtggcgcttaggtggcatctaaattaaaaacatataggtgggacccgtttgtcattcacacatataaaaatttgtgggggccattggcatatgggccccatatgtcatcctctctctttcttcttcctcccctcttcctccattctctctttctctctttttctccccttcggccggcgggacctgatgtggcagcggcgccgggagctgacgtgggagtggcgatccccggagtggaggagtcgacgatggtgaggcagcgctcggcgagatgggtttgacgttgtggaggaagtcgaccggtgggggttgtcgttggcgtcgtcggtggccgacgacggaggtggaggtctaaggcggcggcccatgcggtggcatccattgaagctccctcgccgagctctatcccgttgctatcgccgtccaccaccggtcgccgtcccgcactccctcactgtctcctgtgaagaaaaaaaggaggagacggggaggcggagaggccggcgagccgctcttctcccgccagcaggcgcgtgccgttgcctcacctcctctcccaccagctgtcacgcgccgctctctcctcacccgccggccgatgcgcaccgctgcctcgccttctctcctggcgattggcgcgctccgcctcctctcccgccggccgccatgcgccgcttgctctttcgctggctgttgtgcaccgctgtctccttcctcgctggcgaacgacggccggtgcgtgccggcggaccgcgtggccaactcacggcgccggagctcctccgctaccgccagatctgaccgaacctcgagagctaagctcggcgttgcccagatgcggagctcggcagcagcacctccttctcgagcgacgaccgctctcccgccgctgccgtcactctagcccccgctcgccgtcgttgccgctgccgccggcggtccctacttgccgaatggggagggagagagagataagagacaagggagggagagggatagactgacatgtgggccccacaaattcttcagtgcgaatgacaaatgggtcccacatgtaggtttttaatttaaatgccacctaagcgccacatcaacccatagactaggtcaacaccgccacgtcagcgccacgtcaacgaaatcgccctccaaaaccgcaaaaggagtcaaattgcaccggtttcaatagttcgggggtcgagatatccggttttgcggtttatggtcatggattagatttgggtcacttttgagggagtcaaagtacacttattccccttttctctcctctccttcccacctaagcaggccggcccacggcctctctcccgcagcagcccagcccaaccgccactgtttgtcttcctccctgagccagccagtgcatgcacacgagccgctcgacgaaatgccgacccgggcgccgaatcgtgccgagccgtgtgctgcaccgagccgcctacccgtgcaccgcgcatcgcgccaaggccgcgccacgacaagccgcgaatcccgccgggagacacggcacggcgtcaccttgcatcatcgtcgtcctgtcgccgtcccgtcccagaacctccgcggacgcgcgtcccctcgccgtcgcctcgtcgtcttgtctccgtctcctcccgggaagccgctgagccgcgtctctccctctctctctcgcgtcgcgtcgccaccgccgcatgcgtcacccccctatagccctaccgccccaaatcccggccatagccgtcgtcggccgtgcgtcacccacgtctcgccgccgttcccgctctccgcgcgtccgtcgcttcacatcgcgtcgccaccggtgcctgacgccaagccgtcgcgtcgccgtcccttcctctccgcgaatccggccgaagcagctagccccatacccccggttctcccgcgccctagctgccagctcgccgccgcgtcccgccaagccgcgccggctataaaaggagggccgagcccctttcaccccacaccattgccatctctctctctcatctctctctttctctcgttcttctctccgtgtcgtcactcgggccgccgcgctcctcctctcggcgccaccgacgccggcagaacctcgccggatttcgcggccgccttccccggcccctggccgcggagccgcgcctcgccgccgcgacacgcctcgggccgagccgagcagaacgcgaggacgaggaagaagaccccctccagtcgctgacaagccggctccacgacccttttcctcctcagccactgacaagccgggcccgcgcctccttcttcccatccttcactgacaggtggacctccttgccgtcaacgctagcggaatattcccttcccgtccaataaataaaaatctcagaaaatccttttaacctttgaaaactcctagaaaatcaacagtaactccgattgaccccgtttaagttcttaaatttttctaaaattgagatctacacagtggcactgttgtttatctgatttaagcttgttttattgccttttcttatttagctttgttttcgcgtttagagcctgagttcgaagaagccccggacgccgctttcgaaagagaagactccaaccctgtgcaaggcaaacccctttgatcacattgcccctatatttttaatgatatgttgtttgcaaagatgcattgtttagttcacacgattaacatgtttaggcctcggattgtttatacaaccgacggaccaacctagtagttgcacttatatttcataggttgatgtttccatacctttgatagctccacaaatatttgcgccggtatcgttatacgattaccgaggtagtttcgcttagccatgcttacgttattgccgtgtgggaaacttgggttattccaaatacatgcttaaaaatctggtacagtgtaccggggagttgtgaaataaaatgtgttgtgaaagtggtgatgatgcggagtcacgcctttgtggtttggctacgtattattgttaaggaccgatttctttgggaaatccatccgaacacgttacagtgcgaccacacagatatttatgggatgcctctggttaagtaaattgttatcacatgggagttggtgtgccaatggttgtggaatgccgaggatgaggagacgaagtattacacatttattgcccatcatgggtgtctttttgcctctattgtggcgtgataccagtaagagtaggaggcatcctcggtatttcctgagtggatgacggctgtcattgcctaatactcggctatggatcttagcccaactaggtggcatgcgattttcatgtgttagctttggaaaggccttatcacgaacttccggtactggccagtaccagtgtaagtttcgtgtcgtgtgggtaaagcgtgcaacctctgtagagattaatgaactgttcgaacagtcgtgcccacggtcaagggcgagtgtaaggtgtttctcatagtgtagatttgtttgacaaaggtttgtgaaaaaagtggttactgaaaagggaacgttaccagagtccgcctgtgtagcagacggctaacctttgtggttaggaacgggtctgtgtgacctggggtgtcgtccgacaccgacgtgttgttagggccatgatggcgttgatgtgctaaggtaattgggtgaactatgtgttgttgtgatagtgaaaacgagttaatgagggaacaaattaattgttgttcgttaatcttgacaagttgttgcaaagcaacttgtggaatgggttgaggcgtgagcctcctcccgacaactaaaacttgactcactcactaggagttttgtgaaataaatcactttgccaaaaaggcagctttcgcaaataaaaccttagcctcgttgtgtaaactaaacatgtcattcttccccctggcttgctgagtacgttaagtactcacccttgccccttataataacctatagagtgtgaagacgaagatgtcgacccgaccgccgaggagtatctccaggagcaagccgagtatgaagacttctagatgtttcgtgcctagccccaagcctcgcttgtggaataagttagttgcctaggttctttgcctagtgcatagttgcttagtcgcttagttctccgcgctattcacttctgcgccgtcgcttttatggttttatgtaatgttgtgttgtttatctatgggcctgtccatgatggcaacttatgtaagtactactatccagtgatgtaataaagcagtttactttgattccacatttattctgtgtataccagctaatgtatcctgggactggtactatatcacaggtaatgcataacactccggtgtgagttagctgtgtctatggctaacgaatgtcagggcgttactgctcctctctctcccctcagcgcccctctcgataaccgatgtgatggttcccaaccatcgtgtccctgcggttgccaccgcttcacatttatatgtactcttgatcaatgagaaactatcaattcgctctattatgtcgctcaattctctctcgcttaatctgtcgattctattcactctcaacatgtgttacggatgcatcaatatatacccaggtttttgtgacatttactcttcttgttttgttcaagtgacatgcatggaagatattttaaaaggcaattaaagctacttgtacggtgtgaaggaattctcatgatcctattgaggatgtatatacagaaagctgcactaagatattactttaattacttttcctttagtactcttctttttttttattggcggagcctttcatctttttaaagaaacacactttagatagtggatatgcacatccgtcggaaattgcacctaatattattcgatggaagagtcgaagtgaaaaggacaaagatgggatcggaggaatggaacacacaatatatatgtgtgtgttaacttcgttttattttgtacaatgaacatgccacctttagcagaatgaaacaagacagaaacgttacaaggaaatgagcatcgatggagtcacaggtaagtaatgttcatgaagtaaattaaggaaatattcccttccattgccacatatatacagtgctagctctcttcattttcaatcgcttttgaggtgcctctgtcgagtgtagtctatgccaaatggcctaaaaatttatatgctatatttgtgatttgcaatttgacctgattatttctttcctcagattcattctttcgttgcatatttatatttcaataattcataaactggtccatagtcaacagattatgtattattatatgtgcttcagaatttcagatcaccatataaattataaagatttcgcaattaagcatatcatgtgcttcagatcaccatatattatatatatgacacttggcatgcttaaccagaagaattttcaggggattaccaaacccaaattgacatcaatcttctcgccgaccaactagaggcaaaactatgcgacgttcctttggacgacggcggccggcgacacggctcgccggagtgccacatttccatcgtgaagccgcaagtccgcctcgtcgacgtatcgcagtacgctccgcaggtgctgctcgtcggcgcctaccaccacaggtcgctggaccggtgtgagctggacaagctggcggcgctccggcgtgccctccccgacggcgacgacgagcgggcgtccacgctgaggcgctacctggcggccatcgccggcctcgaaagcgaggcgcggagctactaccgcgatgacacggatgacatgggcgcggaggagtttgcgttgatgctgctgctcgacgggtggtacatactccactacttcggcgtcggcgtcggcggcggcgggagagcggtggacatcttcgccgtgcgcgacgtgttctacctgctcgagaaccagatacccttcttcatcctcgagaaggtctacgagctgatccactctccccctccttctccgggagctacagccatcgccggcggcgggtcgtcgtcttcctccgtcgtggttgtcgatgggttcgtgcgccatctccggtcactcctccgagaccagggctactcgaatctggaggtggacatcaccagcacacgcccctgtcacctcgtccacttactccacatgcacttcacacccatggcgatggcgccggccgccgacgacgctgccgctgtccccatccccaccaggcgcgcgcgcgccaccgtgtaccgctggcgcggggcgacgcagtaccacgccgccggcgtgaggttcaagagacgggccctcggcctcggcgacgcacggtgcgtcctcgacgtggagctccggcggctgacgctgcacgtcccgacgctgacggtggacaacaacacgtggcgggtcctgcgcaacctgatggcgctggagcagaacaacccaaacctgggcagccacgtcacggcctactgcctcttcatgtcgcatctcgccggcacggcgaacgacgtcgcgctcctggcgagcaaaggcgtcgtcgtgcacttcatggggtgcgacgaggacgtcgctaagggattcgccggcctgtgcaggggcgtggcgctcagcgtcgacgacgcgcgccagaactacctgcagccgacgtgggagaagatggagcggcggtacagcagccggccagtcaactggatggcgctgctgcggcggcggcatttgagcaacccgctggtggcgaccgcgctgctcgccgccattgttggcctagtctgtgaagttcttcaggctgtgtatgccgtcaagagctacaagactagaagctaagccactgagacgtatgcccctgtatgcctaccgattttacgttcattatcgaagtaccaatcattctccgctgcgttggattctactccactatgtatagatggccaaaatgagtcgcccgacacggcctggccgggacacgactaaggcacggtccaagatcagtcggaccggctcggcctgagattaaccatgtcgcgccgtgcccatccacggcgggcgcctacacctatatcccaggcatggcccaataagactcggatcatgccatgctggctcgaaggcacgactagcataccgtattgatccttggaataagtttattttgcctccctcatttttttaaggccgtgccttatatggctagaataagtatattttaccccctcacatctttatatcatgcattatatggctggaataagtctatcttgtatccctcatctctttgggccaggcgccaatgggctatggcgcaagctaccattgagccgtgccggcctgcgggagcgaggtaccgttgagccgtgttgtgccggggacggcacgacgttgtcgtgccaaggaagaggcttatgcgtagcccaatagtcgggtcagactggcacggggccgacaactgtcaaaaaataccatacctgggctgggccaaatctttgtgccgtgtactgagctgtcgagctgctggccttttggccaactatactatcacaccatctatggctgaacgcctaatttgtactcctttcatactcgtaaagaaagtcgtttaggacagcgacacgatctccaaaacacaactttgacttcttgtttctataaaaatatttattgaaaagtgatatatgtatactgttatgaaagtatttttcaagacaaatctatacatataatttttatattttcaaactcaataatttgggagttattcatgatttatattcctaaggtttgacttaaacattgtcctaaacgacttcctttatgagtatggagtgagtacataagattggttgcgaagcaccccgcctactagcatagaagaggaccccgaaaagttggccctaattgaacaaggtaacaaaataaagattacatgcttttgtttggatcatgtttcagaactggttgcaaaaaaagattgttgtacttccaagcccccccatggctcctgcgtccaagcctagttctcctaatccctaaaaatcttgtacgtatcaggattcaggagatatcattttactagcaataggaggtggaacatagtttttctaatcttgattaatttctttggttttcagctttggatgtgagctgtggtatgctgaatttggtgggcagctgattgcgcagtcaactaatcaagtctacttttggccaatacttaagctggggtttcttgtaacccagttttgctgtaacttcggcgttcaaaaaaaaaagttttgctgtaacgttgctggtctgctgcacatgtattgcagtatgaactattgatattcatgttggacgtttgttgttgcttgtcagacagatgattattgtgtggttttagaaacatcattacttcaatatagtattatctagtactccaaatatctggtggaatcgtggcatctattatccaattatatatgacctttttatgctcttggctgttcagtttaattcttagcttttgcttcagcatgcgctacttgctagcgtacatttcaaacaagggtcacagtctgttcgggttcaccgagaaccgaaaaaacgagccgaatttgttcggtttagtcggcttggttttaccttattttagacaaactcggttgccatatcttcaaaaccgatcttctccaaaactgaataaaccgagcaaaaaaaaaccggaaaaccgaacacccactcctattatgtccgtgctcgttgtttggaaaaataaataaaaaaaccctaatttatttccgtcaattttggatggcttagatcacgctatgattcatgcaagcacaatggcctttttatatcttctacccccgtacacgacactcattttcttcaccaaaatctaacccatgcagtacgtcaccccttagccacattggcaacagaaagcacaaatggcatcggcgcggacttgcctagtccttcaccctgcccgcctctcctcctctccaagtcaagtgacaacgcggtggccccacccaccttttaaatggtcaagatcctagcccccggcccatcaacactagcccaccgcctgttgctggtcccatggctttgttggcgccgccatcaccttactatcccacattatgtattattattctttttttcaacattataaaaaactacataatatatcctctcaaacaattatattacacagtttttttcacctatatgttggcgtcccagcattattgttataaagccagatcaatcatctgattgttgtaataataggttgttttaacaagtccatcatcattagatgtcttttgctaagaatgtcgcgtcgaaatgaacttgcgtataagaaatagatccaattactactatataaacaggcattggtaccgattcgtaactactggtgccggaagtcaaaccgatacaaagagacggaataaaaacggcatatttacaaacgaaaataattggataaaacttttatattcatattcttagcgaaaaaaagcaaatgttaaaaaataaatttggatgaaaaaaccccaaaatcaactctaaggttgaaaatttaaattttggctgataaacataaccgaaaagatgagaacgtttgatcactaccaactaagaagaaataaaagaaaattaagactatgttcgtactggatttttcatggaaattttttttgtacgaatagctttttagtcgccgttgattgtgttctgtcgagatggaaccctttcagcctttcagatcgttgacattgatcttaatccacatcagaaaggaatttaagggaattaaagaggattaaaggaacaatgcttaaagattatttttagatagtacgtaaaaattccaaagttcccctcaaattctaaacttaaaaataaaaacattcctcaaattccaagccgtttggtcccaaataatcccctttctctggaccatttgtggcagtccatcatctttcttcgttctcctccccttcccttgccgtggaagtcgccatggctcctcggatcgcggtgatgccaccgccacactggctcaaactcaaactcaatcctcctccgccttgcgcaactccggaaacggaatccccatcgccgggaacacatgcttctcccccgttctcatccgttaattagttcctccattagagcaatgatatgatcatatgatacactggtggagaaacccttcgtagtcccagttcgtaacccccctttagtcccggtttccaaaccgggagtaccaatccgggactaaagatcgagctgacctttttttttttttttgcatggccctgttgctgcatggtttatatatatatatatatatatatatatatatatatatatataaaccatgcatatatatgtttgaatacatatatatgcatacatatatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttcttcgttgatgaatcccatgagttgttcttgaaccgctgcgataaatttcttgtgtgtggtcaggttatccctcatgcgaataaattatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacctccgcctaagtctttctctctagttgccgcggaccaaatgacggaaccgataccaagccctacatggagtttaaagatatgattcgtagtagaaataattaacataacaagaatttcttaattaacagagaaacttatgccagtacctgtctataagttcgaaaaccttgtcaaacgtagactcttttttatccattgagtcatatacattgacggtgcaggccgacaggtcgaagagtaaaagcacccagtggaatctgcaatgtgcgtgggatgcattacatatgaaacacttagcaagttcgtacgggaataaaatttggtatgtaggaagacagtaaaattaaactaactctgtgttgtacggtaacagtataaacgtcttgtaatgctgcgccttcaggagatggacgagattgtcctctatttcctgcggatattggtcgagcattgcaacgtttactctccgagggtcgatgaatccagtatcgaaaaccctccgccgtcgggccctttgaatctccattctacaacgataaaagggagtattttattttatatagtctacttatatacaaggacctaattaattaaaggagacgtagtaattaagaattataattgaacgatatacttacaaagtccagaaactcataatagagacgtcgagggcgtccagctggtatacttcgtagattcccttgaaattgatccagagaatatcatctccttgcaagaagtcgaggtccctgatcctcgctccgatcatctctctaccggtggcgctcatctccacgtacagctgatggaacttgtacatttgtgtgggtagggactgcaccagctcgggcttgacaagcggtttatcgagttcgtacatgtatttcaattcagccttttctattggttcaactcctagcaattgatccgtagttagatcggtgtcaataataaattcttctatcgtcatgtctttcccggtcaccaacggctcgatctcctggtttggttgctctccaagctgagggactggtttggactttccagaagatgctttcttcagcgttcgctca

SEQ ID NO: 3523 - DNA, 804 bp, Oryza sativa
tagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttctttttggcggcattttctttgtttctttccatcatcgcctgcccttgttcacctgtcttataagcaacgaactcgtcccagtgat

SEQ ID NO: 3524 - DNA, 1393 bp, Oryza sativa
tatatatatatatatatatatatatatatatatatatatatatatatatatatatatatatatatatatatatatagtattataaaaattgaagatattttggccggtattttgatacaagaagcaattccaagaacatgaagatgaagaagttctatcagaaggcgcttgatgaggcatttgtagctgtccaagaatcaagcgatattgagtttgaaagtgatgaggatgatggcaaggggaacaaaggcaagaatgatgtttgtctcatggctagaagcgtggatgaagattctaattgtgataatgaggtaactcatattcctagtgttgaatatcttcaagaagttattgctagacttggttataagatttctagatttgagaaaaagattaaccaatatgaagctactattgaatctcttaatgcttaaaattctagaataaaatctcttgtttctgataatgatgagtgtaaatcttgtgaggttttatttgaggaaattgaagctgttagatatgttaataggtctcatgttaaaaagattaagaaatctgaatcttgtcttggtatgagttttgtcatgaacactagattggttgatgaattgtttttgactaagagagctttgaataaatgtcaatttgctttgtttgatagttggatgtttaatgtgattagctttaaaacgattcaccaatgtagtgaaaaaccttgaatgacatgtgatgctaatgagatgaaactaaaagatgcattaggtcgtgttaagcacatggaagaaattgtcaaacaagatgaggtgtttttttgctcaaattgtagaaaacaaaaaggtcttttggatgcttgcaaaaattgtgctaatcttactcaagaggtttcttacttgaaaagttctttgcaaagattttctgatggtaaaaagaaactcaacatgattcttgatcaatgtagggttagcacacacaatcgtgctttaggttttaatccttatgcttatcatactagacatcctcctgttgttttaggtgctggtgctagaggtggtgaaattttgcttaaactgagcctaagaacactgtgtttaaatctgctggcatcatgactagtttaagtgcattatcttcaaaaaccaatgttatgcatgcaaaaccttctattagtgcttgtgttgctaagccatatgtttctataattgcttctaatcatcatgataaatatacttgttcgttttgtggaaaagatggtcatcttgttggattctgttttagacttgctagaaaacagaaaaaggaacgggaaattgcttttgcgaaaaagagatggcaaaaactgcgttttgtcccgagacaggcagtcagaccggtgctttacccccagtcagaccgg

SEQ ID NO: 3525 - DNA, 896 bp, Oryza sativa
ttcacatactcctattatttctgtgatgacggatgcaccgggacagcttctacatatggacactgttggtccagctagagagcaatccgtcggaggaaagtggtatatgttggttattgttgacgatttttctctatattcttgggtttactttatggctactaaagatgaggcttttgaacactttaaaagtttgtatcttcgtttggctcttgaattttctggatctttaagaactattcgaagtgataatggtagtgagttcaaaaatgcttttttttgaaagtttttgcaaagaaaaagtcttgaacatcaattttcatctccacgtgttcctcaacaaaatggtgttgtcgaaataaagaatcgttctttggttgaaatggctaggactatgcttgatgagtaccatacacctagaagattttgggctgaagctgttaacactgcatgttatatttccaatcgtgttttcttgagatcaaaacttggaaaaacatcttatgagcttcgatttggtcatacacctaagatttaacatttgcgtgtttttgggtgtaagtgctttgtgttgaaatcgggaaatttggaaaatttgagtcacgttctactgatgggcttatgcttggttactctgcacattctcgaggttaccgtgtacttgttttagacactaacaaagttgttgagacttgcgaagtcacttttgatgaggctagtgaaggtacaagacccgatatttcaggtacattatcacaggttcaaggggaggatattttcatggaggaaagcgacgatgaggaagacgactaacgggtcatggcccggcaaaccgtcgacccaccgccgatcagaccgcaggcagaggagcagtcaaaccggcctgggggctcatc

SEQ ID NO: 3526 - DNA, 32386 bp, Oryza sativa
  unsure (1)..(32386): unsure at all n locations
acaaagtttggtttttagttgaacctcttgttggtcataatattaatggaactaaatgggttttcaaaaacaaacaaaatgaggatggtttgattgtgagaaataaggctaggcttgttgctcaaggttttactcaaatggaggggttggattatgatgaaacttttgctcctgttgctagaattgaggcaattaaatttttgttggctcttgctgcttcaaaaggttttaaattgtttcaaatggatgtgaaaagtgcttttcttaatggttataatggttatataaaggaggaagtttatataaaacaaccacccggttttgaaaatcctgattttcccaaccatgtttttcgtttgtcaaaagctttgtatggtctaaaacaagctccgagggcatggtatgatagattgaaaaactttttgcttgctaaaggttttacaatgggaaaagtggataaaactctctttgttcttaagcatggtggtgatcaactttttgttcagatttatgtggaagatatcatctttggttgttcatctcaccgtttggttgtgtagtttgctgagactatgcgcagggaattcgaaatgagtatgatgggagagttgacttactttttgggacttcaaatcaagcaaatgaagcaaggtacgtttgtgcatcaaacgaagtacaccaaggatcttttaaggcgcttcaagatggcggattgcaagccaatttctacaccgatgggatcaactgctgtgttggatccggatgaagatggtgaagttgtggatcaaaaggagtataggagcatgattggatctttactctatctcactgcttcgagactagacattcaatttgttgtgtgtttctatgctcgttttcaagcttctccacgtgcttcacatcgtcaagatgttaaacgcatcatgaggtatttgcaacatactctagaatttggaatttggtgttctacatcgtcttctatatgcttgagtggttattcggatgcggattttggtgggtgtagaattgataggaaaagtactagtggaacatgtcattttcttggtatttctttgattgcttggtcttctaggaaacagtctaatgttgcttaatcaactgctgaggctgaatatgttactgctgctagttgttgttctcagattctttggcttatttcaactttgagagattatggtcttacttttgaggaagttcctcttctttgtgacaacactagtgctattaatattgctaagaatcctgtacaacactcacgcacgaagcacactggtattcgctatcactttttgagggatcatgttgagaagggagatgttgaattggcttttgttgatactcaattgcaattggcaggtattttcacaaaaccgttggattctcctcaatttgcttttcttcgaggcgagttgggaattgttcatccttttggcatcaattgaggggagttttggctctttgttgcattcatgttttcttttcttatttttttttcctttttgcatacatgttttattcatgtatggtgtgataaaaaaaagaaaaagaagttgaaaaaaatataaaaaaatgaaaaagaagaagagctttgtttgtgccttagtatattccggtatatgctagcaatacatgttaggtgatgtgatgactagactagcttgagtgcatgttagtttttatatgagcttttgatattgtctttaagtgatttgatacatgacatataatttatgacttgaattaagcaaatatgcaatattgatgctagcatatggtttaatttataaatgctttatatatatgctttattgaattgttattcctcaaatagctttgtaaatgctcattgtgcaagagaataaacaaataataaaaaaatatctatgaaaaaaatgaataccgaatccttgcaaacagtcttgacaacaagtatgtattcgatgtgagcaaaagtaatgggtgccgaatccttggaaacagtcttgacgacgaggacgtgcccggaataattgaaaaaaaaaagagaaaaaggctcaaatcaaagtgaaaaaattctcttgattgtttttgtgctaaagctaatttgagaaagagtaatacatgcaataggtctatatgtatagtgtttatttttcagtctatgtgcttgttaatatattttattataaatcgtttgaagtcatgaatctttagtgttgatttgatctttttgacaatatcttaggttcatgtttacacttctatgcatgcttgttaactagattgtcatgccatctaccttgttattgcaacacatgttcttgaattacttttggtatagcaaagctctccggaaaaaaaatgttgatgaactcattgtcaaaagggggagaacaaggtaacaaattgtgcataattgtcataagtagaaggaatttctttcttttcaaaagtgagagatttttctttgaaaatttttttttggcattgaagatgcattttggatttgcttcacaaaacaccacaaaccatttgttgtttgccaatgattttcatcaagagggagattgtagaatcaaggagttgatttagattttgtgatgaaaatattgctggtttgctaatgttaatttagagattttataagatggttgattttgtgaagtgagctgttttggttgaccctggcggtcagaccggctgagtgtcgccggttagaccgcgggtgttgcggcggtcagaccggccggcccgacggtctgaccggcatgatcctgatcgatgtcggtttcgggttgatttgttggatttggcttctagatggtttctatgcgtatggatactattgttatactaatgtgagtcaagttgggacgaacttgggctcggaatatggtctcttggttgttgcatgtgtaggtgttgcttgaggcctcgggagagtgttgccggtgaaagatcggagtcaacttgggagaagttgatgtccaaggatcaagagatcatgcgggatacttaaggctagaggacaatgcatgtggtgatgaagaaatccatatgatatacaagaggaattgtgtacgtatggaaagaggagtcgaatttgtaagggagtccgaattcgggaagtttgatagagataaggaaagagataagttgtttacttgcaagagagggtttcctacatagttaggagtcctagctaagttgtgttagattcgttggctttgcacagcctacctcatatataaatagagagagagggtgaggcctctcgttgtcagagaagggaggggtgagggggaggagatggggagagggaggaggtggagaaaatgagaggaggagatgatgaggggataaggatcgacgaggcggtgaggacggctcggaaagggatttttgtattttttaaaagtttggtgctggttggtataaacaaccgctaaaaataatagggctctaaccttgtcggtgacatggggtcgggggtatcgtgactagaggcttgggtagccgcggtcacccacgtggcctgaccccctggggggggtcgggcccgagggtgacgtggccacccctccctctgtctccccgaggggtcgggccgcccccgtttcggccccaagggtnggggcgccccgaccccctgtggttttggcgccacgtgtgtgggttaggtgagcacagcggggctcacctaaccgcatttatagcgggttggacgagcgcgccacgccgcatttaatgcggcgcagcgcacgcttatccggtccgtgaccggtcgcggcgtgtgaccggtcacagaccggtcagatcgcgggttaggtggcaacaggcggcctgtcacacgcctcgccccgtcccgtcggaatgatgagagcttcctggctctcgtccctagccggagccggcatgctaactcctggagttggtatgtcagtcccggtcagatccattccaggcttcagcgcaagcatggcaaggaagtcgctggccattgaatgaaggttgaaatgggcgtccaccgggaaagctggcgagcggggctggaggcgtgtgctctgcttgtcagaggtcacttccggctgtagactagccctcattgtaaaaagcatgtttcctttcttaggcagctagaggcccatgtggtgacccctgaccagataaaaaggaggaccaggcctagaagggggaaaaagaggggaaaaaaagagaaagaggggttctagagcctgaactctctctcgctctccggctctcggtattccttcacgcacagatccaccagaacacaggagtagggtgttacgcttctcagcggctcgaacctgtctacgtcgcccgtgtcttgtgcacttcctctctcgctgacgttcctcagatcgagggcgaagaacctcacttagcgcccccggccgaatcggcaaaggggggcctgcgcggtctcccggtgaggagccccacgctccgtcaaacctgtttttgaatcgggagtaagaataatatttagttccggttgaagtactgtattttcaaatcgggactaaatatgtttttactcaaaccgggactaatgtgattttttagtggcccaacaaagatcatttctccaggagtggccagtttcaactaaaaaaagatttaccccatttacgatgatgatgtgcaaaagtttgattcgatttgtctacttggttttgagattatcacctggtgacaattctgattaacattttctgattggcggagtcaatacaaaagagaatgctttattttattacagccacagtgtatctgtggaggtactaaaacggaatttggatggaattagtgtctttttcaacagtacttcaatgttggtctttcctgttacattggctccttgctatggtatggtatatattgttaccttatactccatatttgaaggttcatggtgttgctattaacgccctgaactccactggaatattttcaagtgtccaacctatggttcagtaatcctaactacccctatatacaagcatcatttgtttcttcctttaaaactgatggcagatatatagaattgtgttttttttttacctaacaagaccaccaaacgactttgtttgtcatccattttcagggtgtgccctttaaagacggcaatcatgacaatcaagtccttcccctgagcaaataccatgagaactgatcgtcaccgtcgccgttctattgattgacattgcgttgcctggagatatctactatgctcatcagttttaaagtaacttttgaatttgatataaatttggtttgtatatatcatggccgataaaatttttaatttttaacgtgatcatctgcatcgtatgatgcatatagctaaaaccgcttgatgtatgtgcacgattgcaatgttaggtctatgtgtatcatgtttcatggaaggcatttttcagtaatgtggatgtcatatttgcaattatcaaataatgtcgtagcattaagaggatgtccaagtaataaaacaaaagcaagttgtacgtgggcgggtagattgctgattgagatcaaactggttgattttatggttaaaattattatacttgctcgataaattcacgtgtcagcagaaatccaatatacatacatgcatgtgccagtgtttgattagttttgtaggcttggttttagtgtatattatgtaattattgttcatgttattttaatgtttttgttgcaacaaatttacgctcaatgatttttttaacatcatttttctcattgtgattttaatttactatttttttcctgcagcaacgcaaggcactcaactagttgttgaaaaaacgtgagaatgttaatgagattgatcctttccgatttactccattcgtctcaaaatataacaatttttagcttttaggatttgtcccaaaatataacttctccaccaactctcttcctaaccaatcacaaccctccaccattcacttttcctacctacctccactacctatttaatcacaaccctccatcacttatttctatctatttttttaataactatgtcaaattctaatacttcttatattctggatcgaatggagtaattagttatatcacatagatgtgttgggtctccatcgacacgacaagctttcccccacactcgcatcacctccaggtcagcacgggttgccggcaccagctgagcagcccaaaaaccccggccggcagtttgctaggacagcagcagtggcttcttcggtagttagcgcgggcggattaaatttgtgataaatgtatagctagtcctactatagctatgggatttagatctagaggtgtaaagttacgacgtgtttgggtgtttggacaataataaaaaaaactaattacagaattcgtcggtaaaccaagagacgaatttattaagtataattaatctgtaattagcaaatgtttactgtaacactatattgtcaaatcatgaagcaatctatctatctatctattatatactaaaagtctattaaacttcctataaacactctcaaaccgccaagtggcaccctataaacgctctcaagttgtcaagtggcactctaataaataaaaagaaatccaaccatctatttttacttgaattggtagacccattattttggatggtttgatctattttgtaaaaaaacatccgaaaccaacatatatggtactaacgtacaaacgtaagtatgtactgtacgtacttcccttctgtctttcctttgttatttttctatttcatgagaaactaaaatcaaaactattcttataggcaaaaaaaattacaaatagaccaactactagctctagcagctatccctccgtcacttaaaatatcctacgaacacttctaaatcgctacgtggtgctattaaattagagaaaataatagaaaatcttaataaatacaaagcagccgacattcaatttctacttagaaaatcttcaaaaaatataaagcagccaacattcaatttcttcttaaattgatggctttaggttgttagatttttttaataaaaaaatcccaaacctctctccctccctccctccctccccacccccatgcagtgttaaaaaccattacacattttataaacacctttaagctactatttgacatacttaaattaaataaaatcttagcaatttcagaaaaaagactattgtatactaaaagttcattgaatatcgtacgaatacgactaagccgccaaatggcaccttacaagcactcctaggttgtcaagtagcactctaatctgaccatcgatttttatttagatcgacgatccattattttaatttagaagtttagatcttttattctaaacaaaaagcacacatccggaacctccacatcacgtaggtaccaacaaactatcttcatgacaaattaaaatcacaattattttgacattaagaaaaccacaaatagacctccacctattaggtctagtagctctcgctttgtcactctaaacatactacgaatgcttctaagctgctaaatggtactattaaattaaagaaaatacaagaaaatcttaaaaacaaacaaagcattcgatatcgatttgttaattttttttaataagaaaacaacccaaacctccctccctccctcccaccttcatgtagtgttaaaatccattaaacatcttataaatacttgcaagatgtcttgtctgcaattccttatttctatcatctcatgcaaaacgaggagaatgcaaggcaagggcgagaacaataaaaggtaagctgctacatgacgttcttaaattaaagaaaaatcttagaaattttggggaaaaaacatccaaccatcgtatttgacataaatcgatggatacattattttcaatggattgacacattattttaggtcattagatatatatttttaaaaagaacaccctaaatctccttccctccctccttctttgcggcatgcggtgttaaaagttcattacacattttatatatgctcttaagaaaacaaaacatccaaccatcggtttcgacataaacatctgacacattattttaggttgttagattagtcatttagaaaaacatcccaaacctccctccctccctccctacctacctgtgtacaacgtgcaccattcttttctctctgtttttatctccttgacaattaaaattatccatatgggcaaaaaaacacaaatggacctccatctattacttatatcctgttaggcatctaacgactttatgccaacttaattaatttctcttaacatgcatatgagggctatgtacctatacaaattgaccttgatacttttagaatgatctttgtaggcgataaataaatacttttaagaaagacaatcatagtgtccgaattacacatatgatctatgaagtcactaatcatagcaggtattcatctagcaatatagacaacaggttgaaaagtgtggttggttaaacatcatactgataagcatttgggttgtacctaggaattttaacagtggaacaacattgcagtggcgttagcaataaatcaagtcagttccatataggaattaaagaccatgtccatttcttttttttttgttaaacttgctatagtacattgtaaagttttgacgtagaacaatctagaaacatgtattcattacaagacaatccactttagtgatgattagctaaatatactatgaccattacttcaatattttatgggagaaaatttagaacgtatgcctttaccccatgccaagttatatgcactaatatttccatcacaaatttaatttagggtattttaactcgtcagaaggatatcttataaccccaaaagaaatcgaataatatcttttttgtttgattgcattttaaaataagtttaattttagtttaggacataatacaagatattttaataaaaatcacacaaaataagtttaattttagtttaggacataatacaggatattttaataaaaatccacttgcataaggtgcccgcgcatgtgcgcgggctacctttctagttaggcttaaaagattcatctcgcaaattagttgcaatatgtgtaattagtcattttttagcctatatttaatacttcatgcaggtgttcaaatatttaatacttcatgcaggtgttcaaacgtttgatgtgacagggtgaaaaattttagggtggaatctaaacatggccaatatcatcaaaggaaaaggtacatatgaggtccctcaacttgtcatcaaattataaaatcgtccctcaaccagaaaatcagatatacaggcccgcttatatctggacaagtcttttctgcacactttctcctcacttatatgcactcgggaagaaattgctccaggccaagcatgcttaacctcagatttctttcgagatctgtcgcgaccgggaaaattgccttttcccgaacgccagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgcaaggggggtacaaggggataataatataggggttaagttttgcagtaaacagcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattagaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccgcctacggccggaacctccgggacaggcaggcaggactgagccccaagtagcagggcaccaaccctctgccacgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccatcgaaaacaggttttaggggttttgaaagaggaagagaggtgtatgtccaattccaccataatccaacaattccatagtgtccaaatgatatgagacttcccaaagtctaaagttataaaaccacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcattaatttaaatcaaaataattttataaactgggattcaatatgctcaaggatgatgtgacttgccttgctcagagagaacggccttccgaaccttcggcgacgaccgcgaaccacgcttcgggaacctccggaacgacgaaagctacgcgaagcacacaagcaaagctacaagcctataaagaagcaataacaatacataaaaagaaagcacagggttctttaggttttaacaaacattaggagacttgaacgggtcgattcggagttcgtatgaccaagatatgatcatccgaagtttaatgctgttatatggagatttgcggattattataattaagctttgcaattataaaacatgtggaagcgctagcctggaaaagacaggaaggctgcgccgttgacatgcggaccccacatgtcaacctaaaggaccgcggtagaccgagtacacagagacggtccacgggtcgacggaagcggaccccgtgtgtcaaccgaggcgagtggccgacaaacggactccactagacaccacgcggactgcacacgtgaaaccacgcggcttccgagtgggcacactaacagggtcaccacacacacaagcgaacgactaccgacaccggtacacgggtaccggggtcgacaaccgcacaacgggcacgggcgacaccgaaaggacgaggacggggcaacgagaggaggaaaccttaccaccacgcgacgaggcgtgggaacgacaacgacgaacgggcgcggcggagacggacggcgagggaacgacttcggcggcgatccttgaacgaaggcgagacgcggccggcacggggcttgacgacgcggaggcgaggacgaagaagaggacagggctgcagcagctcgcttgacgaacgcggacgacgaacgagaacggctcgacggagggacgaacgtcacgacgaccgggaacgacgagaggacgacggcaacgacgacgaccgggaccggcgaggaggcgacgaggacagccggcagcggctgcacggggacgaggacggcgtggaacacgccgcagcgatgacgatgacggaggcggcgccgcgagacgacgagccgggcgaccgacgggacgtcgacgacgagaacgatcggagacgacgatgaaacgatgatggcaggcagcagcggctgagcggaggaggggacggcgtggaacacgccgctgcgatgttggtgaaggtggtggtgcagcggggcgacgagccgacgaggaggaaggagaggccggcgcggagatgacggcgttccggcgaaattcgggcgacaccgtggcctggccgggagagaggacggcactccggtcccgggagaggtggtggcgacgtcggccggcgcaccggggacgcggcagaggcggccggaggcgaaatcgtggcggcaacaccacggttgccggcggggaggcacttccggaggtctccgcgggaaacggagggtaggccggcgaagaggagccggctgcggtgctggaggaggcgacggcgcgaccggccggcgtggtgacgcggcggcaggggcggctggaggaaggccggcgccggagggagagaaggagaaggcggggagaggtggtgaggccacgggggggggcttgggaggaggctaaaatggtagaacggagcgagggggttgcattttataggcgcggggagggagccggccacgggaggagcgggaacggcggcgggaaccacggccggcggcaatggaaggcggccggacttggcgcgtccgttcccggggattgaaggcacgaatcaagggggaatttgggggcaattgaagaggattcaatggggattaatttcccctatttaattttggaatcccatgagcgaatcacacggatttgagggaggaaaggagtagggttttcacgggagagagagagaggtggccgggcggctggaggaggaaggcgacggcggcctggcgcgtgggccccacgcggggcgcgcggtcagcgcgcgcacgcgcgcggcacgggtgggagcgcggctcggcttgggccgggcgaagccgaggcggcccaggaggagaggagggagaaaaggtgggccgggaaggagaggagggaggggcggcccagaaggaggaggagaggagggagtgggctgcccgggaggggaagagaggcccgggagagagagagggagagaaggggagggagagaaagagagggaggagagaaggacttcgggctgggcttggcccaaaggaggaagaggagaattatttttaggttttttctttttattaaactttgataattgtttttgttgcttaataattatttccggtgctctgaaaattcaagtaaaatttgagggctccttttagaccaaggagaatttaacaaaaattctccgggccacatttgaatttttcttgtacgtatttttagtgtttgccaatttctttttcgaattttaattaattctattattccttttagaaaatgaattttattttggaatgaatttatcaggacgtgacaagatcggcttccggaaaagaagttgcaacttgttggtacgagtattctattaatcctattaagctctaggccgggatgttacactcgccccgccagcctcctgtccactcactggccaacttccccagacgagaagagtgggagaggggaagaaaggaaagaaaaagggaaagagagagagagagagtgatgacgtggtcatcctgatatgtgggacacacgtgggcccacgttaactcggccaccacgtcagataaaaccggggtcaataccaccaaggatgtggctacacagctagtggtagctggtttgtctaaaccagctaccactccatctattaaagatagtatctacctatacttcaaataaaattttctcttaaactactcatccaatctatgatccgattacactgttgtgttcgtaacaattaaatctttataacaaaatctcacatgattatattttgatgaaaaaaatataaattacttggataatatatctaaattacatttaaatttcactaaattacttcttggacataaaaaagtaattcaataaacctaaaagttattccatcaatgttatttacaatccatgaaaggttttatcttcttttctcattctatatgaaaagcgaaaacgaaaggaaaaaaacaatcggtgattaaacggatttacagagagttacttctcaaccatgcaaaagttacttccaattaacattgaagttacttttaaaaaatgttaaacttacttgtgttgatatgtactgattaaatttaatttctagataaaatcatatttttatccctacaatgaatttacttctaatatcgtgataaaattacttttgtgttgttttaagttacttttataatatatgtaaattacttttagactttattgaatttatttttatatgtctaagaagtaatttagtcaaatctaaaagtaacttatatatatatatgataaaagtaacttacgtatataataaaagtaatttacaaatataaatattttttcatcgtaatataatatgtaagatcttgttgtgaagattttgtcagggttatggataccacatacctaacagtagttgactaaatctcggcaggacccactacatatcatgtcctatacggaagcaaccttcggatataggaggagttccggataaggaaagacgaccaccacgatcaacacacacaaaggatcaacacccaacacaatcgacatagaagccacaacatagaagcctacatacgccaagacacgccgccggatatcgacttcagggataagcacggctagtaccctacggtgtctccggatactgtcaggagagacggaagcgctatctttgatctcgctaggcacggattcaaggaggaagactaccctgttgttgactacgagtcagatcttcagaccgccatgtcgacaacagttagataggctaccccaaatattgtactggtgtgattatggtgaataagagcaatactggcttcggccaacaggatgtagggttattacctgacaattcaggggcccgaacctgtataaaaatccttgtctccatctcttttacctcagtctcgcgtatatcctagcaccgacgatccccatgccatgcaaataccgtagtcgagatatcgaatgtcgacagttggcgcgccaggtagggggattttggtgcttcaaggtttcgatgagatgggtttgagatatggactctccaagtacaagctactcggcgacttcggctgtggggagatccaacctatccaagtatatcttctgactagatcggaaccatcatcgtcatcgacaacttggtctatcgagatcatccaagcctcaagctccgcgacataccaaaagatgtcagatcgcatgatatcgaacaagtacgcaacaaggtaattggtagattggtttcttaaattgatctactaatttcgtagatacatccggcatgtatttacaaaggtacgcaatattttatatgcaatttatcgtacctattcagatcatacagcattgtcagatctatgatttattatgtttacctagagcatgttttttatacaacatctattgcgcgagtgtttctgatgttaggccgactacagtctaacactaggggctccctctgttttcttctgtataaatcatgcttgtttacggtttacataatacctgatatttacatctgctagttatatcctgataatactagaagatccatgcagttttttgagtacatactcgatattatctgctatatattttgccttctagaaaatatttttcaggaacaattgagcactcgagtaggttgtggtcgagtacactgtattatcgagaataatctcgacaaatgcagagtcgtcgcgcccaacctaccaacgaagaccgacaacctatctcatagcaccggccatggctggactactcgagaaaaggttgttaatggataattcctcgcgaatgccgtcggcttgatcacccgacatgattgcgaacggacatccggatatgctacaagttgggtatgtgagtcatgctggccacatgagatacacatgtaataaaccaactctagcgcctccattggtgttcgagagataattctactcgctcgctggttcccgaaccagtacgtagcaatctctcgcaccgcaacttccattggtgtcgagagataattctactcgctcgctggttcccgaaccagtacgtagcaatctctcgcaccgcaacctccattggtgtccgagagataactctacacgttcgctagttctcgaaccagtacgtagcaatctctcgcaccgcaacttccattggtgttcgagagataattctactcactcgctggttctcgaaccagtacgtagtaatctctcgcaccgaaacttccattggtgttcgagagataattctactcgctcgctggtcctcgaaccagtacgtagcaatttctcgcaccgcaacttccattggtgttcgagagataattctactcgctcgctggtcctcgaaccagtacgtagcaatctctcacaccgcaacttccattggtgttcgagagataactctacacgttcgctggtcctcgaaccagtgcgtagcaatctctcgcaccgcaacctccattggtgttcgagagataactctacacgttcgccggtcctcgaaccagtgcgtagcaatctctcgcaccgcaacctccattggtgttcgagagataattctactcgctcgctggtcctcgaaccagtacgtagcaatctctcgcaccgcaacttccattggtgttcgagagataattctactcactcgctagttctcgaactagtaaaatgtagcaatctctcacaccttaacttcagatggtcgagggacgactacaacaataacgcagcggtcctcgcaccatgacttcagatggttgaggaacagttacgactagtcttcgaccggcagcgtagcggtcctcgtaccacgactccaaatgatcgagagacacctactcactagttctcaaccagtcaatcgtagcgatctctcgtacatttacttctagtggtcgagtttagactacatctggttctcgactagcggtgtagcgattctcccactaccctgacttctagtggtcgagtttaaactacacttggttctcgatctgcggtgtagcgattctcccactacctttacctctagtggtcgagtttatactacatctggttctcgaccagcggtgtagcgattctcccactatttctacttctagtggtcgacttgcgactaccacctagtcctcgaccagaggtgtagcgattcttccattacctctactccaacaaagttgacatcagatacacaaaatcgccaagtgttttacccagagatcccttaccacaaaagacacctagcgttgaaacctatcctaatgtccctttacgccgtattaataaggcctctgaggaacctaagggaacttcggctggggacgcccagagccgataaggccttgtcggatccttcagagacgaaagaccatgtaagatctggtcgtgtaagagttctcgccgtgcgtattaaccaagccgtgtaatcggaaattgggttttccaatttcacggctgggggctagaatcagtgcttgttcaaccgaggcaggtcaaaggtccaagagtcttatcctccgagaacgattctccgacgacaaggctgggggctagggagagtgtataactcaacaaactgactgatcggagtcggtaaaagagtagacgctcatatacaaaacattggtctgtaagtttaattcattttcagttttccatacatattataacatgtcaccctttgagcattcgctcaggggctatttgtatctaatattcttttctgagtattgattttaggaaaattctattcgacattatcgaagatcgcatgtctctatggttctacaccaagatcgactaaggcgaatacgacaaatattgacaaggctccgtcgcagattatgcactttctcgatcactcgagaacggttgatcgatctcgacaaggaatacggaatgaacaaatggtgtacccgccgagataaaatttcttgacttcaatccaaattctcgattacagcaagacgggagactaagacgggagacttagtcgtatgctttgtactttcttgtttgacgtcggagattgactcagacaaaccctttaggtgtccgcacgaggctgataaaggaagtctaacgttatctctgaacttatcgagaacggtcacgtgcgctcgataacagttcctccaaggtctgcggttgagaatatgaactcgtttatttgcattgaagtcgggggatactgtcagggttatggataccatatacctaatagtagtcgactaaatctcggcaggacccactacataccatgtcctatacggaagcaaccttcggatataggatataggaggagttccgaataaggaaagacgaccaccacgatcaacacacacagaggatcaacacccaacacaatcgacatagaagccacaacatagaagcctacatacgccaagacacgccgccggatatcgacttcagggataaacacggctagtaccctacggtgtctccggatactgtcaggagagacgaaagcgctatctctgatctcgccgggcacggattcgaggaggaagactaccatgttatcgactacgagtcagatcttcagaccgccatgtcgacaacagttagatatgctaccccaaatattgtactagtgtgattatggtgaataagagcaataccggctttggccaacaggatgtagggttattacctgacaattcaggggcctgaacctgtataaaagtccttgtctccatctcttttacctcagtctcgtgtatatcctagcactgatgatccccatgccatgcaaataccgtagtcgagacatcgaacgtcgacagatttaattgtaataaacataattgtaatcggattatagatcagataaataatttgagagaaaactttatttgaatgaagaggaaaaaggcatacatgatctattaaaaaaaaggcaggcaggcactacgttgatccttctcattgagccattagagcgcggccacgcggatgtacgtcaggacgacaagcacgatcgaacagctgtgaggcgtgtcgcgtgatacgactaaagcgagaagcctcttggtttagattttacgtaccacctaaggacctaaactaaaccggttttgtaagttaaggatctcatatattgattttctggttgagagacgattttatagtttgatgacaagatgaaggacctcgtacgtacttttccctatcatctaacagagcagcagcatgagatgaacccagtagattaaaagcccgcatgaaattaactatacagcgaccgaaacatttcggccgtgtttagttaaaaaataattcttcaaacttccaacttttccatcacatcaaaactttcctacacacataaattttcaacttttccgtcacattgttctaatttcaaccaaactttccaattttggtgtgaaacacagccttcgctcattggccggagaaataagttcatctgaggtcccttgacttgtcaacgaatccgattttcgtccttcaactgaaaaaccagatacaacaggtccctcggctgtcaaaaccagtgacataggtcccatagcggtttggacggtgtttttatctgacgtggtgcttacgtggcaattcgaccgtgaaaaataacaaaacctctgggacccacatgtcagcttcacacatacaataatttcaaaaaatggtggggcccacctgtcattctcaatcccctcctcttcttcctcctctctccctccccatctcccctctcttcatctctcccctctaatccctcctctcgccggcggagataaggacgtcctccattcccacccccatgggcctaccgatggcggccgccgcccctcttctcgttgcccgctgcgcctgcctccgcctccggataacccggcggaagccgcggcagccgcccgcatgtattcaggttgaacgacgcgcgggacttgcctagcgcgatggactcggcggcggcagagaggccgagctcctacgccgtcaacttcccaccgctgctgcccgcacccgcgcccgcggtcgccggcgccatgggtgttgccaaccacaagagtgtgctgtgcatgaagtggagggaggggaggtgccacaacggggtagcgtgtcgctacgctcatggcgaggaggaccaacgaattgtgccggagatgagagtcggcggcggggggacgtccatgcatgcccggagctcgccaccaagggatggtgcaagttcgggctcaactgcaagtattgccatggcggcgtgtaggattgaggagcagcgccatgggagggggggggagtccttcatcttaccacgctcgcggaggaaacgtcaggttagagttagccagactgaatccatccgaatcatctggtcagctgttttgcttctgttgtggtcagatgaaccactgggtttttgttgctagatcgagtctactctagtcatgcgtttgatttgattattcgactcgtgaatccatccgaatctgaattcgaccaaggaccaatacactgtttgtttcttttttggtcagatgaaccactgcgagttttcatttgtcagggtctaggagaacaagattacaagaactgatgaatttgattttgaggggcgccgcggctgcaggctctgggctctggctcggcacgttcgacggcgccgacaccaccgcgcgcgcacacgacgccgccatgctcgcgctccgtggccgcgccgcgtgcctcaacttcgccgcttcgcccctcgcccgtgccgcccccggccaccctccacagcgccgccgacgtccagcgctccgtggcgcgggctctggaggacttcgagcagcgggagtcgtcgtcgtctgtgtttccactcgccatcgacattgtcgccgaggacgccatgaccgccacatccgagccgtccgccacgagcgacgacgatgccatcaccaccaccaccagcagcagcacgaccgatgccgacgagctggacgcggctgtcgccgctccgccaaaatgagccatgtaggtgccacctcagccaaaaccagacacaatactatcgagggaacttatttaaacggtttcttaaattggggatctgcactggacgacaaatagagggacccagagtgaacttattccttgaccggatgaagagcctaaatgctaagtgggtgacaacctatgaggaatggatggcccaatgaggtctccattggatgtgcctcacttccggcacatccatgtcatgggctggaatttaaaactaaaaggaaaaagtacaccgaagcgcgggcggcccagggaggagcggcgcgcgggtggtggggggaggagctgtggcgggcggcgggagaggggcagcgcgcgggcagcgggaagaggagcgatgcgcgggctgccccgccggccaccgctcacgaggaggtccccggccgccgccgcgcatctgccttcatcatgtccggcttcaagtcctcgcaagcggaggtcaccgagtccactccgcgccgcttgctcacgcctccctccaaccggcacgccgactggcggcggctcccggacgccgccgtcgcccgcgtcctcgacctcttccgcctcggctacctcttctccccgcgctggatccacctctggcaccgcctaccgctgtatctccacgaccgccagttcaccactccctcgatccccgccggcaacgttgcccaagcaatcaccaacgtcctcgagctccatgttggcaacggcgtctaattcgtacccaaacaaggcggcggcggcggacatggatgcaacgaggtagctgccccgggtggtggaggcggcgatggcggacatgaagacgccgacgtcagcagcagcgacgaggagtgtgacatctgcgacgccgccatcctaaacggcggctatgacatcggccgcgtgttctgcttccgagtagagaccacgcggtggtcccagatgagcaggtacagcgccgacctcctcctctcccatcggccgggtgccacccattctctgccgcccgcccgcaactcattcccccgccaccgcctcgcgggcctcgtgggcggcagccggcgggggagcccgcgcgccgcccctctcccggccgcccgcacaccgcgcctcccccggccgcccgcgcgccacccgtcgccgatcgctggctgccggccgccgacgccctcctctcccacctcgcattgccggcctcgcagtcgcagagaatggagagagagagagatgaggatgggagagaagagaggaaaagagagagaaaggctgacttgccaatactgacatgtggggcccacgtgggtcccacgctgactcagccaccacataggacaaaaccagggtcaaaacaactggaggatataaagtgcatggttttgttagttgaaaggtgtccggtatctggttttgcggttgggggacgatttcgtaactcgatgacaagttgagggacctttggtgtaccttttccaaactaaaataacctcctctccatgtggatgggtcggattaggcccactaaaggaattaaaatcgacgatgcacgatggatgatggatatttcattagggcgaagctatagcaatttattggggttaggagaccccgatgatttcttatgagtccccttatactccttcctattttatagctatgaccccggtcaaataaaacactagaccccggtgattgtttcgttaaagctcatttggtggcaaggaacgatactattatcaactagcaaatagaaaattagttagcaattgtgattatacgtcagtctagatagatatacatatatgttttagactggcgctcataaagtggcccttatttaggataaccaactaatcctattattatttcctaattatcatcacaatttggttgaacctggtctctcaagtttgaatttgacgaaattagagttctgaaatatgaacgtttgatttttcaagttcaattacatgatcatgaagcatgagcctggggaaatataacaaaggtaattttcaccatataagaggttgttatattcttttcccaaatatagtaacctagtacaataatgatatggttgtaattgaggccttgtttagtttccacgtaaaatttttacaccatgtcacatcgcacgtttaacacatgcatgaagtattaaatataggctaaaaataactaattgcacatattgcgactaatttgcaagacgaatcttttaagcctaattgctccatgatttgataatgctgtgctgcagtaaactttttctaatgacggattaattaggcttaataaatccatctcgctgtttactgatagattatgtaattagttttttttattagagcctgatcaccccatgtgacatcttatataatatccgatgtgacacgccaaaactttacacctctggatctaaacaccctctgatatgtaaaaggtaaccactactacaacaatagacttaaaattattagaagctatagccaattgttaggatcgttaattaatagtgacctcggtgaccatctatcctggcttcgcccctgatttcatatcactagtcatcatcccatcaatccgtgcaataaacataggctgcaagtataaatatatattttggatttggatacagagaaattttataattttagttttagagcatagtttttaaatttatgcttcgtttgtcttttatttccggatattatttcgttattggaagacatacatgttgcttataattaactagttgatacccgcactttaccgcgggatacgtggttaaataaatgttattatataaatgatagatgtatatgtttgaataatgtgaaaatggtgtcgagataatgattaaacattgcttgcataatgagttctaaaaatacaacaaaattgtaaatgatatgtcatatttacatgatatttaaaatactttagacaataattgcttgtgtgtgatgatgtgacatgttagagtgcgcagccccgcccaccaacttttaagtcgtgctcccccatcatcaattaccgatgtgggactaaacccaacaatctccccatcaacccatgtgaccccaccatgtgacatgtggaccccgaagacttgttaccggcctcctcaccaagtgtcccataaaaattgttctgggtttcaaacgttgggctctgataccacttattagagtgcgtagcctggccccccaattgtgggccacccaggtcacattgggcctgctccaccacaggcccaatcggagccacaactttaggtcatgggtctacacaacccaaaagactagtctgataggtgaggaccgtcccctaccttttaagttgtgctccctcatcatcaattatcgatgtgagactaaacccaacatgacatacttgcatgtgatgtaaactactctaaataataattgctagtggatgatgatgtgatttttatcgtcattaatatttggtatggaaactaaactcaacacgacatcgaatacttctagttgtttgattgtagtcattgaaaagggcaaacactatttttgacacaaaccaagaaataataagaatagattattgtgtttgattatcatgtgccttggatttggctacgtgcatcaagttgtcacgacggcatctgagcagggcgttcaaactaagacgtcaacagcggcccagcagcaagatcgacccaaaaggatgaagcggcccaacgcacgctttccgttgagtgagtggacccagtagcgaaaggctaggccactgtcagtgagagagactagatggcgcattgctatatagtcggcaggtgcgaaagagcgggatacgaaatattgtattcaaactgaaacctcaaactcaattccaatctccctccttctcctctggttctcgttgtctctgttcttcttcttcctcaagtcagcttcttttcccttctgtttcgaatcataggagagttcgttgcgactcaaatccgagttcgtgacatttggtatcatagcagcgatcctggagaagccaaggtacacgtctcgtttgcaattgcaggttgaggccatggagaaacagaacctcgacttcagcaaaattctcggcgacatctaggattcgctgatgtcgttgaacaacaagcaagcggagactcaggcagtcgtcgcgaagctggatgcaggagtcggtgggtggcagcctcaagtggagtcagcgattcaggatttgtgcgacgaggttggcgaacttcgtcagcaactggatttccttggcaaatcgatgcaagcttcgccgacgacgctttcccctcgggttccgttgacggatgaggaaaggaaggcgccgttgctgcctacgccgccgacatcttcgcatcaagtcgcggcggaaggcggaagcaattgggcccatggccacggcgctcaacagaatttccggaggagggcatctggagtggtgaccactctgatcccaactctagacaaggctacgtttgaatctcattcagttcctttgcactcgttggagaatttcaaatctgattcggaggttggggagtttggttttgaacaaggcggtagacagtataatcatagagttcctaaactagatttccctaaattctatggcacggacccccaggattggaggatgaggtgtgagcactattttgatgtgaacaatacttttccagggttgtgggttcatgtagccaccatctatttctatggtagagcagcatcctggttgcgttcgtctagggctcatgtgcggtttcctgtttgggatgatttttgcatagcagtttccactaagtttgatagggatcagcatgacatgttaattatacaaatggatacaattcgacagtcgggaacagtttgggaatactatgagaaatttgacgagttgatgaaccaattgctggcctatgatcctgtcattagcaaaaagtatctggtgcatcgctttactgaaggattgcgccgagagattagaaatgcagtattgttacaacatccccgcgatttggaatctactctggctattgcgtctttgcaagaggaagtgctggaagctccaccggagtctggagtgaaggactctaaaggaggaatgcacattcgctctaattcagcattaaaaggggctttgccactacctctaccaccaggcaaaggagttctatctgcagttggaaaggttgatgacaaaaaaagggaattgatggtggtcaaccaatttggggttctgacaagatgattgctctaaaggcacaaaggcgagctcaggggttatgttacatttgtgctgaaaaatggtctacaactcatagatgtgctaactctgtccagttacacgcagttcaggaattattctctgttttggatgcaattggagagagttctttttctgaatctgctgaattgattacgtctgaagaacaagtagtaatggttgtaccagttcacgcaatacaaggggcagaacatgtgggttcaatgaggattttgggttatatccaaggtaaggaggtgctgatactggtggatttaggcagcacagctagttttctcagttccaaggtagcagatcagctgtcaggagtgcagttaattcctactatagcacaggtaaaggtggccaatggagctgttttgtcttgtacagctgagttacctgattgtgtttggacgactcaagggcatgtgttttacaccacctttaagattatggccttaactaattatgatgcaattcttggaatggattggttaatgcagtgcagcccaatgtcagtggattgggtacaaaagtccttggttatctgctggcagggaaaatctgtcactcttcaaggaattgtgccagaattgcaacagtgtcaaatgatatccactcaacaactaaaagagttcagtgacaagagagcagttgctcattttgttcagttatgttctttggaggacagaggatcttcagaacaaattcctgtcaagattcaacacgttcttcaagaatttgtttctgtctttgatgaaccaatgggtttacctccagctcgatcttttgatcatacaatccctcttgtccctggtgcagtgcctgttaatgtgcgcccttatcggtatacaccggctcaaaagaacgagattgaacagcaagttcaggaaatgttggacaagggtataattcaacctagttccagcccattttcttctcctgtgctattggttaagaaaaaatatgggacatggcggttttgtgtggactaccgccatctaaatgatatcactgcgaagaataagcacccattgccaattatagatgagctgttggatgagttgtcgggggcacagtggttcactaaacttgatctcagggcgggctaccatcagattcgtatgaagatgtcggatgagcataaaacagccttcaaaacacatagtagccactatgagtttcgtgtgatacctttcggcttgaccaatgcacctgccacctttcagggtgtgatgaacagcatcttatctcctttacttcgcagatgtgtgctggtacttgtcgatgacatactcatttacagtgcaactttggaagatcatgtgaaccacctgcgacaagtgctccaaattctggtcaagcatcagctcaaggtaaaacagagtaagtgttcttttgctgaacaacggctttcctacttggggcatatcatcactcccaatggtgtgtcgactgatgacgacaagatttgagtggtccagaattggcaaatttgttgcttttcttggaattaacagggtattattgcacatttgttcgtcactatggcatcttaagtaaaccacttactaatctgctgcaaaagggtcagttgtgcatttggacatctgaaacagaggcagcctttcaagcattaaaacaagctttgattactgctcccgtcttggccatgccaaatttttctgaaccatttattgtcgagacggatgcttccgataaaggcattggtgctgttcttatgcaacaaaagcatccagttgcttttctcagtaagtctcttgggcctcgccatcagggcttgtcaacatatgaaaaggagagcttggccattatgctggctgttgaacattggcgcccttatctccaacatgctgaatttttcattcggactaaccatcgaagtctatcttttctggatgatcagcgtctgaccactccctggcaacacaaggctctcactaaactactgggattgcagtacaaaatcatttataagaagggcactgataatggtgcagcagatgctctgtctaggtatccttcttctgccactttagaattgtctgccttgtctgttgctttgcctgattggattcaggaggtggtgtctggttactcgcttgatcctgatgcttgtagcaaggttcagaccctatgcatcagtgttggtgctgtacccaatttttctctgaaaaatggtgtgttatatttcaaggattgtatgtggattggtaccaatacagctgtgcaacagaaaattttagcaaaccttcatactgctgcagtgggtgggcattcaggcattcatgttacttatcaaagagttaaacaattgtttgcttggcctcgacttcgctccacagtaactcaatttgtcaactcgtgtgatatttgtcagcatgctaagtctgaacatgtcagatatcccggcatgttacagccacttccagttcccgaacatgcttggcaaatggtatctcttgacttcattgaagggttacctcgctcagattctttcaactgcatattagtggtggtggacaaattctccaaatatagtcattttgtaccgttggctcacccctttactgcccttgatgttgcagaggcttatatgcagtacattcataagttacatggtcttcctcagtctctcatttcagacagggatcggatttttactagcacattatggacttccctctttaaattggctggcacccaattaaggatgagttcctcttatcatccgcaaactgacgggcaaactgaacgtgtgaactagtgcttggaaacttttcttcgttgttttgtgcacacatgtccttctcattggagtaaatggctcgctttggcagaatactggtacaatacatcctttcactctgctttgggcactactccttttgaggttctctatggccacaaaccttgatattttgggttgacagttactgcagcttgtcagtctactgagcttgctgattggcttcatgagcgggagaaaatgcaaactctgattcgggatcatctcctgcgtgcacagactcggatgaaatttcaggctgacaatcgtcgttccgaacgagtttttgttgtgggcgattgggtgtatatgaagctgcagcccttcgaacaacagtcagtggtaactcgagtaaatcgcaaactctatttccgtttttatggtccctttcaggttttggagcgggtgggggaagtggcctatcgcttggcgttaccctcctccagccttattcatccagtggtgcacgtatcacaattgaagcaagctttggcaccaagtgaaacagcgtcgcccaggcttcctgttcttcgtccgaaaccagaggcatctccggtaccacttcaagttatggatcgtcgatttgtacgcaaaggatccaagatggtggaacaagtgttgatcaagtggtctggcggtgaacctgccaccgtcacctgggagaatgagcaggagctacgtcgtcgctttccaactacaacaacttggggacaagttgccactcaagggggaggggatgtcacggcggcatctgagcagggcattcaaactgagacgtcaacagcggcccaacagcaagatcgacccaaaaggatgtagcggcccaacgcacgctttccgttgagtgagtggacccagtagcgaaaggctgggccactgtcagtgagagagactagatggcgcattgctatatagtcggcaggtgcgagagagcgggatgcgaaatattatattcaaactgaaacctcaaactcaattccaatctccctcctgctcctctgcttctcgttgtctctgttcttcttcttcctcaagtcagcttcctttcccttccgtttcgaatcacatgagagttcgttgcgactcaaatccgagttcgtgacacaagtcatatagaagttgcaaattaacttcctattatgttgtctttaagaaacatatgtagaagcaaatacgatcaaagctcataagacaacaagcaccatcaaactaaattaattaatttgttctggagatgatcgtatcaagatcgatcagcatacgtgttgctttaatttccaaacagatcgattaattgccaacgcaacgcaagctcgagcaaagggagaagtgatcgctttggctttcgaccataatctttacggcaaacgcctccattaattccatacgtacaaacagtttagtgacacttggaaaagcaaagcatatgctaaagcatatatatagatgctgtgatcgaattgataaacaggaaagcaatggtccgagatgcatagcacaaaagcatgcaagaaccgtcgtaacatgtacgcgtggactgtaagccatccaaagtgatctctggaatcagcagagtctacagacctcttctcaacttcatctaggtacgtatacattggtaggatgggcctaggcttttgggtttacatattcaagatgtttttttatataatggatattaaattcggcatttgctttaattgaagctacagtcacttattacatattcaagatgtaaagcataaaaaattgttttgacagttgtatggtgtgtcgtacgagattaccagagtaggtcatcagcgttcagcggagggaggagagagccaggcccaaattaaaagatgggtttatgtacttcttaggttatgtcatctttttcattttttaatgtattgcatattgtatgtaccacctatttatttacaattcctaattagtctatatagagtaaattattatatatatcacacattttaatgtcaattttggtgtaacactatattatcttcgatgcctcttaattggttaattacacttcccgtcaggcagtagaaatctctaactttccttctgttcatgtttttgctacaagatttctgtgttccaaataagaccttaactaatatttacatcgcaagtactagcgacatgtgtcgacaaaataatgatatgctttacatctcgaatggatgtcggttaggatacgcatcaagtctcaaaatcttgtatatatgaaaacactaaaattttatatgtgaaatttgattaaaactgtcttcgtttagttaattatatttttaacatatttatgaatatatcattacaaaaacaaaaatcgaacataggcattgaagagactatgtcagtgtcagtgtcagtgtaaattcgggagtatgtcatgcatactaaagtttgacactcttaaatttaaaactagaggttaaattaacgtgatctggaattgacgatagatcaaactaaatgatatgcagcgaattgttgcaggatatagaagcgacacttcaatgaaatgtgtggtgataaaaaaaatgatactacctccgtcccacatttcccacattactggtcgctttgagtttttttttaatatttgatcatttgtcttatttaaaaaaattagaattattatttattttggttgtgactagttttattatcaaaagtactttaagtacgacttatcattttttatatttgcactaattttttaaataaaacgaatggtcaagcgttgcaagaaaaaatcaaagcgacatctattatgggacggaggtacgtagtagagtggtataatacattaataaaacatgtatgcgaattgaaaaaaaaatgtttgctttaatcgtgatatactgtgagaaaagttgttgagacataattagtgagaacattgagagactaaaatggcatcagagcagatacaagagcagatacaatagcagactataagccagctataaacacatttggagaagataacataggagagagaaggacagcgggtacagatttatagccagttataacacagactccaagatgcatgtgcgtatgactggtggaaccaactatgaattgtgtagtatgcgtttagagcaagttta

SEQ ID NO: 3527 - DNA, 9946 bp, Oryza sativa
tatatatatatatgcatggggtgtgtgccatgccaaagtgagaaggtccaattcaaagtatgcatgtgttagggttcgattctgattttgtttctcccattctctcctcctctcttaccataattagctatggttttagcatgtcatcgtctccctctattattgaacaaccgcccagtccctcttccttcgcaccaccgtcctacttaaccttttgttgaacatgctctctctctttgagactttttcatgttttattttcaatcatgattgcattcgacgttgcaagatatcatggcatacaattctatgatattagaacgggaagtgagtgaaaatatgtaggcaatggacgttatatcgctggacctattttatacgcgagatgattttttgttacaaaatcttagctgaagttgtaacgtaactaacagatgaaattgcatggtaggtcagcgtgatgaatattaaaatttaattacgtacactactacaaaacatcaaatagatgccagcactataggtgccggaagtgataaaaccggcgtctatagtgcctttcgaacctacgcgcccgtgagcccgtcaaaataccaagaaccggcatccttatatcctaataggtgccgatttttttaaaaaaatcggcaccttttacctctgtcagagatagatgctggttttaaattaaaaccgacatcttttagttagcgtgggacccgcccggcacctttgtggacaaaagaaatagatgccggttcttactcaaaagcggcacctttcatataacccgttggtgtccagctaaatataacagagaggaatattccagtgaatatcccaagtgatgtccggttgtcaggtgaaagaggtcaaaggagaaggggaatgtgggtcccatgggtcccacttccttttctattctttcttcttctctcctgcttctttccttcctcccttatctaccctataattcattcaccaacacaatgttacattcctcattcctcattgatcggtcaggatggtctctctaagatccaacgattcaggattgactgtcacgtcctgataaattcatcccaaaataaaaatcattctctaaaaggaataatagaattaattaaaatgcgaaaagaaattggcaaaccctaaaatacgtacaagaaaaattcaaatgtggcccggagaatttttggtaaattctccttggtctaaaaggagccctcaaattttagtggaattttcagagcacaaataataattgagaagaaataaacaaagtgaaaaggttttataaaaagaaaaaccctaaaagaagtctgtttcccccccccttcccctcttgggccggctcggcccagtccctccctctctctcttcccccgcggcccatcggctccccgcgtgcgcgcgcgccgctgacaggcgggcccgcccgccactctcgctgacgggtggggcccacctgtcatcgccttcctcccgccgcgcccgccgccgcgcccgtgccctagcgccgccgccgccgcggattccgccgcatcccgccttccccgcgcgccttaaagagaggggaattactccccgcgtttccctctcccgattccccctcttttccctttctctctccctcggattcgtccggattcatcccgcgaagttcgccggcgtcttcaatggcgcccgagatctccgcgcgcggtttcctctctctccggacgcgctctccccctctcggcgctatatatttgctccccgtgcctccctcctccgtttccgccgttcgccgcttgctctcgccgtcggattcgtgctcgcgacgtccacctctctctccgccgtcgccgccgacatccggttcgccgccgccgccgctccggacgtcctcccgactcggcgccacctcatcggcttcgccgagtggttgccgaccccgtccgccgctccgcttcgcccgccgaccgccggagcaccgtcgtcatcgtcatcccgaaccgcgccgccgctttcctcctctccggccgccgttctcgtcgtcgtcgttgtcccggggtgagccgaggaccgccgttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgtgggacccacggcgccgaccgccgccagccgcgtgcgcccggtccaccgtggaccgagaggctgacgcgtgggccccactcccgtggacccggtccgcgcgccctctccctcggctgacgcaataaatgggatttttaattaaaatttaaatgaagaaattcgtaaatatccatttaaagagcatataaacttcaaatggccataacttggccatttgaactcggaattggaccgttcaagtctctaatttttccttaagaagtaaagaacccatttttgtgctttgttcctgctgttatgtggagtttattagtgtgtaagccttttcttttccgtcggtcgtgtagacgctgcagcttcggaagatccgctcttcgtggaagttgaagccggcgtttgggaaagtgagcaaggcaagtcacatcacccttgagcatattgaatcccagtttataaaattattttgatttaaattattgcattatcgctttgtttaaattcccgcgttatcactgttttttttagccatgcctatttacctttgttatgacattattattgctattgttattattaccttgttcaccctagaataaacaaaaccccaactagtggacattatattcatggttccactagtatgaatttaggtagatgcttcgctgattaattaggcaacattaggtggttttataactttagactttgggaattctcatgtcatttggacactttggaattgttggattatggtggaattggacatacacctctcttcctctttcaaaacccctaaagcctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggcgtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctattattattcccttgtacttcccttgcattaatcatgcatctgccggtgtggcttgctgagtaccgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagcgcctttgtaataatgtaagtattgtcgatataataaagatgtgtcttttatatcatgtttgtgtggtgtaccccggcttttcctgggacggggatcaatacactagcgttcgggaaaaggcaattttcccggtcgcgacattgacccaccttccctccttctacgatcctactggcaatcctccaagagtcgattgcgccccttggtaagccggcgagctaactcctagcggaatcggtgagtgtaacgggcaactagtttgccatttcttttgaatctcctcctgctgcgtggatggtcagggtgtagacggtaagccatgatggtaagctcctggataccctcttgtgaaatagctctgtagccgctgcaatagcattctgttttggcgtgatgaagacattggtgttgacctctgcaatggagtctggaggttcgctttgtgggcagcatacgctgtgatggacagattgtgtttcctgtggtcttccacttccttgcgtttgcgtccttccttgatccttgcttgttcatcttcggccttcttttgcgttcttctactgtgtgttgctctgcttctcgggccaaccgaggttgttcgtccccattgactgtcgattcttatgatctgcaatataatttatagggtgcactagatcaaggagagatggtggcacatatgtttatactggtttaggctctcgatgtgaggtaataccctagtccagttgtatgtatattgaatctgtgtaggtatgcgtagtacggcgttggaatagcacgtgagcacatatgtggagaatggctgtgtctaacctgtttatatagaagctagggcagccgggtggatatggtacggtatcccgtataatccgaatacctaccatctatttacatgggataggaataattgcctaatccttaatctttttctttaattacaagtaagctgcgtgggcctagggcacttggcccatcccatgctattcggcacaaaggcaaaacatgaggtaaccgggaaccatataccccacagtagcgcttgatgatgactccgaactaggtgaccccacagtagcgtttgtaacaagttgctgactggccgagtgacaattttgcgtaccaagttaacttcgcatgtttcttccaatctggaaggtgtcatagacttctcggtgacagagaacgatggtcttcaccggtgacagagcaatgttgggtgtggacgaagtgatatcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggtcatgtcaggcccccccgggaccaaccgggactaaagtcgtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaatactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggatgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactgaaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgacgatggttcgcagtggcgaaacatcgacagagaatttaaagaatttggaaaggacgcacgaaacatacggtttggtttgagtacagatggcatgaatccttttggagagatgagcagcggccatagcacttggcccgttacgatgtgtatctacaacctccccccctggctatgcatgaagaggaagtacataatgatgccgattattattcaaggccccaagcaacctggtaatgacatcgacgtgtacctaagaccactggtcgaagatcttaaacagttgtggaagaagaaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggaagtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagctagctacactcttagcaaggcagagaaggaaaatatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacacatctgctttgtcaccttgtgaaagagatccgtattctcaggcctatgtacctacacaacatgtttcctttcgagaggtacatgggcgttctgaagaagtatgttcggaaccgtgctcgtccagaggcaagcatcgccaagggttatggaacagaggaggtcatcgaattttgcgtagaatttatcgaagacctttgcccaatcgggtacctgaatcacgccatgaagggagactacggggaaagggaactctcggaaggaaagcaattatgacggtagacaacaatttattccgtaaagcccatttcactgttctgcaacactcttcattggtagctccttacatcgaggagcacttggctctagttcgcgccaggaacatcggtaagtccgatgtatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagttcaaatcatgtatatgctagttatatgtgatacttacaatttttaaaagttttaaatcacacaggtggcaatttcatatgtacgttaattagagtttttaacatttaatttactaacattcatatgctaattataattgactagaggatttttaaaagttttaaatcacgcaaggggcaattttatatgttaattaaagtttttaacatttaatttactatcattcatatgctaat

SEQ ID NO: 3528 - DNA, 23350 bp, Oryza sativa
tcaatgtatgttgccccgagaacgtgaacgagaacgagaacgatcgaacgaacgagagcgataacgagaacgatcgaacgaagacaagtgagaacgagggaacgaacgtgaacgagctagggaacgtgaacgagcgaacgaacgaggacgaacgttaacgtgaaatgcaatatatatatatatatatgtatatatatatatatgtatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgtgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttaaaatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaagtttgtgtagggttctaatgtatgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaacaagcttgagggtcggcacatcataacggaagtggaagaagatggacgtcctagtgccccagccgaagccgccaagaactatgtacgtcacagcggttgggttgtgcgggataacgtgcctgtcagtagggtgtactggcgaagaacaagggcacgcggagatcatgagagctttgtcccagattcggagaaagagatgctgtggaccacaatgctcgagacattcacccttcctacgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtataggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgtctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtatcatgaacttcttcaggggtatgtctgcatctgtcaaggaggccatcaagctatcggactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaactttctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatatctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcaacgagtactactacgtcgaaatgatagctagctagctaggacatataatggattgtaattaatacatgactacatatgtttctatatgcatgtgtacatattttctataatgtaaatatattttggtcatatatatatatctatatacatatgcattaatttgcataacatatatatgtgtataaatacatatatattatgcatgtatatacatataatataatataatatatatatatatatatacatatatatatatgtatgcatatatatgtattgaaacatatatatgcatggtttatatatatatatatatataaactatatatatatataaaccatgcagcaacagggccatgcaaaaaaaaaaatggtcagctcgatctttagtcccggattggtactcccggtttggaaaccgggactaaaggggggttacgaaccgggactacaaagggtttctccaccagtgtaactccaattcatctgtagccaatctaataggtcattcatacaataattgcatactacactattaatgcctggtcccacctgtcatagacacactgcgtcttagaatctgtgctacagctggctataaatctatagctcgctgctcttctctctcctcatttatctttttaaaatatgtttgcagctagcttatagcctgctattgtacctactcttataggtgactattatatgaatcggctattttaaattaactatagatgatttggagccggtagttagctatactattaaacttgctctcaatagaacttacctcgatctcactaatgctctcaaattatgcccggacaactttaaatataaacaatcatattatgtttcaacaatcatgatttgagactacacttataaagtttatatgggatgaaacaaggggtaataaaagtgtagcctgggagcaagagccattgaggtggatttgtgctcaaattgttgaattattgaagtgaaatgggagtagtaggtatctagtgagtgattatttgatggtttatttcagcattaagtcagtatcaatacttagttagtatgtagtaataagcaatcaatatcaggaataaagcagattaatttcagttttttatgagacaacagttaatgagaggaatggaccatgcattaatagcttttttgttgtatccatggctgatatataagagcaagttcaatagtatagccacctactagctccaattcatatatagccaatctaatagctcattcatacaatagttacatactacactattaatacatggtcccacctgtcatacacacactgtgtcttgtagtctgtgctacagctggctacaaatctgtagcccgctgcccctcctctcttctcatttatcttcttaaaatatatttgtagctggtttatagcctgctattgtacctgctctaagaagctcaatgatataaaggttgacattctcgacgatgtggccacatataatcacagctaatgaggatatttatgtaggaagagtatattagctcagttgggttttttttaatcacgtacccgcccgacttttagtctccaacttaataagggtgctcttattaatttttattctgatttaatataggtgttcgtatatatggttaatattttagtggtatttaatttaattttttaaaggtgttcataagtaagagcgtgtatgtatgtgtttgttctctgtgtttcgaaaaaaatttcaggtgatctgcccaagatttcaacgatgcctaaaccgtatggatacattgacaagacaagtgtgcgctcaagaggactaatacttgaccaccttttgctatattaataattaattaacaaacgtgattaagccacatttcgatcaatagcctagggtgttcttgaagtgcgcaatgaccaggatgaggagagcaatccttaactgattccttctagaaaagactccccatagtttcgatcaaacgacacgaggtgtggtccgggaagtttcttctgtgcctttcttttcatttatatttttctaactcaattgcaaaaggcaaccatttgaccatttagctccagccacggcgtcctgaagatcagaccgctttggtacgtacaacatcttttttccctattttgtgcatgaaaattatcgggtaaaaactaataataataattcagtacgtgtcatgaaagactctgaaatcatagtattttgagaagatattgaaaaggttactgtaagtagaggaggcgctgttatacaactgtctgaaaactcaatttagccttgtttttctctttttttttctttttctgaggaggcttcaatttagtttttcagatacgaaatttgcaaacagttgaaagaataggagtataacagtactcaaacttcaacctagagttgtttagcgttgtacattacacttgttgtaaattacatttatttcaaatgatatcaaactagatactgaaaatctatatatttgtatgcaaacatcttccctacattggtaattttggaactgtttataacttctaattaaacaataattgtgaaggtagcgaagacaccaacagtttggatatatggataataccgtcaaatggcctttcacttagaggacttttacggtacattctacttaaagtatatacttacagtatatgaaagggtagatttggtatttgttaaaaatctaaaaaggattgtttagccatttttaattgagatcatttttttccatcggtggtattttttcggatgtcgtcgtccgtacgtgataccaatccagtctacctcgtacgtggtacgtcgggtcgccggcagccgtacgttgtctcgcgtgtggctcccacagtcccacaagcgccgcccagcagctgtcgtacgcaatgatgccgtcgccgccgccgccgatcgccggaagcgatacagcctccgccgggagcaaagccaacatattgccattctcgtgcgcagcactattgccgccgtcgggcccagcagcagccgtccgcttccagaaacttgcttccgtcagtctctctagcgatataagttcttgagtgttaaaagcctgagcctgtgataatatataactactgcatatttgcatcagacttgtttatgattcaggcttcatccgcttcaataacaatggatacaagcaataattaagttaattaacaagtctaattctctacaaacacttgtgaatcggtacatatgtttttttataaaattcttcttcacttttttaaaattgctgttgtcgcatgccgccgcggggcttccctgccctgctgctgctgcatgccgcactgctgcttcggccacctgccggctgccgctgcccggctgcctttgccgatgcgagctgccgcagctgcccgccagcagcggctgctttgactggacgcctatcgaccggatctaactgagcaaatgcgaatttataaaattaccccctacgcaaatagataaaaagacaaatataccctattcaattttatactgcaggataattaagaagaagatcagattaatttacaccgttagatcaaatataatggcagtatatacttgcagtacaatgtacgtaaaaatcctcttcacttatacctgcacaagaattcaacgatcaaacaatcggttcatgatctgcaatatttggacaagaataaatgatctctatcaacaatgttcgtgcatcctttctttcttggaagaaaggcttaagggggattttactctacatatgcacagggtaaaggtgtcaaaaaaactactttggcaatcatggattgattctcttatgtaacctcttgttttttcttttctttctgttgtacgtatcgttctgtaatctgtaaattgttaatagtagtatactagtatagtgcagtagaaatcaaaaaaaaaaatcggtgtgttttttgtttaaaaaaaaatcggttcatgctgtggtaacggtatcaaatcacataaatagttatgcttagcaatttcggttttgatcgattgattgttgaaatggtactgcttatttgtatatcagaactaattcactctgatatcacatctctgttatatatacatatggagaagtatagtaattttgaggagatattgatgcttcatttgaggctgttttacccacagaaaggtattcctgagtttatctgttcttttgtacaaaatgaatttccaagttattgtgtcaacacatatataattgaagtgtcaacacatatataaacgtatatgcgtgcaatcatgcatagggctggtggcaagttattataattgaagtgcaaacaaaaattgagaattcaggagtacttctacaagtcaattgtgcaaaaacctgatgtgaacgtaggagttgtctgaaactctgaatgaatattgccctttctgctcagcagaggccaaaggcaagtgaccgagacactgaagcaagaatgatactacgcacttgtgtaatacataaaaaaaattatacaaatacttagaaaatattcactcaatttttactcaaaaggacttctgtaaggacttctaatcagcaaagttctactctgaacatttctttagtcaaactatgctttatattttgattgaaggagcagtagccacataggagttcctgaaacgcacgctacttgggatatatcatcatcctatataaaaaattgaagagatttattattcacaattgatgatgccatcttcagatagaaacaagagtacccgcacgggataacttgtaccaatattatctatccatttttctactcacaaattaaaagcactgtgttcagaaaccacaggtgtcacaggcaatcaaaccaagaacatagaaaatcaggcgcccacatgattcccccaattgccagcagatgctgcagaagattccaaacacatctgtctctacttttatctccttttcctctccactagtattttatttttttgcaatatttttcacactccaaaaccccatcatttttcagctataaatggccccctcctccaagcttcaattcccttttcccctcttccccagctcctttgttaggttttcttccagtgagctctttttgctcatattcagatcttcacttatttcctagttgttactactgcctttgagtattgacagcttcatcctgccaactcagctcaatcttcctctgaagtttcagtctttgtttctgaatctcttcagtgttcagaggggaagttctgccaaaaaatttctctggccatccattttccaaggggagattctgccaaaattttcatctctgtccatcaatattcctggggaggttctgccaaaattttctctgaaatcggttaatttataaggggaggttctgccgaaattttcgctggtcatcaatcttccctttgttgacataccctgcataagtatatacaacaaacatataactttttgcaaggtaagaaggagtttttatctgttcttgatgatagactcctagagaagttgtcctagttgtgtagatgttgttgctcatcatccctgagcacctcctctctagatttatgactggcccagccataacccagcttgttcagtccttctctgttgtcttcctctactggttctatgtcttctcagtaagctccctgtagttgtagccttttgaaattacaagacttatttatacaacataattatcaaggcatccacatataaactacaaggtatatatatatatatatatatatatttacaaaaagaaaaggaataagagggagtaaaattgttgccggtgcgaaaaaaaaaattgttgagaggtgaccatgtcgagtgggacctcgtccgggtcgagccagggaacccggagctccaggtcggaagatgacctgaacctccaggcccagatggagaagaagaggaagaggaggaaggagtcgaaccgagagtcggctcggaggtctaggatgaggaagcaacagcacctcgacgaactcacctcgcaggtttatatatatgctctgcttataatatatatatatatgtgcacaaaagtctaaagtttgtgatgcatacatagatctagtttattgtttttgctgtcataattgttttactttattttatctttatatgatagcttgcactcatgtgcaggtagaaagcaaaaaacagatgaaaacagaagtgccacttgaaatatctgccaaaaccaactcaataattgtgctgcctttttcaaaaggccccatcatctgtttcctacctaattcgttcaataacactagaaaacaattcatcatcatgatcttccttgtcataaattgagcactcaccaaactagcatcacaaccctgcatcaaaaatcaggaacagaagtctaaacacatatcactaagaaaatattatgtgtcactgaacaggtgaaccagctgaagaatcagaaccagcagctgagcatggcactgagcctgaccacacagaaccttgtggcagtgcaggcacagaactcagtgctgcaaacccaggagttggagctgcagagcaggctgtgtgccctaactgacatcctgatgtgcatgaacaacaccagtgctactcctactcctacaattccagccaccactacaagtgcttgtgatatttttggtgccagctcatggaaccagccacccatagacttgtaccagtaccagtgcttctgatctaggaataagaagagggttgttgtggtagtgtgggtaggaccagaagccatcaagtaatgtttcaatcatgtagggccattgttgtcactgttaatgtatgcaattcaatcttaattgcctgctgtaggggacagggatatttgctctttcttgtagctgttggtggtagagggattaccagatggcaaaatggtgctttggcaatgtgttaggtggggctggttttggttgttaagggtagggaggagaaaattggtaggtttttcttgagcatgcaagaggggaggcaaaggattttgtgtaatgatgctcttcaaggaaagtattcataattatgattataatgtaatatgtggatttggtggatcttcataggccaagtgcttctttgtgctccatatgtgtgtgtggttatctgaaaatagattatatgattaacatctctatttattttgagtattggttcaaaaagggtagaatgccattttgacatagtttttcttttacctattatttgcttcttactcactccagtgtcaaaattattgacgttttagctaccgaagcaaagtatgctaattcttgacattttggttttgcttgtgcatcttgaatctgcttgccactgcatgcatgtacgcagaccatgtccaaaacatcaaaaatttcgaaactggagggggtatttcttttacacaagtgtcaacatacatgacgaaagctgcagtcgtgacatatgtaaaaccacctttttgttttttcatgtgacctagatatttcgtcaacttttcttcacttatttctcaaggccctctatattgaaagcttgagttttacccttaattgtggacttcatctagcacttcagatttagcagagccatggaagcatttatcaccttttgaaggtgttatgtccaagtctgaacatttagatacagctcaaagggcattttaatttgtatagcatcaatatgtctggaggacatgtgaaatattttctccttactgatttgtctaatgaaaaatctagtatttcagacaaaccttgcttactgaagaaccaaaatgaaaatccaacacagcaccaaccttgggaagaaaagatctagaagatgcgtaagaggtgaagaaaagaaggttgatagctatatgtcttggtacgtactgtagaacagtgggagcacttatcaactttttccaaagtgcgatttcacaatgaaccaatcatcctttatttcgaaaacgaggaagacactgttgtgctttgccaaaagctatgtgctcccacatgctccaattccatataacaacttttgcaattctctggcttcagcaggaaaaaaaattcatttctctgcataaacacctcttggatgcatcctttctttcagaattttgagctagacaaggagagaaacacaagatctctaccaaaatccatagagcctaatcctgaagtgcacctaattggatgacagatatcctctacagtaaagctgatttaattgaatcgagctctcatatatacagagctgagctatcctgctgaaaggatggtgagggtgaattttcagagaaattggtacaagaatagataaaggcataactgcccaattgtcgctgttggaatatgttggcatgtgacttcacgaaatggagacatcagcatcagacatggaaatagtaaccaacaggtcatggcaaattccatggtgccattgagtctgaacttacttctgcactaagtaaaatttggtagggaaatccaaatttgagaaattctgatcaagaaagaatggacaaagaagcagtactccaaaattcaatagaagctgcaatttgtgtctaattctgactatttctcatatttacactagatgtatcacaggtacaagctgaaattgcagctggtagtggccaatcaaagaacaaactaatagagaagtaaccaaaattgctgagaagtttcatcccaatcgtttgatcgatcgatcgatcgatcaatcatgccatcttatgagcatcgcaacgcatcggcggatgatgtagagccttgccttctgctccttgagagccctcttgaggcccttgagcttcatgtcttgagcacccatcctcatcttcatgatctggagagatgtgattcactgaaagagatgagacaggctttgcttgttggatttggaagtacaaacttttgtttgagtttggagatagcaatggtacatggtttatataggccgtttgtcatgtgggctgtgtcagcagctgaagtgttttttactctgcttatgcatatctgagtaattaacttgtaactggtttcatgctttgaataaacaaaagatagtttatgtgatcttgaatcaacttacttaaatttcctgaggcttggttgacttgataataaaaaaaattcattgatcacgtaatggcatcatttgctctgcacgatggattaacataaataaatacacaatatgtatggttgagctatgaaaaggttatcctactggtactggacggtgatgccacattgtgagtcactctaggagttcgtgtgttgtgtcttgtaattcaatagttattgcggaatttcttgaagatgacagcgcaagatggtttttagtcaacttttaggtttgacaaaaaaatattttcccagtgaaatgccaagtattctctctttatcattcagtatttcctttttcagatgaaggaagctttattaaaatcaagataattacatcaaggagctacttccggcttctgtataatattattcttttgcagacttttgttagtaagtctactcatttttttgaccactactcgtaatcgaaacaatcaaatttcacccaatagaaccgttataaccttcaaggcagaggtggaataaactcgcccttgctcgctctacctcggtttaaaattcctccaagtctacacatctatctattatatactaaaagtccattaatcttcctacaagcgctctcaagccgtcacgtgacacttctacaaacgcttctagaccgccatgtggcaatgcctaatctcatcgtcgattttcacttaaatcggtggacccgataatttagacgattagattagattagatgtattttatttaaatagaaactactatgttaatgttggccgaaaaaaaacataagaattccaaagtatacgtacgactaaaaatcaataaaactctaatattgttcatcggttcgctggcaaaataaatataagtacctaagaatgggaaaagagcagtaaagcttatgctgctcacctacgattcgttaggaaggaaaaaatatgccagcgtatttagaaaaaaaaattaaagccacgagtaaaataaagccaaaaaatatacgtatgtagtaccatccaaacaaatcgaaaatataattttctacataaaagataaaataaaaatatgttattccacaaatatacatcaactagacatcataaaaaatataaagtatcaaattaacgttatgtaaaaagtcacattttatttttctttaaattatattcctttaaaaaacatacgtctgtagtactattgaaaacaatcgatggtatttaaagatatatttttctattatttaaagataaaatatattattctataatttaagcaaatatcatcataatttttatttaaattgatgaatccaatattttagaccattaaattaggtatattttatttaagaaactaatatcatactctgtctatatagacgggagtaaatgttggcaaaaaaaagaaaaaaaaactgtccattggaagaaagagaaaaaaaatctacatacggacttactataaaaaaatagaaccaaaaaaaatatgtagcgatgaccttttgaaatagtgctttctcttattatttaaagataaatatattactctataaattttgtaaatatatataagtagttaaactagatttatattataaatatgaaatatccaatcaatgatctttaaaagttttatctgaacatacgaggctgatgtatatagtaattaatgctatgataatttttttatttcatatcatattttagggtgtcaagtatcatttaacgatatacaacgctaatttaaaactacatacgtaaaaattaaacaacacaatttagttgttttattttacatcattggattagatttattatttaaaaataatatatttctcctatacatgaatacatgagaaatatagaactgttagaccggaaaccgtacgtacatatgattggaaaaaaacaataatggtcatgtatcgtttcccggaagaacagtaaaccatatgcgcgtacttatgataaagccaaaaaatcgacagtcagaaaataaaattttatacaatttaaagataaaatataataatattaaaatttacacaaatataaatataaaatatccaatcaatgctttttaagttttttatcttttatgttattttaaaattatatatccaatttgtgatcatgttgtattactttaaataaaaaacaattaatgtctataaccctaaatacatcacaacatatggagccgatatgcaataattattgttatgataataatttcacattatattttaggtgtaaaaaacactttttgaatatgcaacactaggtgttgaaaacagatactgaactaacatgcacttcactatagatatttatcaaaatatagtatggtactttggagattatcgtggtagtatttaaaaaaatcactttgtcccggttacatgtaaattcttctattgttttgggataaaatttaattccttctatttatgtgatggagggagtataagtaatataagtttatctttgattagatgaaggagtaccattagctatatttttaatagaaaatatctttcattaatatataataaaaactaaaatgttacttaaagtcatctatagcttacaaaatagaaaatattatatacataatacaaatagatatgaaccaactccattattatgacagactttttgtttgaagtaaatatgcccaaaccagttattaacgaacacatatttaaaatagtgtaagaaatattttaaaaaatatcatccatatttattcgtaacaaaaattcaaacaacattaaacaacatgcccgcgcatacgcgcgggctatctttctagttcttctttaatatttaaaagtagtcagttttgaacaaaagttgatttcacactggtagagaaaccatctttggtcggtcgactcaaatccacaatagtcccggttccattaaaaaccgggatttttagtcccggtttataagagaaagatctttagtaccggttgttgttaccaaccgggactaaaaatcatctttagtcccggttggtaactccaaccgggactaaagttcatctttagtcccggttgattccatgtcagaccgtatcagggtactaagatctttagtcccggtttgtaacaccaaccgggactaaaaacctatttttagttccggttgatgttactaaccgggaataaaaataaaaaacacactatataatccctattaccgatcctcttttcccatccacacaacaaactcctccctctctctttctccctctccaacttctttatctcttccttatctctaactcctaccttctctttcttttttttccttccattagtcacagcaaagcagacggcggccggcgagggggcgcggggggccggtgcggcggcggccggcgcggaggcgcggggagcctcgcggcagcggcggcacggggggccgcgcggaggcggcctgcgcggcggcacgggggaccgcgcggcggcgggcgaggggccgctcggcggcggcgcgggggaccgcgcggcggcgggcgaggggccgctcggcggcggctggggcggcggcgcgtggggccgctcggcggcggccgtcgcggaggggaggaggggaggcggcagtggccggccggccggcttttcttttttttctttttttcttttttacgatttatcctgtgatgtatttgatttgtgtgtgatgcggatctgtgatgtattttttagaacttgtgatgtaattttttaaaagtttgtgatgtatttggagatgatctatttgagaatttagagatgttctgtgatatgtgagaatttggatttgggatttcttggcatgattaggggatggtgtgaaatcagtattcaatactaaaacaatgaaaaagagaaaaaaaaagaaaaaatatctttagtcccggttgttgttactaaccggaactaaaaatcgatttttagtcccagcgggactaaagatagcgatctttagtcccggattcgtagtcccggttggaaaaccgagactacagggaggttacgaaccgggactaaaaagcatttctccaccagtgtcactctatctcagagatggctctttcgccctttaaagttgttcctagctgcaaaggatatggtaataaatatttttccaacaaaagttcaaaaaagtgaggaaccatctcatattctacccatgaaaaaataagcaaatactgagccttacaaacaaccagggaccattgtcacacaaaactactgaatttcatggaaaaatcactagttaaattttgaagatgtcacatgatgccaaattttaatatttcttaccttttgtgttacaaactcaaattttttaaaacttttcattggaagcaaactccaagtccctaacggttgatggtcttttccaggtgaatatgaatgttgaccagacatcagtagtagagagagagaaatgtgactaagggatagtgagaaaagatctaagaaatccacgtttttagacaagaagaagaaatatcagaatttcaatgtctgctggaaaaagaaatttaattatttgccttttcattattccagggttatatgcatattgttttcctttttccgcaccaacggacctgcatcgcgaataaatagctcacgtatgcagccaatattaagattaattttttatattatatgaaaggtgtacacacgcacataccactatgcatgcacacccccacacacaccctcacgggagacgcacaccacgtcaccacccattggtgaatgcatcccctaacactctcaaagagacggagattaacaacaaatctctagcctcattaaattcctatcgaaaacgcatcattgtgtgtataatattttggtaataagatttacctaataagtagagtcatgcatcaatgactccatcataaactactggtgtttccctaatatcaagagtttttggttaattgatccccaaagagtgaaaataaataagttttcttcaagtattttgctgcagcctaccatcgagatttttctttgttggcacaacattggctgtctggtctagggattacttaagcatacacccttcaagataactagcaccatgtcaactacagaaaagtcaatgtttttaaacaaaatggcaagcagaaatgtcagcgattataaactattgctgataacattgttaagcattgtcaacacgatggtttaaccaatagttccaaagtattaggtttgaccatgcacacatacacaaattcttcgatgatctaagaaaagaaaagataagagattttttttttcattatctctacgctggcagatgctatcctgagtttgcctccattcatgatgctcacatggcaagacctttagagaaggatacttcgctacgataaaacaataataggatcatatcgtggagttactgccctaataggatggtaaaattttgttttataaaatttgttcataattttctgccatcccatacatttgttcactacccaaaagtatactttttctcaaaggaagaggcagactgaccaatcttttctcagactatttgggtatcactttaacttccaaagtcaatgcttcaggataaagatatatatcatgtcaacatggaggtaagaagtgaaactgaagtgttccacattcaactaactgtgcaaataaattgtcagctatctattcctggtgcatgatgccaactaaaaccttgccccaaaaggctggctcagcagacaaacagaggtaagaaagcactaaacaaggcattgggaaataagctaattaacctcagccaatcagcttatgtacaatgtacctgccagtcagacctattttcctttttcatgattggatggttgtttctatgttaattaccattatagttttttttatcaagcaatcttaatcaaacacaatctaggagccacaaagcatcgcagaataacatgtggtgcacgaaattcagtgcatacataggaaatcataatgcttagcctcttgagtatacttgtcatatttgaccactttatttgttcaaatattttgacagaagtggaaagtccaccattataaatccctactgaaaagtccggcattatatcattactgccgctagagtcccttatgatttttttgtaacagaaaggaacataactattttatgttaaattattttttttcagctcttgcagttaacagacaaaacatgatgtgtgccttctgttactgccctacatagggcctgataatatataggctggtaaacttttggtttctaaaatttgttcatatttttttctctttgccattccacacattctgtcactaccaaaggaagaggcagagtgaccaaatttttggtttattaatttacaagaacacctgagttttggtcagactattggatacacttaacttctcccaaaatcaatacttcaggataaaaatatatcatgtcaacgaggaggtaagatgtgaaactaaagtgttctatattcaattagttttgcaaagtaaacacaatttatcagttattcctggcgcatcatgcaaactaaaactctgctcccaaaaggcaggctcagcagacaaacggagacaagaaggcactaaattaacaaagcatttaacaatgggctaaacctcaggttatgtacaatgtacctgccagtcagagctcattttaccttaataatttttggatcaagcaatcttaaacacaatctaggagagcattgcttcgcagaataacatgcagtgcacgaaattagatggcgcaagacacagacgtacagagggtatcataattcttaacttcatgagtatacttttcataatttgaccactttatttgctcataaattttgagaggagtagagaagtccaccattataaatcactacggaaaagtccaccattataaataattactgataaatgccagcattgtcaactaaatgatttagtttggagttccaaattaacatctggtaggcgcagcacatgtacatacaaagattgatctattccctcttgcataaatatataatgttgcagccacaattaacaatactctatttgcttttctcaaaaaaaaaacaatactgcttcatgactatagtactccgaatctctgtcacttctggtagcctgagagtaggatagtaattttttttatggatcaaaactttgatcaccatatttgccaatccataacacatcttgttactttcatgggtaccattatattcttcctaaaggaagagacagagcaaccaagcttctgctttgcttcacagagagagaactgaattttggtagtactattggtgtacggcaatagcatccaaagttttttttaatgaaattagcatgaaaagtcaatcccttcaggagaaaacaaaataatatgtcaacaaggagggtatgtatgaagtgaagctaagttgtcccattgtcaactacttgtgcaaagtcagaacaatatgttaacatttcaagttgatgtcaactgaacttttgctcccaaaagggaggctggcagacaaacaaagacaagaaagcactaaacatagcatttgacctcatgatctaattaatgttcagctatgtacaatgtatatatcagtcagtgttcagtgtttcaagttgaaaggaacagcgttttggatggttgctgctaagtaaccgtcctagttttggatcaagaagaatctaaaacgaaatccaggacgagaacaatggcgacgtgttgctttgcacaaacacatgggttgtacaaattttgagtagaaagtcaaatagtataacacagaaacttccttttcatgaaaaagtactcaacgtgtgacaatgtgagctcatagagctcattttttcacaaatacaagtcaggtttggcaactttatttattcaaaaaggatttatcactgtaatagattggtccattatttcggtggcagagcggaaaattttagtaagatagggagttaaaataggttatagccaacatataattaacatgaccatttcaaaaataagtcatctcttgtttaatcctttcgcaaagcaaggataaaagcacgggtgcgatgttgggcccccctcgtatagaggtgggcttggtccacaacaaatttaagaagcttgtcaaaaccagcattccacaatacatgagttccttttttaccttctttttatttgctctctaattctttgattccatcaaattcattggtgatagctaaaccggaaaggttattaaagcttttagcccacattagataaaatatggtttctatcttttttctaactttgccttagttagaagtgacaagtgttcacaaacaaaatgattaataagttaaacaagtatggatggattcacccaaaagaaaatgatccttgcattaggtggaatccaagattgcgtggagacgtggtaaacttatcctttgctaatcttcctaaaagaatcctcttccggtcgtcacctttcactagaaatcaaagaagaaagaacagtacacaaaagaaaaacgctcaagcaacagtgcgatttccggtcaccggtatatgaccaatgacatgcagtaaaagtgcatgatgaatgcacttctttattagtcaatcaccacaaatgacactgtcctttaaatattattaattgtttctacaattactatctacatatttaaatatatggcatcgttgactttggtcaatctatgccagtttaacaaccatttttctattagaatataatgataatattttcttaaaaagtgtaatattataaaataaagaaaaacatataagcatgatttttatgtttccaaaccaaatatatggagagctattgatgatcaaagctttgaaagttttgaccgaataaagtcaacagtgatatatatttaaatactaagggagagtgttcttatgaaatgacaatcccctagtggagtatgagcaaaaggacacaacatcataagttcataactatccaatggattatgagctaatcccatcaacacccaaaaacatttaatcgaaacaaaacaaaaaagattaagtgaagcaattgggaattgcatcactatccacttgcaaaatggtcaaacatttggcacccaacaagggaatagaatcacacaacactaatctgctgttgtgccaaaacagtaagcatagtgggcttcatactttagagagcccacttgcatttctctgtgcattaggttctttgatgaacctaaccatgttctgcagagatgctcaacttttcagtcctggttttagccatccaataaagcatgtttaccgttccctaaaccgtttgctt

SEQ ID NO: 3529 - DNA, 26668 bp, Oryza sativa
  unsure (1)..(26668): unsure at all n locations
atctaaaagaagtcattagatgcaggtctaattcggcaacataaggattttcagactaaacatgaaaaggtttatatataaatagttgagtccgtttatacaacatagggttcaaaaaggtattcgaacattcaaaataggcaacgaatttaacttgggccgaatttaggcctccttcagtcctttggagtggatgaaattataggaaattactccctccgtctctaaatatttgacatcgttgattttttagcacatgtttgaccgttcgtcttattcaaaaacttttgtgaaatatataaaactatatgtatacatataagtacatttaacaatggatcaagtgatagaaaaaaattaataattacttaaatttttttaataacacgaacagtcaaacatatttttaaaaattcaacggcgtcaaatattagaaacggtgggagtaattaataattctaatttatgtgcaaatcctcgactcagtttaattactgattattgtgtgcctaaattattggcatatcaaccacgatcaaactttacattttaaacttaattttcatagttgattttagggatttttttcccattatactgtattttgaaacttaattattattttttagaaaaggctatatgtactaactttttcttactaaattcttactaacactgatgtgtcatgctatgagtgcatctagattttttgtaacttccatctacttaaattaaacggttgagatgattgttagtaaaagtttagtaagaaaaatttagtacatgtagcattgctcttatttttttgctttatttttagatcaaccgaccggccgtacttttcatgattgatcctatttattttttggtttttatctgtgttaaccgttactagcccaccgacaaagtgcacaaatacagttgtagtggtttagtccagttaatcttgcagtcaataatttaatcaagcagccttacatgtctgcccatcttgcagccttccacatgtacttacttcctatagaggttattttcttctttacagaaaccaaggcagattaccacgcaggtcatgcttgcttactgcatgaaaaaatagcatgaagacgactcgaatatattatttccaagtggagaaagaattctgcagaatccttcttgtgaactcaaggttgtttgaaatttcaagtagatggacacacatcaaaataatgataggaaaacagtatactgttagtatgtatttacactctcctagctttacaagagtagtggttacccttgccttccaaagaggcaagaaaacaaagggaaaatccataggaaaatgatcaaatgctgttacatgtcaagcttgattctcacccaccagaatggcagggtgaaaaaagatgaaaaatttgcaaacagaagagaaatgagccccctgatctgatcaaatgatcagtcactccagcagagaagcatgacgacgcagcgtcggatgatgtagagcctggccttctgctccctcaggacattctgcagcttccccctcttcttcttcaccttctccatggctgccaatgcagtggaacactgaaaaatgcaatgcgaatcaaggttcagagcgctctctctctctctctctctctctctctctctctctctctcgcttgccttcaggcgaatgccgatatgcgggtagagaatgagactgcagtgatgcaatctttgcttatatagaggagccaaaggatatctctagagcttgcaccataaccacccaccacctcacatgcaatttcagtacttattttctttttttgccttggaggagacacttccaagtctaaatgcatgcccctgatattctattgcttatgataatggttaaggagggtgagcacttacttaacaatgtgatcatagatggacccttgatgggtgctgaggcacagtacccaggggctgctccatgattgaggaccatgcgccgcgccgcggacaggatcaagtggccatacatgcctgcaagcaagaaaggcaaccatggttccattgtttagtgcccccaagggaggctgttcatggtcctcaaacagtcaagcctaccataatctctgcaattttggtatctcaatgcagaagcttagcccttaaaactactaaaagggcactggagacactgtagcaagtctgaaaatatgaaaaaaacccagtgaagggactggataagagatttcttttctccttacctgcagattgctcatgtgcattgctcatactgactacaacaactctaatcagatccatgcttgcaagttctttcagaatatactagagttttcctcgcactagaaagggacacagcacagcacagacatacctgggttggaaagaaatgagaggttgtcaagcaaaatcaattcagagattcatcagtcaacatttacaagaagagaaattcttgttgatagacctatcaatctagtaccagcaaaaggtaaataatacttattcatggatatgaaagatcctaatgtgttcattttttctttttgcaaggataaatactactgttagtgtccgtgctcgccatcggtatggtctattcttgacttaagtatacttccaagattcattccatgaaaaacaaaccaggttctttccatgacaaacaaacaatgtttggattgacattagctggcactgatgaacagatcaaggtggggggctaaactccaatcatgagataattccaaatggacaacccttgaactgactgaagtgacacaacccaggcccctacactagccctgcaactacttggataggcaatcacaaaagacagcaaactaacaacttgaacagtcaattaactacaagccagggcactaggcaacgaatcaaagcactaaactaccagatgaccaatggtaatcgtgatccagaacacaatttgtagatctttaacattcagatgccatgcttcatttcaaaccatccttataggtcataaccagggttcaactatcagaggtggtataaaatttcaggggtcactgaaattccaggggcccaaaataccttaagtctttgttgtcagtatacatgtaaacgaaacaaacatctcagagaataaattttgataattttcaagcagaagttggaaaatttgaatgcctaaaactttttgacctttatgaagttctatacggagggactgaaaagtcaaagtcataggaatttttcaaattccattctgaaatttcaaaccttggtccgaactgctacaggtaaataatgtaaattacatttttgtacacggcacacctataaggtagctagtgtgctccttttcctcagacaacatgggtactctgcatgtgctcaataactcttaactatttgtgttaaatttctacctagtaatgaggaagcagttaacagaggcaactaaaaatgatagtgaggttatgatcaactcattggtcgagaccaaaatgttggttaacatgagacagcgcctgtgtgctacacgaccagcattgagacatctaatgtcacatgcttgactagcattcatacagaagattcaatgcttggtcagacaatgttgcatgtgctaattattatcaatcatatatattcataacacattaaatcaaggtcaaaactaaaatccagcagccttaatccaacttggcctcaaaaaagaaaaacgccaacttaatccaactatatgaaagatacttcagaaagtttaaacttagcaacagaaaggtaattactaatcaactcatgatagaaaataacaaagagacacacaaatgaaaacatgggagctctctacaagtacaagtggcaagcagcagacaggccctatataacaaagtgcccagtgttttgactgggaattagggagacatggaaattcagtaaagaacagagcatcaaacggctacattgtccacaagacaagaacactccaaccaaagcgtgcgcgcacacacaaaagctatttcctggtcatctagaataagtacactacaaagtacttttcagtcaaaaaagatatgctgattgcacggatgatcagtgcactcgtcccatctttcctagcagcttccgaacgtatcaagaggacatgaggagatctctaagatgcttgaacactggtttttaagaacttttgcaactctttaaccacacaatctaccgacaagaggatatactacagtactaaaacacattgttaattctgacaagtccaagaagatctgggggatgcaacaaaaccataattaattcctccaacgaaatcagatgggcaaattacagtgcagtgagatataccaagtatctccatggagaagaaaagcaagataagggaatagtttacgataccagcggcgcatgagcagcactgccagtgccagataccaagaaccttcatcggagccatgctgaaccactgaatctgcagatttctacacgtatgcaggtggcagcaggatgagctgtccgttatctgaaatgatcatatccatcaataaaatcaagctttttgtcggcgacaagaacaataagctacattcaggttcagagatttgtctccctagattaaagaaagcaaaggaaaactaaagtattagcacgattgcatgggagcagaggtgcgacatgctttgcctcctctctataaatcattagcctccttccaagttctgtaccacagcagcaagctccaaacgtaatcatcagagagcagagacacctacattcatcaccattgtagcttctgtttcatcaagcaaaactgaagccatgaagactgtgaaccaaggcaagcagagaggaaggatgaccagagctctgaaagagcatagagccaggctctacatcatccgccggtgcatcgtcatgctcctttgctggcatgaatgaactccagtactgcatgttcttccattggatcccatcaaggatccatggagagtctacacacatagctagggaactatatcagttagaagtagaaaccaggaaggaactccatgtgctcatgctaggttgaggttgcattgaagcaagcttggcaagtctagagttcctatcatttgtttcttgagtttttttttcttcttttttttcccttttatccagttcttttgtcctgctgctatccctttggcagtgggatatggtaggtctagctttttgtacatgctatgtattgtagcaagcagtctacctaggaatgattcagcagaagaacagcaaagttgatcgaattctatcgagtgaaactgaacttttttttacatttctacatcaagtgagtctatatctgtcttttcttgacatgatgactaagcaaataacttgattaatggaatctttactgactataatgtcttaagcagaaagaatgaagcctactgaagcctatcatctgttcttaattacccacatgcaacactgcatccaggcagcagggctctagcctctagctaagacctaagttagccaccagatcatatgatattatcacccacagataggacaaaatcactaaataaccagctgcagtgcagtcacagatacagagagaaacagtgctcaccaggaatgcaggggccttgtcttctgggaagatctgagctcctcctgcatttcttaagttatcagaacaaaagaaaacaaacacaggatgcagaaccacagcaaatgcagatgtgaccaaacaaatgcagacaaaagtggagcaagctgacaaacgcacgaacacacgcacgcacgcgcgcacgcactgaggcacgtgcaggacatcttctgagcaatggccaggagggagtccatttagtctgcttttgcacccaggtcaaaagtgaattctggctactaggaatgagagcaccggtgcccacaatcctttgatggactgagaaaaagcattgctgatagtagcaaagatattccagtggcattgttcagtcaagattcagaaattcatattaactctgagtaaacttccactcagaaaaaaaaaactcgaatacacaggaggactgcgtaccattgcattaagaaggagcttccactcagcacaaagtaatagtgttctctttgtagattgctggattccatacctctgctacattggtcacacaaaacaaattgactgtatttctctaagacaagagaatcaggtgcctgagactaacatatgaagcaaagaattaggtaagagctttgtgcctccttactgtatgcacaatatattactttctcttgtgtatggtatacagatatttgtaatatgcatcaagttcaatggtgcataagacttcacacatatagatagagcattaatagtatgacaaaaagaaaaaactaattccatttttttccatcgaaggtgcaaagtacaaagcatctgatacaaatcactgcaaacatttaaaaagtgcagtttcgaaaaaagaagtaaagtgccatcactcaatttcaagtcttgcaacttgcaagtttccacagtggcgatcatcatcaacagcaaacggaaccatcaagttgtagggcaattaagaagtgattttccatatcaatttttctcaagttgtacaagagggggggacatctcaagactgtagagttggatctctcacaagctagagaaaaaggacatctcccaaaatgaaaccttcagactacagagcggtacattgccaaactatacagagcaactacacctcagttctagctaaatcctaccaaaatggcagagccaaaaaaaattccatccagaatggaatggaaaacaaggtccgcaatggacatcgatcaatcgctccagcggagcaacatgatgacgcagcggcggaagatgtagaacctagctctcttctccctgaaagctctgttgagcctccccatctgcccccttcggccttcaatcttcatagtctgatgagaatgctgggtgcagggcaaaggatggaagagatggagatagacaagttgtagaatgtaatggctagtgtgtggtatgagagggaagctggagtgaggggcctttatatagtggcacaggaggggatatgccatatcaaaagaacatcatacccccacatgcaggcagtttgtttatgcactaggaggcacacttctgaccctaaacttatcataatcactattctatatttctatctgtatagagcttaggagctagcaaaaacttaaaatatgcatggccactaacaagagaattactgtggtaaaaccagacaagataaagtggtcaggcaggtgcagattgtttactaaccccaagaatgggactccaaaatgtcctagctccttagcaggaagcttccaggaaggtcaccttgatgcatagaataaaactgatataagtgtatcaccaacagatgttaagacctggttaactctcattgcaaaatgttgcaccatcagccaagctggggtgaaaacttcagatttctatgagacttgtctgatttcactttccatgaactggcatggggctataagtaattaagattatccctgacaaacactaagaacgaagtattgcagctatgacttagaaattattatctacaagatcataaaaataaatcttggacttctaggagacctgtatgctaaaattcccaactccttttacattccatgcactgagatggaggtaactccaacgttatactttcatcagtaatgaatctcaggtaatggtgattcagtcggcaacttaggaacagaatagtgctataacctataaggaacttttgatggcagattgaacatatataccctggaatctggataatttttcagtaggagagcccttgaaaggtgttctctatctactcaggacaatatccttaaaaacaggccgttcagttgcatgcaacttaacaactgcataaatttgaaaagagcatataacttgatagcttctgtcttttgttcttactatgtaaatttttttcccatggaagcattagaatacagatttgaactatcaatgtccccagactctcagactgttctttgcagtacaaaacttgccttctggtaaggtgacaagttcccaaatgttaatatcactaattgcctttatttcttcttttcctgacagaatgttttaacctatgtgtttcataaattccagtgcctaaaatgtatttgcttagattttcataaacttggagtatatagtgattccagctgaaaatggcttgccttagctcatttaccatcggaaatatcttgtatagctcgtgtggttacacaagcatcatcagtgaagtcactacaagacattgttaagtccaaaagagtgcaagaggaaaccataaaaatttcaggattgaacaataatcatgcactggggaatcaaatcagaagaaaatctccatatgcactgaatctgtctctactactgaagtcatacgctaggaaaaaatgctgaggatgacaaggtagattgaacgggcaccagaaagaaacttcctattttgaagggtaatgcagcatgatctcagtctttagtttcaatcagtgaaagggagtggaaccttttgttatcagcaaaattaattcaagtctttgatgttcttttctcttttattgcggagattttttgcatactaatttattaagtttgaatccatgtttctagctgaagtaacataggcccccatgctcgttttctactagaagctaaaaggtgtgccttctactggacaataatgtgatcgagccttcttttagcaaacataacaaagaaagataaagtcctgacattattcaccaccttctagatattcaatattttcaggtatagctatatttggaagtacaccttagttcagaaaattgtaacctttcttaagggaaaaattaaagtcatgcatagactagaaaacgattagcacaagatgcatcattcataaactcaacagaataaaatctattctggactacagtccgaacatatcaagtcctatcaatcggagcaatgcacaaatatagtgaaactttctaatgcaaacatacagcatcttaggggaaaatcttatagctaatgaaagttttagccgtccatataataatgcagtaaatgtttttttcggacaatccacaccagacagcgcgaagattcattgaatagagcaggaaaaaaattacaaggctagaaccctgggaggccatagccaggaaagaagaaaaatatccaccagcgacgcaccgacagcacctacacacaggccaggagaaggcgcacctgaccggctgccgctaggccaacaaaggaactacaaccaagatcgcccaaaacccaaccctaacatccgaacaccgaacaccactctagccacctctttgggattgaggagagagggtgagaaagatggaaccactctcccctctaggccctccaacgtggccagcttgtgtaagctaggacgccaacacaagaggacatgacatctagagtaactgaattagtgattattttggggttgttcagattgatgccatttcaaaccataccattttttgataaagttgccaaatatgtgcatccatttagttttttaccaaactctagtaaatacataagaaatgctgccaaaacttgccaatgttgccaaaatttggtaaggtttattttggctataatctaacaagccctttgtaagttgttgctgtacggatggtgaacgacaaacaatattatttagagataattccttccagtaagaaaaataaataggaaaaatagacgagacaataatttgcacaaatcaagaacataacacacactgttccctgatactattccttaagaatatagtgcccttgttattagtaggaagcccgacaaaatgttaagtggaggtttcaaatgattccctctcaaaatgataattgtacgtttgtagagcacatacctgccattggagctagaggaacagcccatcgacaaaagcaggcaagttgcattactatcaccttagaaagaccattgagtccattcaatcctagttgtgtataatatccctgtactcttgactagcagtactgtcttggtaaaaccaacttttcaatatcttcaatgctacaacagaacatcattgccaggatgcatgcatgagaatcagaaatgagtgagaaccaagacagtccatgtttactatgaaaaagttccgagtatcaatactcaacatccaaagttgttctgaatatgatacattaatcggagaacgatgagacaaagatggtaacttgtgtatcttggagaacctctaaaagagctacagcatggaccatgctacatacaatttgcatagcaaaaacatgttatgttataacatcagatccatttggcaatagaaaatgtggaagcctagatgcaccgagataatttgaaagttgtacctttagaactaagaataatactcgaagggatcagtacatttttaagacaggagaccatatccttcagttttcgaggagttaaattaccgtaaactcacttacatagccttcatgtgaagtacttgcaagctgcactactccaaggataaaagaaaaaaaattaagcgaaacaataaagtcctcttattcctacacagtacacaagaagaagcaccaaatccttaaagctgctcaaaactgtcgaaatatgcataagatcctaccaacccttcatacagattgtaaaggtgagtaaacctccccagagagatctcaaaagtagctcagagaggaaaataaagcagaacaaacatataatttagctatccaagaacagccttgtctggtataaatgaactcttgtggagcaactctgtaggaatcatcaaacaattctgcacactgcaacttgcatgttattataaggcttttttttatggcaggaaagggtttaaacaagtccacctataatccaatccaaattgcctgaactaaaagcagcttttttgtgatatcatgaatgctcacatggtctgatgcacggtatatgcttatggttaacttcagcgaagtataagtttcagagtccatggcaaattctcaactctcagcatgagagagaataagacatataaagaatgtgagctttgtctcctaagttgcattcaacttattcaacttggttataatgcatatctgcatgtgaatgagttcacggagtgtcctataaaaggctcctacctcttcacatgataaccagatctacataaactcaagcagcaaactcttacattgcttcgccttctacttctccaatcaaaataagtcagtaagtcactatcagccttgtgcacatgaaagcagagaggaagaacataagaagtggaagattcattagaactcggaaagagtgtcaaactcggctgtacatcatccgatggtgtctggtcaggctcctctgttggcatgattgacttcaaatcttcaacgcatttgtcatcaacatttcttcaacccacggtctttttccttagcctatataaaatatttcagggaagtcattatgtcaaggagtcaatcgaggtgttacaacttattgaagcaagagctgattgagagatctagctgcaattacataactgggatttttgttggaattatgaaagcaacttcttctccagtttgttagttgagaaaattttgtaattcttatccttttcttgcctggttaacatgacattttgcttttgtattagatcacattggatgtacattctttctgctaattaaaacttagtttcttattaaatcacatcagttgtaaattgtttacaagggaataatgtttcttgtagcaaataatgaaaaggcgggctaaaggttctgaattatccggctgttgtatataattaaagcaattgctttccacttgatcagttaatgaggaaacatcaaacctgcttcagaatgcgtattataagaactattattcactttcatctcctttcatcatcatgcatcagctccacagatcaatgagaatatcagaaagtgacaataacagatcttctattgccattttcagagaaatgctattgtaactgaaatttttttaaaaaatcacttttactaacctttgtttacacaaacatacaacaacagtaacacataataacttctgcagtataagctacatgaagtatatcatataaggtaagcaagtgtgcatattatattacctgacataatgaagccttcaatatcttcatagatggacagggttatgcaacataaaagcataaagcaacaagtttcttatggcacctctagccttgtccaattaagagagagttgctacctatccatcaaggaattcagcatcataacagatctcaaataaacattataatctaaaaggactcatacatgcccataacgggaagaaaatcttttactgaaacagagctttaatagaatccaccttctattgttaaggaactgaaccggtttcattttacttgtactcagatatagattcatgttttcaaatatatgtcaaattactaaattgacattcaccagatgtgttgacttttgcaccctctgtaccgaacagagcttgcataacagaatgcacattctatttaagaatcgaactgcttgcattttacttatactcagatatacatattacttctattcaaatatatgccaaactactatattggcatgaaacagtaatacttaatgaatagacttgtgcactgcttttaccaaacagagcttgaataacagaatgcaccttctattaaggaactgaactacttgcattttacttatactcagatatagatcttgtttgtattcaaatacatgtaaattacttcattggcatggaatagtaatatttaatgaattgacttttgcactgttttgccagacagtcagaatgcaccttctattgttgaggaactgaaccacttgcattttacttctaatcagacatagatcttacttgtagtcacatatatgtaaaattaattcattgacatgaaacgctaatatttaattaattgacttttccattcaacaattggcccttttgacttcatgttctttgcagaccagtgcttcattttacttatacttaagtatacatattacttctattcaaatatatgccaaactactatattggcatgaaacagtaatacttaatgagtagacttgtgcactgcttttaccaaacagagcttgaataacggaatgcaccttctattaaggaactgaactacttgcattttacttatacttagatatagatcttgtttgtattcaaatacatgtcaattacttcattggcatgaaacagtaatatttaatgaattgacttttgcaccgttttgccagacagagtcagaatgcaccttctatcattgaggaactaaaccacttgcattttacttctactcagacatagatcttacttgtattcacatatatgtaaaattacttcattgacatgaaacgctaacgtttaattgattgacttttccattcaacaattggcccttttgacttcatgttctttgcagaccagtgcttctttatgataagatctaaggaccaccaacaaagagtcaaacattacaatttacttgaatgctgcagtcaaggagacaaagggtgtaacaaaccaggtattttggctttgcttagtggttaggtagcaatctattgagcatccaatgatgcctgatattcactttaaaaaatgtctcatctaggaacatgcagtcaacaattacttcaaaagtcaaacttgagaactgttttctggtatgaatgaaactgctgaagaatactgagtgtagcttgaaagataacaccgagtaccataggacctgcaagactgcaacactctcctaaaataagttctttttttttgctggggatcctcaaaaattgtttgacatcagcgctctccacaaatactgaagaactgatatgttaaaactaggacagaagaaacattatgtatatcatatcaagagccaacaaccacatttgattccactgaacaaacaaaaaaatacgatgattaattgcaaatcacggcatgcgcttgtcagatctttcaaggtgtataacatctagtgatttgcagtcttcatcataatccataagctatgcaatttaaaatgtgtaactcacaaaatataggagacattcctaattgagtcctagggagaaggaatttggtaggatgagatcaaacagaggggaggaagaaccagtataacgagatgaagaggaatttggtgctgaaatgtgttttctcattgaacaaatgaagccttatacttccaacagttagccagtcctacatattacagaactcaatactactcacactttgttaggaaccttgtagtcctctagtgtattacaatatggtcccaaaaaaaagtgaaatgatgtatattggccaggaaatcaacaatgtgctatatgtaccatgtaagtaaaggcacaaagaagggacagaaatttgccttattataaatctaatccttataattacacttaacaaatagagaaggaacagacaatgtcagattattctattaggttacttcaagtacggaaccaaatatgttgcaatcattttatcattggtcaatgcagcatctacccaagttaggtttattacaagatatgagtccttgaagagaaagtgactgttcattgaaccatggctgatgtattgaaaaaaattgtatgtggataagaaggataaaatagcacaagatatatggcaataataagctgatttagagtctttttggttcattttggtagggaaccaaacattcttcatctccaatttaccaaactttggtaatgccaaaacctgcccatgttttggcattacaaaatgtagaataagtagaatagatgcctctcacaaagtgtggaggtgaaatctcatatatatatagctgagttacagttagtgctacaaaagaccaagagttacacttaatgctagtgctgagtttacactaaattctataagttacataagcccaaaagtctagaagagaaacagtctaaggattaataaataatcctaatacaaaattatggtaaggtagaaaatcaaaccagcctttaagtacataagatctaacaaggtcagactatattagatggataagtatctatatttcattatgcttatcacatactccctccatcccaaaataagtgtagttttgcactgttcatgtccaacgtttgaccgtttgtcttatttgaaaaatttttatgactaatacttttgattgttattagatgataaaacatgaatagcactttatgcttgactacttttttaaatttttttcataaatttttcaaataaaacaacggtcaaacgttggacacggatacccacggctgcacttattttgggacggaggtagtacatcacaccaccaattaaaatcactgtgactaatatcccatcatataatgcacttatccacatgttattccgcaagcaagtgaagaacagcaattgtcacatgttattccgcaagcaagtgaagaacagcaattgtacaacttgatcataacttacaacagcaatgacctcaatggtccatatcatatctactgctatttctttcaagtgtccacagcttgtataatcatgaaaagaataatagaacaaactaacgccttacattaggagattatccagaccaggaatatcaaatggtagctttataatgccgagggcaatagacaggaggagcagccacagaggaaagatcttcatgcacagcagcaacagggacttttgtgctgaaaagaatagcattaagaaaaaattcagcctactttttgtacaatgactaaaaatggtgtaaaacaaagaacatcacttataagctgtaaacaaatctcatcgaaacgtatttcgtattttatttgtcagtagcacacaagaaattgtgcttcctagttgtatatgatggcctgtattgaagtggctagtatcatgcagacagtacagcagttagatagtaaaagttccactaataactgatacgcaaatagcaacgtagagtcttaatcaaaatggcaacacttacagccagcacatcttttataaggaaaaaaaaaagcgattacaccttccacataccatcgaatggtcacaatgtattgtctagtgactagtgaatagtgataattattgtacccaggcactcagaatatgtaacatcagattaatccaagttacagattaacataaacagtgcagcatattaggccctgtttgattcagcttaggattattataatctggattattaggagtaagctgaaacaaacaagtagattattatgctagattattataatctataagccagattactataatccaataatctcctctagaggagctttttccagattattgagtggctaaagacccactaccctcagatgcctctaataatccagagaaacaaataactcgtagattattttatgtcagcttattataatccagcttagagtaatctgatttaataatctagattacaacaatcttaagctgaaacaaacagggccttaattgtcaagtattgagtagattacccagcttcttttcacagattaagccttttgggtagaattgtttggcacgtatatgttaacaaataaataattcttgcaagctctactaccttggcaggcgcggtcctcggtggtgtcgacgacccactcggcggcctcccggaggcggcgctcggcgtggccctccggctgcccgatcggtgtggacgcgatgagctccatgaacgcggactgcctctccccgcggcgggaggacgccgaagggtcgtcatcgccgaggccgatggcgcgccgcacctccgcgacggacggctgggtgggtggggccgacttgaggggctgggtcggctgcgggccaggcgcgcgacggcggatgcggcggacgggctcccccgcggcggcaccggaggcggaggaggccaagacgacggcggcggcggcggcgaggcgcggggcgcggggcgcggcgacggcgaggtggcggcggcagcagcaggaggcggcggtggccatggcggacttcggggagtgtgtgtgtggagtggaaagtgtgtaaatggataaagtttagagaaagatctttcattttcttcttttttccctactgcgacacctgtcactatcacgtaatatctctccaccccacttcacaaatctcaaagcacatttgacacgtttggttcagtccgactaaagccattcacagtgcaagcagccaagcacccactgtgagttaccacgagatgacagctagaataaagaccctctcttcacagtgcaagcactgcgtgtgggactcagaaatatctgctagtgggacccacaaactcccaagtcccaactcctcaccggctcctcctccctcgtcatgcaatccccaaatccactcatccccgccggctctccccttctccctccgccggcgccggctcccctcctccctccgccggtgtcggcgccggctctcctctcctccggggggggggttccctcctccctccgccggcgccggctcttctctactccgggcgtcgccctcgaagaagcggcagcgttgtccttggggccgagctgcggcggcgccctcgaagacggcagtggcggcgtggatctagagcgcggaggacggtggaggcgcgggacggcggcggcggcatggatctgggctcttcctctctcggccggcgacgaggagacggagccgctcgtggtcgtcgtcctcctcgctttgtctccactttccgccgccgccgatgaggagaggaggacggcggcggcggcgcggatctggagcgtcctcgccgtcctcctcaccgacggcggcggcggcgccctcggcgacggtccttggcgacgtcgcatctcctcgccgtgtggggcccacgcccgactttttgagcgaggttgctcattcctctcctgggatgagaagaacccagtgtagctatgggccctaccaaacttttttcgccacatagactaggtaacgcgccatgtaggactagataacgcccactgtgaccggcctaagagcaggtacaatagcaggcagctataaacatattttaaagagataaaggaagaaagagaagagcagcgggctacagatttatagtcagctgcagtacggactccaagatgtaacatgtgtatgataggtgggaccaggtataatagtatagtaagcaattattgtatgaattggctattatattggctatagatgaattggagctagtagtaggctatactattaaactttctctaagggtgtgtttgcaagagcaagttccgaacactcccctctcgtttttccgctcgcacgctttttaaactgctaaacggtgcgttttttgcaaaaaagtttctatacagaagttgtttaaaaaaatcatattgatccatttttttaaaaaaaattgctaatatttaattaatcacgtactaatgaaccgctccgttttccgtgcatgggagatggtttcccaacacccacctccgaacacaccctctgagcaagtttaatggtatagcccactaatagctctaattcatttatagcctatttaatagccaattcataccatagttgcttactacttcctccgtttcacaatgtaagactttctagtattggctacatttgcctagattcattagcatctatatgaatatgggtagtgctagaaagtcttataatatgaaacggagagagtatactattaatatatggtcccacctgtcatacacacattacgtcttgtagtccatgctgcagctagctacaaatctgtagcccgctgctcttctctctcatcttttatctcactaaaatatatttgcagctggctaatagtctgctattgtacctgctctaagagcaaggttaaggtgttcacaacacgtcggctcagtcatttcccaaggaatgttcaataggaacacgtcatgttaggctcacccacctaaagttctcgctgctaaacttggtcacatgttcctcaatccaacctaggggtagcgccatgcgaaacgaggactgtaggcctgttgtggacgcttgtgacctcaccgtgttgcattatggactatgtatcctctgaaagtcctcggcctacttggcagcctaggcctagcaaatgcttggacacattgctattgcgctagtagcattgctggctgccagcggtagtatacgtctaagtcatgataatatagcagttagattatataacgagttgtggccatagcatatctctatagaagcttaagtgtatttaaatatttgtatggatgcattgatttaatttctttggtcaaatctacgctccatcctttcaaccacctatgttgaagaacaaaatgatgttagtgcacatgggatctaggaggagcgacccaagacccacaagctgcatcaattagtgctaacactggcggcaagacgatgatagtgtcctctttcacatgctactgcctgacgctcctgcaagcgcctcctccactctctctcctcatttctctctcgtccacataagagtacgttgatgtgtatttttaatcgttgttggtatttcttacgattatagataaatccgcaagcgcacggatattgttgtagcatttcactcatgagtattcccaaggatatcgtatttatatttccgcagggaaggcggcggtatgaaaacatacttatgcctccttaatcaatctatagtatcatccactagtaattataattattgtattttaaaacttatgcaagcatgcttcaaaatctatgctaggaagagaatatactatggttacaaagtgctaacttacgacaaaggcaaacttatatactatggttacaaagtgctaacttacgacaaaggcaaacttatctacaaatcatgacaatcagttttgcatgggtgagtatggaaagtatgataaatgtctcctttcgaaaaaaaaaagtatgataatgtcaaacttagcaggtaaaccagacaaattggaattcgcttgtactcatttttaaattggcaaatgggagctatgtggatgttgtctcatcctctatttatcctctattgttgtaacttgtaaacatggagatacaattatatgttcttaagtttgagacttatctgaacctaataaactcatgacttccctgtcatatgaagccttacagtatgaattgtataaaaagaaacccatctttcaaacacttttaaaaaagagagagagaaaatatacatacacaataatggaacatagggaatcaagagaacaagatagacatggattatttatttatttcccacgaatcttatgcacaactccatttgagtcccatcgtttcacctgcaaacaattataagctgcaatgtttattagaaaaaaaatgacggctattttatatatgtgttttagtgacataaaaactaatacttaaaaataaaaaacgatgaaaaaccatcaaaatcaactctaaagttatttttaaaaatttaaatcccggctgcggctgataaggtacactggtgaaagattaaaagaatgctaattttgatagaacatgcatacattaagaatctcgagaatccctccgtctgggcacctggccaaaccaaaataaatcgagcgctctgtgatccaccatgcatgtgcacacctttttctctcgcaagttagagcatgcatataagtactgcatgcaactctcatacccattcttttttcacgaggaatactaaccatttcattatcaaattttaaacattttttaaaccatttatcctatctacgatccatcattatattcgttgtaattaaacctttacaacaagataatacatggaaagattttgatgaaaaaaataaatgttccacatggttttattgaatgtttcttctagtattttatgatgtttcactagttcatttacaaatattgcatatggtattgttagaatgttttggtaagtatttttatgatgtttcagcagtcataacttaatatttcatatatgatattgttgatatttcttaacgacatttactagaaatataatttccagcaatggtgcagaaatacttctggtatattatggttatagtgttcatccgcaagcacatggatataccattgtaacatttcacccgagagtattccaagggtatcatatttgtttaatcccgtgggaagattataatagagagaaccgtactaataatttatatattacttgtaataaccatagtctaagagggattaatataattcatggggtagagtgacactaagcagaagcatttatactcttactcataattatctaagtagaaagaatatagaaagatctattcctatacttctagtatacatattatacatacatcctagttataatattacttagctaataccctctttccgatgctgtaacgccccgattttcgttcgggattaaaataaatcatttaataatgcattctctagaaattaaataaaagttaaaccaatttaatcaagtggaattatggaggaaattaaaatttcctttaaaaatctttggccgggaatattttgcaatattctttgtgccctaaaatactctccggatttttccgcaaattttcggagctcaataaataattttaaagtcacacagatcatttaaccaattaagtaaaaaggaaacaaatttaattctccttccttccccttcctccctttcgggctcggcccaaattcctccccctccttcctctcccgcggcccgcgcgcctcctccctctctcgggccggctcccttcccccttggcccgctcgcaaaagtctgttttgcgtccctccttctctcccttcgccgacaggtgggaccggcggacccacccgtcagctccttctcctacctctcgccggccaaccccaaccgccattgccgtccacgtcgccgcaaaatccggcaccctcccacacccgagctcgcatcccacgacgtgggcacgatccactccacgtcctccaccattttccccgctcgtcccacaaaaaccggcgccggccgagccgccaccaccccacgtcggcgccccacttccccggcggttggccgcccgactccgcctctcccgggctcgatccggccttccctcccctataaaaacattccccgcacctccctctcccttttcccctctctcccgagccctcccgtgcacgaaaaccaccccgccaccgtcgcaccttccgccgccgctcgccaacgaccctccagccggttgccacagccgctcccaccaccgtcgttccgcgcgaccgccaccagcggcttctccgcgtcgtgccgcaccccggcgtccgctccatttcccctccccgcctccgaagcaccgtcaccacgcgcaccaccttctgccaccgccgccgccgactccagccgccgcttggcgccgctcctagccaccccaagtcacgctgtcgccgccgctcgcttcgcagcgccgaggagcacctcggccgccgcttttcacggccgggatcccaccggaacatggttccccttgcgccggtgcgcatncgccggccgttctcacctncgaccagcgattcatgccgctgggagccctctccccctcctaacctctcccccatcctccccaggtccttccggccgccgtccgccggttcccgttcgcggaacgccgccgggccgccgttccgccttcgtcccgaggagcgccgacgccgagctcccccgcctttccccgccccttgtcgccgccctcggtgagcactcctcccctcttccctctttcttcccttggctggccgcctcccgtgcttgcgcgcgccgtgccgccgccgccggtggccgcccagcccgtgtgccgccgtcgctttggtccctgccgccgccgccgccagccttgtgtgcgcgctggccaggccgcgccgctcggccgtccccagtcgtccgatcggccctggccgatctgggccatccacgtggtggacgcgcacccgaggccacgtgtggaccatgtccaccgtgcgccctccccctttgactcgctgacgtgtggggcccacgtgtcggcgccggccgcccctttgctgacgtcagcgaagtccatttcctttgtaaaaataaataataattgcgcaataaatcgagtttaattttagaaattcatttaaatggctcaaaacttctaaaattcatatctaattcattcgaactccgaattgagccattcaacttgcaaaattcatctaaaattgagctctacatgtttgtttactttttatgtactgtttccttagtttttattagagtttttcctcgttttgcgtgccagcgtgtagttcccgtcgtttcggaagatcgcgttcgcaaggataagagttcagaagatccaagtgaagaagcaaggcaagtcacacattccccttgaacatgttgatcccaatttataaatggtttaccgtttacaaataaatatgcatgttttgctaattacatgggatccgggtattacctatctgcttgcttgtgccatgtttacttgatatctgttctttgtcaaccttgggtaataaatcgactagctcatattacttatgtgacctagctagaactatatgcttagccatgcttaattagcactagctcagttgatgggataattacagtattagacctttttagtatcagaatgagctgcgtgctcgagacatctggccatgcttcatggtcgtaattatccaactaaaatgcgactgaatgatgggctgtgggtgcatggttttgctagtcgcacccatggcaattaaggaccggttcgcgggatgccctggaagaacttatcgtacttaccacaagccagcgtgggcaacggctggacttgtagtgtagctttcctctagccgacgcatccaggcaagggtgggcgtgatggagcggggcgggccctgcgacggtttctgtcgcttccggattcacctaggcacgagaggggactgcccgttgcccgctggggacgggggtgaaacctgaggtgtggtgtgcttggctagagggggttatgcgaagggtcctgtcatggcctctttccggtatgtcgtggtggcatgtcggcacacggaaacgtgttgtggggctgtcttgtgggtatagttgtacacctctgatcagagtaaaactattcgaatagccatgcccgcggttatgggcggtcgaccagattcaccgtgattagtcccatcttaataaatcgacccaatacactgtagttcaggtgggttggttgggcctgttcaacgtggtgtagcgttgatcagtggagatttattgttactttaattactcaacagttttactgttttgcttaataaaatattttacaactgcctttatgcaaatagccacaaacccctccttgtatccccttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagctgaagccccgctaggatcgcctttttccgctgctgtcgttctgtttaggtgtgaggactaagtgcctcttccgtaagtattttacgctttatttacgtttggaactgtatattacttgtcgttttgtgtaccctggctggtcctggacagggatttaatacgcaaaatagtctgggaatttgggttaaatttctgggcgtgacagatgccctcctgtacttcaagaagccacccctgattaccgagttccttacaacaatccatcatgaccatccaactggggctaaatacggaggagtaccctcctcagaaaattaacttaggattatatacacgcgcggaggaatacccgtactgagctgtcaccatcagcggcccgcttcgcttccgcaacatataaccccatataatgatatctagtaatctaaacaccacgcttaaattaccaaatactactataatatcatcgtcatgatagagtcatcgtaaatacccacactattgcatctcccagataagctagcatcataatgaatataacttgggtatgtaataaatctggtattcatatactcggaaagtaatacaataccaaagtaatataaagaagaatattctaaataaagtacaagtcttataaaagaaggaaaagctactagagccatacccaaattcttccgaagactccgaggactgaagattctattctatttctattccactatactctagaaactatattaaacttgatagatgaaatgaatttcttgcttgtggtgtgtcttgaaatggagagagtgagctccttgtatagcctcccaatgacggttgtgacggttggaatggtcggaaataccctccaaccgtcattgggagctaatccataccgtctagccgcaaccctgcatccaacggcgccaggatgggttcggccgaaccaggggccgacccattttcggctagcggcctcgtcttctgttgctcacttcagacttgtgaattttggcccaattggtcatgtcatttttgcattcttgacctattcattgataggtctgattctcgacattgtctgattgaatgatcacttgttttgatgtcgattcttctccacttagtgttcattctctgcaagaggttagtaatcctagtgccagtggaatatttattattttgacataaatatgcattgcaagcataactagttctcttttatttaagtagtgttgacggacgaaactgatcactaacgaccgtcaacaaatataaatgtgttttaacaatatccatataagtatatcgtttatttcgtacgagtctttatatgagttcactggttgggacttgatgtttcgtgcagaggttgatgatattgcagtcattatattttgaatgttgcatttatctggaacatttttttagcgaattgaaacaattttttataagtggtgaaacatcattaattttttttatatgtgagatcttgtttgtaaagatttgaattacaagaaatacaacggtgcaatcatattatagattggattaataatttaagagaaaaaacatttaaagtgtgttaagaaaagcaagatttgtatggagagatgagagatagggaattatggaatattgcatgtagctgatatgaggcaaggaagtagttgacatacatgctgcatgcaacaaatatgtagggtgcaacacacgcagagatgaggcaaggaaatactccctccgtggttgctatattctgagacggatgaagtagttgacatgcatgatgcatgcaacgaatatgtagagagcagcacacgcaggaggtgcaggaggggggcacccgatttttctcttgaaaatcgggcacccgattcttagttactccctccattccataatataagggat

SEQ ID NO: 3530 - DNA, 6970 bp, Oryza sativa
  unsure (1)..(6970): unsure at all n locations
taataattccaaatttttttaataagacgagtggtcaaacagtgcaaataaaaactcaaaatcccttatattatgggacggagggagtacctcctaaaaatacccttagtttagccgaaaggctacactcaaaactaacctgatgtatactaagaaagtaataaatgctcacaattcttcccaactatagagtaccattattattacatttactaaacaccataaaagaacaatacaactcttttttacaccaaaatttccccatattcccctatggccccacctgtcatccacacaaaagcccacctttcttcttatgggccttggggcccatataaattagaccccagtaccccaccccttcgccgtcatctctctctaacctcacgaaacctaacaagaagaagaagaagagaaattccggcaaggaagggagggagggagaagtcgttggtgcgggggagattgatttcgcgggagggaggggagctcgagaggcggtgattcggggagtcggcagggtggcgccgggtgcggcggcggcgggggcggccgtcggggggatggcggcggcggcggccgagaggcagctggtggtggccgtggaggggacggcggcgctggggccgtactggcccgtcaccgtggcggactacgtcgagaagatcgtgcggtaatgctgcgcccgtgctttcctccccccgccgcgccaccctgctttcttgttactagttgactgtacggccgtcgcggattagtgcatcttggatttcttgatgtggaagaattggaccctttgttgattgtttagctgtttattttgagacgaagggagtacatggaacgcgaagcggtagctagttagttcttgatagtggaagttagcagctatccgtgtatgtgtttgatatacacagttttttagttatattagtcggatatatcgttcactccaagcattagtaggagatttggagatttgttgtttgctctcaccttcttaattgcaaacattaaatggtactagttagcttcaattctgtttcacaatgcttattcaaagagtaagaatgcaagcgcatcatcgatgtgtggaaattcgtggtttcttgatgaactggttggttgttggctatatggtgttgtggcacgagatacatctttttttgctcctgattcgaggagactttgtatcactgcatatgtgcagatctatgacagaatgtagcataattcatcttctactttgggttttatgccttttctagttcctccttgctcattcagaagtatttttcttcagtctagcatattttagtgttttttttttcatgaatgatgaatgattcccatgaaaaccaatttcagtttttggctggtgattttactactcttctgtacaaccagtaatgtaatgatgggatgtctgtttggttatggttatggcttttctgaagtccttgttttcactcttgttaattagttgatgttctggtttcgcatgggtgtaattggaatattcatcacatgagtcaaatttcttgtgttcaagcctttcaaataaaaaaaataatgaaagtgggagctgtttgtattgttggtcaataatcagtttgctctgaattattagggtttgtttgcagttgctatcctcctgtgcttattatttagcttctgtggaaacagttaagaaaaacttcgtagtctgtttgagaaatcaaattaatgttagacgaattctgttagtcaatttaaactgttatttctctgacaagtgttctgtttttagaactgaaataatatctctatttgcaacttgattaaaagagcagcagttagccaaacatcaaaatttctataagctactgtacggaacaggattatcatagtccacctcaacgcaaaatccaaatggagcctttgatgttatgtggtgatccaccacagcttcactctcatatacttactatcatgaaacttttaagctcatctcttgctagaaatttttgtcaatttctgtagcacttagtaacctttgcatttttagtactactattcatgaagcatttcaatttatgcaggagtttttgtgcacatgaaatggcaggacaggtaatttgctctcagtatttatcgtcggacttactacttgatccatgtttccttgacttgtgtcaaaactcaaaagtgtaaattattatcgtgttatgcagaagctcgcagggacaccccctgaacttgcattagtcgtcttccatacccatggtccttatagcggtaaagtttgatatcctccatgccctaagctttttattatgatccattgcaattatttgtatttagttctatatcaacaaaacatgtaagctatgataattcgcttttgattccttgcagctttttgtgtgcaacggagtggatggacaaaagatatgaatgtgtttctttcatggttatctggaatatcatttagtggtggaggctttagtgaagctgctatttctgaaggtcttgctgaagcattgatggtattgacatattggcatcgttcagttcttttcactttttgcacataatgacttcctctggtgtttcctgtactttttttttttggttcaaaatgcataaattagaaactgtggcttactacttccaaaatttcagtactgcatatggttgcctacttttgagttcccgtgcaaggttttagcattttgtttggcttgtgcaatcatgcttcatttggcatatgaaatgatgtttcttttttgccaaatggcacatctttcatgttaacatcaacagtagcaacctttagttccaggcaagttggggtaggctagagatgaaactgatgtgcagccacaaaaaaactaagggaagtatagtactagtaataacaatatagttaaagaagacgtgaattaggtcatgattctgggcatgtggacctccaatttccatgcaactctatccaaaaccataattcatctccacaggaacgactgggatttttatgatggcttaccaatgttatcgcaacattcttcctttactcagcgttaggaccagctatgctgaagcaaaggcagagtttggtatcttattaacagagatattttgatttcctagatgaagggaaatacctcttttcatctctcactgcacctgaatttgggtccagttttgtctaaattagttgatctacaattttgtttctcatagtaagccctgtaaactattagttgagcctggacattatgtagaaccatgatacttaacaatacatgttctacccaaccttttggattactttattttccaagaattatagcttgttgtcttggtattgttatttccagtattctctagaatctgtcctttaatgcccttctgcacaacatatgattcatgtgagaaaattctaaggtggtttgcacatccacttatcagctattgtctcataaaaaatgtcttgatctggatatcagctacagatagccttaccttagtaaatagagtgtataactgtaatcaccatttcattaggttaatttttgtaaggaagattttcattagatcaaccctattaggaaactggatgtctgggccagtacccagaataagcagagtgaaactagtatgatcagaagtttaaattctatgaatgtacctatattagtatgttaattttcctatggtactgagtcttcaaaaatcaaaatttcagtcttcatccctactattataaagagggaatcgtcctcctccacctccacataaaagcctctttcctccataaaaactgtccaccctaaaaaaaactgtttactaataaagccaaccattgtataaacaccgaacagctcactgggcccaaatcctcccactaaacttaataaaaaaaaccattgcaatgcatgacagcatgagcctataactagttgaaaaatacttgggtctttgaatttgatatcattttatttcttgagttctctatgaattaaagtatttattgcctttatgattttatttcctgtgtgcaactagatactccaaggcagttctagtaacagtcagaatcatcaaagccatgaagtacaaaaacattgcatacttgttgcagcaagtaatccttatccactgcctacgcctgtctaccgcccccttgttcaaagtagcgatcacaaggagaacaatgatggagcaaaagaatcttgtcttgctgatgctgagactgttgcaaaatcatttgctcaggtcctacacaaatactgatatctagcatattgctgattacctgtgtttcaatgaagtggtcagcagtcattgttggttctaattaattttacttatattgatgtagtgctccgtttcattgtcggtggtatctcctaaacagcttccaactctgaaagcaatatacaatgcggtaatttcgttattttgttttgctaaattctgtaagccacaagccatctttaataatcttctcctggtattttacttgttcattgatggtatgatagttgcatcttgatttacagagggttgaaaaactcacttaagaatatatcttttaaaataaattataagcatgaacttgcagaactggccgctccactattacatatgttcttgtacttgtacacagtactaaacttcatattttcattaccattgaaataaaaagagtaaattttatcaaacaccacctattatggtccaagttgcacaaaaccacagggattttggcacatgacacataaccccatgtattatggccctaaggtttaacaagaccacaccgttaaccaattttacatactcctatatcaaagttttaaaagttttagttacattcatgtaacatttatatgatggataaaaaactcataaatttgtgatgtgattttataaatgatcaatagtgtggttgtgtgaaactttatagctataatacctggtggttaagtgtcacgtgccaaaacccatgtggttttgtgcaacttagaccacaacacctaaaggttaagtgaaatttactcaaataaaaatgaactcagtttggattgtactgtcattgtatcttatttgtggataagaaaaatatccatttatttcatttttttaattagttagtatcctgcctgaacttgctagctagtctttgtatggtttacagactataaatctatgaattggcatccttatctatcattagtttaatacaagcattttttaacttacatgatataaattttatcttctgcaagaccttcgacagtttgtactgatgaataatttgcaccaggtgctgatgttgtccatgttttgttgcaggcaaagaggaatcctcgagcggctgacccatcagtggatcatgcaaaaaatccacattttcttgttttgttgtctgacaattttttggaggctcgaactgctctaagtcgccctttacctggcaacttggtcacaaatcaccccattacaaaaatggatacagctgcaacatctgtgccagtaccaacttcaaatggcaacccctcaggttgaacaaatgctaacatttggcttagtcttgccatggtatttagcctttagttctgttcctcttttggacgaaaggttgtgacgttgttacgatgtttgtgaatatgtaggtgcttacacatagtctagcgtgagtctgctttaacaaatgcttgacacagctttgttaaggaaaaaaatgttaggctaaagtgaaataaaccattgccataattactccatgggctgaagcaacataggttaacaattatcgttgcatatattggtacgcctgactattttaatagcaggaaggattctggcaatgcccttatgccatccatttttggcccgaaaaaagcatatcattgagttttcaaagccttagaggaataaaatgtattgtgagctctcctctattatgaacacgatgtgcttgtgcatctgacattacatgggactacaatataatttcctatagtttatctccaatttgtcaagtacagatgccttgagctggagatgaagaaaaatggatgtactgaatacacaaacgtgaaaacctgcctcctaaaagcttgtaccattgtgttctatttgtccccttcccatctgggtggtttttcaattgtagtgccaagaaaacatagattattctataatgattgtgtcttcatggttatcattggcatggggtcacaactaattgtttggactctgagtgataatgctttcaatggcatggtgtcttcggattgatgaattctatatggataacaagttttgtttttcagcatcttaatcaaaattaacactgaggatacaaatatatcgcaattcctgtttttatacacagcaatgtggttttaaaggtattcgtggatatacataatttgttgtttttgtgagtgttgatgaagccccttcattgtttgtttcataaataaaattttacagtttaatgttatgaaatgccaaattcttattgtttgtattgtacattgctatgtactaatatatgccagattgcccatctacctaattaaagtggaacatatttcaagtctagccaattgctggttttatttgcatgatccagttgtgataaatctggaattgccttatatagaaatttgtttttggcttctggttatatccgtatcattactatcttccatactgaacatgactaactgttataagtatttttcagttaatggacctatgcttacccgccaaccaaatggtgttgttgcaaatattaaaacggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3531 - DNA, 1126 bp, Oryza sativa
aacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagttctaaagattaatgacaattacttcgaaaaattatttttgtctgtaataaattaagtggataaatcgtaataagcaaatatatgacttataattaataaaaatttccaatatatatatatatactaggcatatatatgaatgatattattatattggtaaaaactctaattaagatatgtatgtacatactgcatgatttaaaattaataaaaattgtaatcatcatatatacttagcctaggaattatattaaattaaatgctaaacactctaagttaacatatgtaaatgccacatgcatgatttaaaccttttaaaaattcgaatagtcatatataagtagcatatgaaagatagtaattaaattgtgaaaaactctaatatatgaatgatagttttaaaaatatattaaatttaatacttttaaaaattctccagtcaattataattagcatatgaatgatagtaaattaaatgttaaaaactctaattagcatatacatgatttaaacttggtgaaacctctaataatcgtgcgtaattaacatatgccatacatcaattgatttatatggataatcaatacatccaaaatagtttacatcgtgtacacaataattacggcattacatggccggtgaaggttgactgcaggtactttctcctcactattgttcccttcttgtgatcgctgcatgagtaaggggtgtcttcatttgatagaaggatgctagggtcaatcgtcaccgtgaaagggggttgcccatccaactgatggtaatcttcgtcagtcttgtcctcaactccgacatttttctttggcttgggagaaccacttgacgcttaggctcatcaggccccccgcccttttttcgtttgctagacatgtacttcaagaaaaagacttgcgttacatcatttggcagaacaaaaggttcgtcgagtatccaaccttgttaaagtcaaca

SEQ ID NO: 3532 - DNA, 1087 bp, Oryza sativa
ccgttttcagccctaggccggtccgctacctccctccgtttggcttgcttccttcgacccatcaaatccggctgaatctttctcgatcacccaaaaatggttaagggtttttgatccacttacctcttttcgttttacccaaaatcaaagcgtaaaactcgagataaaaacaatgggggaagatcgtcgtcatcatcggcaacagttagattaaatccgcaaaataaagctaggaaaatcatggagaaaataatgaggaaagagtgggaatcgatttttttttcaatcaaattggagtgaaaacgcacaatcgatatggcgccggcacagcgcaagggttcaactcggtagacgtgccgcaaatagattggataaaaaacagacgagaaaaaccaaaagcgcacgggataaaaaaacaggtgacaaaaaaaccagaagtgctcgggagacacgcggtgaacaaatcggatttaaaaaaccggaaaaaaaaccgatagcacgtgcatagaaaaaactctttctcgtgaaaaaaaagcaaacggactttttttttgtttttcactggcgagacttttcttttccttttttactgtagtcggacgatttttttttctttttttactggtgacgacataagctttttttttctttgttgagtcggaattttttttaccttttgagtcggactttttttttcttttttacctactatatggaaatttcttattatttttaagtggagatagagatacagagattaaaccaaaacataaaattaaaaccgattgaaacacggatgacgtatcaaataccggcaaaaacatcttcaatttttataatagtagagatagagatttgacaaaagtgtgagtaaactataacaaattcttttgacagcatccaccaaaaaatgcatatatcgaatcaaaaagcatacgtacatatatattttagatcaaaaggctatcgcccagctttactgaaagcataagaagtctgtgtacagaaataaggctggggattccagcttacatatcaagttcttagccaacgacaccggcaacaaagctgctgactcagcacaaac

SEQ ID NO: 3533 - DNA, 481 bp, Oryza sativa
cgtcgcataactccctgatgtacctgaggaactcggcgtggccggggaaccgccgcgcgtcgacctcgccggcgccggagtcgccgtccttgcctgggcggaacgggaagtcggagaagcccatcacctccctcggggtgatgaggcggagcgacgcgtacatgctgctgtgcacgccggccacgccgagcgggtcgccggcgtcggtcgccgtgtcgtacagccactgcccgccgacgccgccgcgctgctcgagcaccgtcacgtcgaggccctctcgccgcagctcgcgcgcggcggcgaggccagacacaccggcgccgatcacgcacaccttcttgcaggatgccatcgtgatggaattgcaatcaaatttgcagcacatttaaataaagcttgtacagagcaacatgggtcagcatggacagctcccagtccgtttaaaattgatttttttttggagatgtttaaacttgaatgg

SEQ ID NO: 3534 - DNA, 739 bp, Oryza sativa
aagcgcggagcattatctagtatatatataatattaaaatacgcatcatctcgtagcaaagctcgtagaagtgttatgttagatggaccaaacctttgttgctttgctactaaaatggtgcaaagcccagcaaatgcaaagttagacaagcctcccattggcagtagatcatggtgagttcctagttagtgagaatgagattacagagaagttagggctcccaaggtaaatttatgtattcttccgctattatagttcacaacgaatggctcggaataagtcggtgtcctgaacactaaagctagcatcaccgatgtaattatcgacgacctgataaataagacttactacatctctatattgagaagctcttgtataaactataaagtaagctagccatcaataaagagatagacaagactttgttcttattatttttattaaacttacaatttttaacataccttaaattaatgttactccttaatccgtataagttttataaaagaaagtttatccaatagagcagtacatttgatgcacatgtatctggaactgagatatgattggactgaaatcccagaaatgccagcgatcaggcgcccgatcagtggcaaaaaaaaatcgggcgcccaccgcttcccgcgcctccgcgctgttcttaccacgcgcctcaccacacgcgccattgcaacaaattacccacgtattagaaacgctctattaagtgaatctgttt

SEQ ID NO: 3535 - DNA, 502 bp, Oryza sativa
gacatcgcgggcaccgtgttctgactctgagctagggtttcctcttcctccctctcgattcgattcgatgcgagttgtagaggcttaggctgctggaataaaataaaaagaaaatcagaagatgatgggccgggcctacccagacagagttaaagcccaaatccatcgccacctcttgtctctcaagagaaacggctccaagttcttttcctttttctacttactattattattatataatatatataaataatcctcacctacccgacaatctctctcccaccccacccctttctcgtttcgttggaagaagaagaagaagaagaagaaggtggtttcgctggaagaagaagaaggtgaaaccctagatctgatctcggatgacggcgcgatcgttgttggccggtaggatggtggcggcggctcaccgcgccttccgcagctggcccctccacacaatcacaaccaccaccaccaccgacgccgccactgccatcgccac

SEQ ID NO: 3536 - DNA, 591 bp, Oryza sativa
ggagtttttttttcctattctttgcatactatttattactccattctctagctgcacgtctcaaaattaaaaccaatgtcacaactcacaacatagtaaacagtcctgtatgaagttttattcaaggaatagttttaggaattcaggacagttttgcatttatcctgtatgagacgtggaaactgttgtttcttttgcttccaatgctttgtaggtttgttattctgacaatctcttcttttttctgaaactcagcttttgggccgatcattgttttgtcttggactgctccttaggtatggttctcaactcatggcagcatccgaaaatcaacttgatttcccaaagattatcagcttgctgaagaaggaatatcttctcaaggatgatttcagcttgaaggttcgaggtttgcaggtgtgcacacttggaatcaattactgcacttactggcactagaaaaactagatggatggatggcatgtccacctgtctagataacaagaatgtgctttagtttcatttatttttcatatttaaaaactattcagtactagatgatatatttttctgtgcatgcaggctttggga

SEQ ID NO: 3537 - DNA, 254 bp, Oryza sativa
cccaattcacttgcgcaagggagaggacgaggacggtgccggacggagccacgcccacacgcttcaactgtgccggtcctaggaggctgtcgtctccgatgatggagccacacgcttcaaccaccgccgacgacgacggagccactccgacgagctaccgccgacggcaacgacggagatgcgctggcacgctcctgattcctgaaggcggcgcctgcttcgtcgcccgtcttctgattccagaaccaatggct

SEQ ID NO: 3538 - DNA, 1587 bp, Oryza sativa
taaagatcaaaatttttaaaaccgggactaaaaacaatctttagttccggttctttttggatccgggactattatggattttgccggaccgaccaaagatggtttctccccccagtggagttatataattttaattgaacatagtaatcacattttaattgtacatagtaatcaccctttgcaacgcacgcgcgtttgtaattaaagtcctatacaacaacacatttcatctaacagaaaggaactttacagatggtacaaagtcaatatgaccgtaggaagttatcatgtacccaagattcactagtttgctattgcaggcttacatgaagttatcatattacccttataaagtttatgaccttaggggcatattaaaacattttagtggtccccaagtaacatttgatgctactggtgagagcagttgacgtggttcccataacacttttctaaaatatatgctttgctggatggtacttttcctcaactccgatcgctcgagtcgaacacttgtgcctggacttaaaaactctcccatcttttagctcctcgtcacttcacttgtcttagccaaagaacctgctcaaacacaatgcctttagtgatgccaattcgagcaagtaatcttgttcgaacacattttccttggaacaggccttattgggcgaatgcaaatttttggtcagaaccggctacatattagaatttatttgagcaaagctcaaaaacactttcctcatcatgcgagtttttggccgagtataggggatggtgttcaccccctgctacaacagtaatggccagcgataactagagactgggatgcacataaacgtacagtatcagcacttaacgatggcattatcagtcttcggacacgcacatatctctaaactaattgtatggtgagaaaatcgaatgtaatccgagaagaaagatggcggcatatttatagcaattccgaaaataaaaaggttcagtttttagtacaatgaaaaatcctcttgagacagacaggccagcattttttttgttgaattgtcgtgtatttatttggtttgcttcatcttaacctgaatttattggagtccaatccaagtgcttttatttgtgggcgtcgtcgtcctcctcggcgggagtccaaccgtgccggcgcagggcgtcgcggacgaggtcgctgtcgtggtagccgtcgcggaagttctcgatgtcgtcgaccatgtcggagagggatgacacaaagatctccttcttccactgttccatccgcgggaagccgcagatgcgctcgccgtagtcgtcgcagcgttccaggttcaagaacatgtcatgcgtccaccgcttcggcaacccggcggcctccatgccgcgggtgtgctcctcgacggcgcgctccatcttcttcggcgacggcagcgtcctccgcccggacagcacctgcgccacccacctcgcctgcaccttgatgaacaccggcaccaccaccatggccgggatccccacgaacgacagcgacggcgcgagcgccggccggaacacgtgctcgtacagcggcccgacgcggttgtcgtcgacggtgacctt

SEQ ID NO: 3539 - DNA, 546 bp, Oryza sativa
ggtgacggtaaccgggcccccgggggtttttgaaaccctggtggtgctacattaaatatttgctaatgacagattaataggcttaataaatttgtctcatggtttactgacggattatgtaattatttttttattagtgtccaaataccctatgcaacatcctatataatactcgatatgacacgtcaaaattttacacacctgcatgtaaacaccgtcataaattgctctgctcttccgtctaagatttgagcattgcattcttaatttccagatgagccacgttaccccgaagtcgaaagttttccagtcgtgcttgtgttctggtttccaggccgtagccgccgtacaccatcaggagattagactcttcgacgctccggagggattatcttctcttatttggaccgtgttttggtccaaaataattattcaaactttcaacttttccatcacatcgaagtttttctacaacattaactttcaacttttcatcacatcattccgattttaactaaacttccaattttggtgtgaactaaggca

SEQ ID NO: 3540 - DNA, 710 bp, Oryza sativa
atcttccgccgttgttttggtcaccggtgagttcgccgcgtcgccctctacgtgttggtgtcctccgttcgcgtcgtcgtgccgtcgttcgccggcgagtttgcgcgcctgagccgccgccggtggtgacgtcaccgctgacgtcatcgccgtcgtctctcgtggtctggccgtggaccgatggatcttggccgtccgttttggatgggtcaatatcggccgttcgtttccgtgagccgccgccgtgcacccggttcaccgtgaaccctagccgctgacgcaataattcccttttccttttcaaaaataattcattattgcgtcataattcaattaaaatctaaataaatgatttaatctgatttaatctttgaaaattcataactaattcatcttagctcgaatttagttggttcaagtttctaattttttctaaaatagagatctacatgttaaaaatatccacatgtactgttcatgcttgtttgtgtgctgttttggtgattttgctcctttctgtttagattccgacgtttccggagagtccgtttttgcaggagaagattttgaagagttccaaggccagcaaggcaagtcacacagatcccaaacatccctttgagcatgttgatcccgtttaaagctattgtttctattcaactattgcatttattttcgaatgtcattgggtggaattaacctaatgtttg

SEQ ID NO: 3541 - DNA, 1237 bp, Oryza sativa
ggcgcttccacgttcaatcacaggatcctagatattttatccaatcataactaaaatgtgccattttaattaatatactaactaataattagataatccctccgtttcgaaatgtttgacgccgttgactttttagtacatgtttgactattcgtcttattcaaaaaatttaagtaattattaattcttttcctatcatttgatttattgttaaatatatttttatgtaggcaaataattttatatatttcacaaaatttttaaataagacgaacggtcaaacatgtgctaaaaagtcatttttatgtaggcaaataattttatatatttcacaaaatttttaaataaaacgaacggtcaaacatgtgctaaaatgtcaatggtgtcaaacatttcgaaacggagagagtaattactactccctccattccaaaatatttgacgccgttgactttttaaaacatgttttgaccgttcgtcttatttaaaaaatttaagtaattattaattcttttcctatcatttgatttattgttaaatatacttttatgtatacatatagttttacacatttcacaaaagtttttgaataagacgaacagtcaaacatgttttaaaaagtcaatggcgttaaatatttagggaaggagggagtacgtattgcacccggtaatttttgttatatgttcgccactccaattgcttttgcgtcgtcgtcctcctcctgcggccgcggcgcgacgggagtccagccgtgccggcgcaggccgtcgcggacgaggtcactgtcgtggtagccgtcgcggaagctctccatgtcgtcgaccatgtcggagagggacgagaaaaagatctccttcttccactgctccatccgcgggaagccgcaggtgcgctcgccggagtcgtcgcagcgttccaggtccaagaacatgtcatgcgtccaccgcttcggcaagccggcggcctccatgccgcggctgtgctcctcgacggcgcgctgcatctcctcctgcgacggcagcgtcctccgcccggacagcacctgcgccacccacctcgcctgcacctcgatgaacaccggcagaagcaccttggctgggatgcccacgaacgacagcgacggcgccagctccggcgggaacacgtgctcgtacagcggcccgacgcggttgtcgtcgacggtgaccttcccgttcgtgtccaggaacgggaacgagtaggtgttgccggtgca

SEQ ID NO: 3542 - DNA, 712 bp, Oryza sativa
caatctttctaaaaacaacattataatcattgcattaatcttggcgaaacagattatcccctcttaaagggccatccagggcaaataagcggagtcgaatggttcgctaaaagtaaaaaaatccgactcttcgtagtcgaagagaacaagaacgtgaattgaggaagttaaagaacaatcaatcgattccagtgagtttaattggttaacatttggttggttactcatcacacaggatgatcaaaagcagaaaattaagcagcagctgccctaggtagaataagatttgattacaagctaaggtgattagaaaggaggctatttgctcaactgaaagccagccagatcaggagtagccgggaaccttgacttgactattcagagacttaatttggaacagaatttttttttaatccccttcctcttgaggtaaaccggatcgaatgtaaagaacgaagtatgcatacaaagtagcgggtttgcggtagagaggagtacgcaccatcaacacctggatgtacctatcgagagggccctcagcctcggagatgtcgagaccctcggccgcttgttgatgtgcagccgtgtcggcagcgctttcgataacacgccgtaccggactgccctcccagccgccgccaccgccgccgcagccgccatcccgccggttcgctcctcagttctcaggcgttagggtttgcttttttttttt

SEQ ID NO: 3543 - DNA, 2242 bp, Oryza sativa
  unsure (1)..(2242): unsure at all n locations
ggtgtttccttttcgaatccctaatagtagaattactcttaatatggttgtcttgttttctggatgtggtcattaacagtagcaacaggaagcccgggtaaatcatgtcgttctgcagaatttggtgcatattgagagccaacacaacaaatagtcccccgttcccccgttctatttaacttgtattatcacgcacgtttatgagctcttaaatggtacgattttccaaaagaaaactgtttaccagcatctacatctcttagagaacttaaattaacttatcaactttccaatctttaatttagtcagttaaggctctgtttgaatctcctgaagataaaaataaaaataaagattaaatgttttacgtaaaagataataacttatgattaactgagttttaattattataaatatgaaaaatagattaatctgatattttagaacaactttcatataaaaaattttcgcataaaacgtaccatttagcagtttgaaaagcgtgccacgaaaatccaaaacttaatgttcactttgttgggttccgaacagcgcttacacccacaaaataataaagtaaatttcatccataatcccatcatccaacagcgctttaaaacaaattatgccataattatttgcgagacaaacaatatttagatattccaatcatcaaacttccagaatcatcacaacagacacagtcatcaaacttccaaaatcacatttgcttcacagtcatcaaacctcctttgggtgtgtcctctagaagtaacagtaagtatcaaacaaactagatgcgcaggtatcaaaagtgctcctccagaagtaccaaagagtaagtactacaaaatggggctacaaaatccggagtcactctcttttgccctgctgaggagcccatccctgtgactgcgaacctctcactcgctctangacatcaatcttaccgaacactttctcatacgcagccacaagccgaagaaagaagtatccaactgtgggtatcagaatgataacgagcatggtgaacttccccttcttgtcctcaggaaggcggtagccgatgttgtccaacacgccagctatgcccttgggtttctcaaggctacaatgcaaacaaaaaaaaaaggttcaaacgtataatgaaaacaaataccacagaaaaaagaacaaggtaaataccaaaaagccataccttttaattattgtgctcatagacttggtaagcttggttaacatttccacattgccctcgctcaaagtaatcatgtgctcagccctaagtaacaatacaaagaacattagagtttaacagcctttcatgagaaaaaataactcttaaacttgacctaatactaaccaggtctgcatggctctagcaaaaatgcgcttttccaagttggacatcggctgcacaacatgaataatattcagaacaatggtaggtgaatggccgaaggttttctatttgctgattgctaccattcaacaatgttttatgttagttttgacatatatctgaaaacagcagcctgtatccacacattagatgtcatggtcgggattacgtatcgtcgcagagggcgtgtggttccgcaagcgtcgccgggcggaacggcggagtagcgcgcggaagctgcgtgccggatgactacagtgcggcgattggatgagttcagattgttagtctgtttatcagtttgttagcttggttttagcacattggttaattcgtgtacccctatttagaggcacagtttttgtggagtttaattaaacagattcaaggggggggttctctcatatactattctctatttgctataccttgctgttcatcacgggcgtcgttccaccaaaccccctcgtccaccggccatcacacattcatatcacataccttcttaccccggggctcgtgacaacttggtatcagagctcatggcaacggacgaatcctccaccaacgcagccaccctcgcagccgcagctgcggtcgcagctccggtctccaatgctgacatcgccaagctccgcgagtccatggccgacgtacttcatggcatgtccctcctcgcatccaaaagtgacttggcggatctcagccgctcagttgccgtcgcctcatctcgccttacatcgctggagcagcagggtgctgcatcgacctcaactccgccccgactcggtggcgacggaatgttccggtgaccaccaccaccaccaccaccaccaccat

SEQ ID NO: 3544 - DNA, 404 bp, Oryza sativa
agtattaggcatcgagttaggacattttcattgcaagtcgtcagtaacataatttcttattgcctagctacttctacttgatggcttatagtagtagttttcttttcataacttttaaattctcgatctgaactatatacctttctgacggaaattctctacaatattaattttcatcgtgtggttatgtatgttcaggagcaagtcgctgacgcctgggaagaagagggcgcggcaaccgcggttcgcgttcatgacgaagagcgagatcgatcacctggaggatggctatcgctggagaaagtatggccagaaagccgtcaagaacagtccttttccaaggtgcctacctacattttatacatataaattcatatatggagtattacaaatgcatgcatgct

SEQ ID NO: 3545 - DNA, 9867 bp, Oryza sativa
  unsure (1)..(9867): unsure at all n locations
ctgtggttctgaaagttccgaatgnacnnnacnanngngcnngcgcgnggcgcgcgagagaggggcactctgcgcggcgacgcgcgctcgcgcgtgcggagcggtgttgatcggaaggagagagggagagagggagcgggagcgtgccgggggagagagaggaaagggccggggaagaggggaagatgggcccagagaaaatcggcccatcgaccccgggggaggcaaaatggacttttgcagaggaatttgatttggaaggatttggattcggagttgaactcgacgatagatcggggatcgagatcttgagatggcacgggcactagacaacaagcaaagaaacagatttcgcaattagggtttttaggagataattttcccgctaggcgccaagacggaacgggcgctacagaccaacccccctaacaagaatctcgaccccgagattcagcacctaagggagcagctccagaaactcggcgcggagaagatcttctcgctcccaggttgcctcatcttcagaatggttgctccattggactttgtagaacttgatggtcttccttcgagtctgacgttctgcctcttcaagaaccttgatcggtctttccttgtaggtcagattctttttcagcacgatattacccaggggaatttgctcttctggaactcgaagacatttctttagctgggatacgtggaacacgttgtgcacatctgcgagaccttcaggtagctcaagctgataagccacttcgccacgtaggggccgatgtagcggggtgctaacttgccggacatcccaaacctcctcataccacggaggggtgatacccgcaggtacacatgatctcctttttcgaactcaaggtcacgccttcgattgtcagcgtaacttttctgacggttctgcgctgtctttaaacgttctcggattagcttaacttgttcttctgctgacttgagtatgtcaggaccgaataccagcgcttcgcccacctcattccagcacaagggggtgcggcactttcttccgaacattgcctcattcggcgacatctgaatgctggcctgataactgttgttgtatgagaactcagcatacggcaaacaacgatcccaagtgccttcgaaatccagggcacacgcacgtagcatgtcttctaggatttggtttaccctttcagtctgaccatcggtctgcggatggtaggccgtactaaaatttagatcggttccgagggcttcatgcaattgtttccagaaccttgaggtgaactgagtgcctcgatctgacacgatcttcttgggacagccaaatctacatacgacatgggtcatgtagagttctgctagtttctttccatcaaaggtggttttcactggcacgaaatgagctgatttcgtgagtcggtccacgattacccagatggagtcgtacccgttaggggttcttggcaaactggtgatgaaatccattccgatctcttcccatttccactcgggaatcggtaggggttgcagcagaccagctggcctctgatgttccgccttgactctttggcaaatgtcacacagggctacgtattctgcgacatctcgcttcattccagcccaccagaagtatgccttgatatcttggtacatcttcgtacttcctggatgaatggaataggcggactcatgagcttcctttaggatgagatctcttaactccttcttggccggtacacagatgcgtggaccgcaccaaactttgccttggttgtctatggagaaattggtgtctttcttctcctgtattctttttattaattcttttatcccttcgtcgtctttctgagcctcccggatttgcgactctagggtaggctgtactgtcaagctggcagggacacctgactgtaccacggtcagccttaacttctccaattctctgcacaggcgatcttggtcaggccgtatttgagctacattgcaataggccttgcgacttagcgcatcagcgaccacgttggctttaccagggtgatagtggattccaagatcgtaatccttgattagttccaaccatcttctctgtctcatatttaactcggtctgtgtgaagatatacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcctttcggatatctggcaaggtgagaactagggcagtggttaaccttttcttcatttcttggaagctgtcttcacaggctgcagaccattgaaatttcttttccttctttaacagctcggtcataggtctggctagcttagagaatccttcaatgaatcttcgataatatccagctaagtcgaggaagctgcgaatctctgacacattcttgggcgggttccaagcaagtacagcttcaaccttgctgggatctacttcgacaccattggaggaaatcacgtgtccaagaaatgctactcggtctaaccagaattcgcatttcgagaattttgcgaatagttgatgatccctgagcttttccattatcaacctcaggtgttcagcatgttcttcctcgttcttggagtatatcaggatgtcatcgatgaataccatgacaaactggtccaggtattccatgaagattttgttcattaagttcatgaagaatgctggagcattggtgagtccgaaggacattactgtgaactcgtataaaccataacgcgttgagaaagcggtctttgggatatcttcagatctgattttcagttggtggtaacctgacctcaagtcaatttttgagaaaactcttgctcctttaagttgatcgaataaatcgtcgatccgtggcaacgggtacttgttctttatagttacttcattcagggctctatagtcgattaccattctctcagagccatcctttttcttaaccagaagcactggggctccccaaggggatgagctaggtcgcacataacctttactttccagctcttcgatttgtcttttaacttcggctaactcattagctgccattcggtagggtctttttgcaattggtgcggtgcctggtgccagttctatggcgaactcaatctctcggtctagtggcattcttgttaattcttccggaaatacgtcgggatattcacaaactatgggcaccgactccaaggaggtgacttgtaaacaggttaagatagaccgacttgcggtaggagtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgtaaattttgggttttccaaccatttcttttcacaaaagcttgtgatatgaaagaatgggaagctctcgaatcaaacagaactattgcgggtatggagttgacagagaacatacccatcacaacgtctggagcatcctgagcggtttcagcttgaatgtgattcacacggcctcgaccaaagtggttggaagcatgtgaaccttgtccacttgcctgagtgctaggacgagactgagctgccgctggagtaggagttctggcagtgctgccattagcatgccctgagttggtgttggtagaattctgagggcactagcatagtgacccatctggttgcaccggaaacactgaactgctgatggtccctgtggtgacttgaaagaggtaacactgtttggcgcagtattgccactaggggcacgctgctgtggctggggtgccgggcggttcatctgaggacgaggggcgtagcctggctggcggttagcctgagtgaccgactggtggtattgcatgggttgaccgtagcgagggcgaggtgcgcctcgggaggaattcccctggtggttagatttgcgtttcttgtattcttcggtagcctcttttctggcatcctcaagtagaagtgccttgttgatcatatgttgaaaagtggggaagtcatgcgctagcaactggagtctcattccaactgcgattcctttcaagaatttcctgatcttcttcttatctgagtccacttcctcaggggcgtaccgagccaacttgttgaacatacttaggtactcattgacactgctgttgccttgcttaagtctgttgaattcctctttcttcatgtcaatggtgctttcaggcacatgagctgcacggaaagccgtagcaaactcatcccaagcaatgttagtgggttcagggtgtgcattgcagtaattctcccaccaatctgcagcaggtcctcttagctggtgagaggcgtagagcgtcttctcgaccggagtacactgcactaagttgagttttctatcaacatctttcaaccaatcgtcagcctcgacgggctcgacggtctgagagaactctggcggacgtgacctcagaaaatctgtcagcttggatctattgttgcccatgtgagggtggccatttccatgcgcattatgctgataaccggctacggctgcggctattccttgcaagatttgtgtctgaactgccattaagtgttgcatgttgttttccacatgagatggggaagggaggcgttcttctccagaattatgactggcagtgcggtgagagcggtgagactgttccatttctgcatcacgggaagctgtgcgatgcgagcggttgctacggcggggttgctcaacttctgcattgccggaaacagtacggtgcgaacggttgctgcggtgagactgctcattagctgattcatgatttgcttctggttcgactctaccttcttcaaaaccgaagcgggctggcgcacgagctgcacggcgggggcggctagccatctaaactcccagaagagggcggggtaagagtcagataagtacttaggagggcaaggagcaaagtaaatagcaactcagatagcacacactaggcataaactagatttttcaaatcttaaaaacacctgatacaacgggtgtggacaagtcacagagctacgccgagcttgactgtgcgcacaccacctaggagaaccagactaccaaacaacacccacaatcaaacacacgcacgcactacctcgccacgactccaaaagagttggcggcggaacaaaagggcctaacacacggacgactgctgaagactgcctcctctactcctcgtcggcctggctgcctcctgtagtcggctcctcagtcgaagaaacgtcgatcggctgacgtgaagggaccggcggaacctgtcgagggccggcagcagcgcgggccgctggcggtgggggagctgggtggtggaaacggaacacggtggaagaaccaacaacacgcttccacgcagtgcggataaagcgtggaccacggcgggaggaaacaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaagcggcgtagcggcgggccagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggctaggcgacgaagcgcagtccaggaaaggtcctggtacgcgatctggagagtgggcctggccacggtgaagtggtgggggtgaaggccagctccgtgtatacctccacgagggtagaggtacacggagagctcacagtgagggggaacacggtccacggagtaccccgtgtactcgggacacgagaagccaaggaaacgggtgaggtcacgaagctgagcgacgtggtgaccctcaccaaaaccgtgggaactgaagctggcgttcactgccatctacaattttgaaagagggagaaggatcagtaaccattttagaaacaaactattgaaaataaagaaaacaaaagagaccttagcttttcgcaagtagttttgaacttagtatccttagggtcgtcctaagcgtcgggtttcgccctagggccaagcctgtgctctgataccatctcttgtcacgccccgagctagtcccgactggaattagcccgtgacgctccaaattaacctgttaatcgataccagtcccaggaaacagtgctggtatcacaggaagatagaatatcacagcaacagaggtctctttattatagagtaggagtacagtcatgttgggctgcggacagatcccgagctcacaactgcattagaaaagggaaacggaagccgggacttggaccaaacaacacaggcgcgacttgggaactaggccgaaaccctaaaactcatcgtaaccggcttgctcctggaagaactcctcatcagcaggatccgcttcatcttcatcagcaactagggggggaatatttatatagagcaagggtgagtacgggagtactcagcaagccatgggaaataagtgtttaatgcaggcttcaaggaaaggctgttgttttcgtaattgattttatttgaactcttttctaaaaacatctaggtgagtgcttctcaaacgacacggttgagacagtgcgtcccgtccggtcggagtatgtgcaatgtatcaatctttagatcttaaaacaaggttggcacccggccaacagcttttcaaacggccacccgggccaacaacttttcaaacggccacccgggcctagctgatcccgtcagctgctgatttttcaaacatcgaaccccttttcacaacagtaatttcacaagcagttgtcaaacaaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagccgacacaggcttaccatatgccgacgagaggggtcccagaccaacaacaggttaggttccagaccatactgtgctaggaagcccagggggggtcctctccgacaccaccccggcgaatccacatgtctctcggcatcatggctcccctgataagctagttactcagccaggggtgtcccattccacccatgtggtcgtacttgtcttttgttcggatgaaattccaaggaatcggtccttaagtgcgggagtgggaaaaccgtacacccggtacgttccccggtccgcggttttataaattcatttagttcgcaagcaccgacccaggtgtcgggttttccaagtcttttgtaaaacccaagttttacccaagttgtttttcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaacagattaagtgcgatcctatcaatgcataatattttgcaagcaatataattaaatttcaaatataggctcaagatgttcaaaggtggcttgccttgctcgagatctggagcttaatcctcgaaatcctcgcactgcgggtctacgggctccgaaactacacgcgaaacgggacaactcaacaaacggcgaaaataaagccttattaatgacctctaagcgtgccattaggtagaactcgagatttggggaattttggaagttgaacggagtcaaacggatttacggtggggaagatattgaatttctaagattattggatttttagtctaaaggaaaaggatttaattaaatcctttttggaaaggataaagagaagaaaaagggagagggagggaatatagacttccctcggacggctagggcgcggcccgagagaaagggcggctcggccgagcttaacgggccgaccggcccaagaaggcggcccagagcggcccaagacgcgtgcgcgcggaggaaggagagagagtccggtggaccgagctcaccacgcgcggtcccgggtaggacccgcttgtcagcggctcggctcaccttgcggagggagcacgcggcgcggcgctagggtggaggatggacgtggtgcatgcacgcggttcgcggaggacgcaggtgcggcgggcccacgcgcagcctcacggctcgcggtggaacgcgcacacggggagggactgaccggggtcggcccgtcccgacctcggctgagctggcgccgacgtggcgcctacgtggctgccacgtgggctggcgggaggtagacgacgacccggccgcgaatggacggcgggcggcggcggcgagcggcggagcgaaccacggcgatacgggcgaaagcgagcacaccgggcggttgttcgtgatgaggggagacgagccaacggctcggattcgccggagggagcttgacggcggcgaaacgcggcggcgacaaccggcggggagggaagagggaaacggcgacgaggccacgaggggtcgattcccggcggtgagagcatctacgcggtttcgggaactcgatgctagcgtcggattggatggagctacgccgagcgaggctggcgacgtgcgggtgctacggagctcgagcggcgacggcggcgagcacacggcgagcgacggcaacggttggggcggcgccggctagctacggggagtctactcgtgctaccaccgaaaactaaggggggaagatggagcgaggaggaagaacggagggagacactaccgtgcgggacggggcgctgtgacgagaggccgacggcgcgggagtaatctctccggcctcgggccggggaagaggaagaagagggcgcggccgaagtccccttccgcgtcctcgaacgcaccggttctcctggcgctcggcgaaggacggcggaggcgagacagagcacgggggcggcggcaatggcacggaggcgaatggaagaggaaggggaaaggggaggctggggtttaaatgggcggcaatgtcggtttgggaaccgacttgcgcggtcaagggcgcgagctggcgctcggcggtcgcggccaaagcggcgacagggaggatgacgccggcgaggaggaaaaaggggaaaaggagggggagaaaggggggcttgcccctttgccgattcgggaaaaaggaggaggtgagcggtggcgacccggcaaaaggaggagggatgcttgcttcgtccttggcggcttgcgccggagtggcggtgccggctatgaccactgcgatgacggcggggcggtttggaacggaacggttacactggcaaagggtcct

SEQ ID NO: 3546 - DNA, 1363 bp, Oryza sativa
  unsure (1)..(1363): unsure at all n locations
cgggggcgttgacnatcgaaatgcacctactcagaggtacagnagttcatcacggcgcagacgcgacgcgacacgggcggcaaccacgcgagcgcgcgcgcgaacgagcgcggggagcggcagcgagggagcggagagggaagactcggctcgacgcgggcggctcacgcgcacgcgcgcgggcagagcggagaggcgcagggcgcggctctcgcgctttcgcgcgccaagcgcgagagaggggcactcggcgcggcgacgcgcgctcgcgcgcgcggcgcggggcggagcggagggagagagggagagagggagcgggagcgcgccgggggagagagaggaaagggccagggaagaggggaagatgggccgagagaaaatcggcccatcgaccccgggggaggcaaaatggacttttgcagaggaatttgatttggaaggatttggattcggagttgaactcgacgatagatcggggatcgagatcttgagatggcacgggcactagacaacaagcaaagaaacagatttcgcaattagggtttttaggagataattttcccgctaggcgccacgacggaacgggcgctacaactggggaggccggtgcgtgcgtggacgtgtgacgaggagctccgggcacctcttcttccccttccctggccgctcccagagagcttgctcccgcgccgccgccgctcgtcacggcgccctgtcccgatgcggtagccctccgttcctcttcctcgctcgccctccccctcctttaactcgcttggtagctcggttagccttccggtggttcgtaggcgccgccccaagcccggccgccgctcgccatggccttgccgccgtcggcgcctgctcccggaggccgcctctcgtcgccggacctccacggcgcctccccaccccatccgactccagaaatgaaacccttgagccacggagatgctctcgccaccttgaatcgacctctcgtcgccctgccgtgatttccccttttgctcgccgccgacaatcgccgtcgaaatccgccgccgtcggctcccctctcgtcaatccctctcgccaccacgctcccggggatccccttgacctcccccttgctgccccatggccgccggcctcccttctcgctctcgcgccgtgtcgccccttccgccgccgcatagcgccgcggcgcgtgcgtcgccggtgaccttcgggtcccgcgtcaccgcgtgcgcgtcgcaacccctttccgcaatagctgagcccgagcccgtgcttccttcgctcttttcgcgcgcggccacgtcggcgtgccggcgagattggccgccgcctgatganggacgtgcaagtcatagtcaaanngcca

SEQ ID NO: 3547 - DNA, 12797 bp, Oryza sativa
  unsure (1)..(12797): unsure at all n locations
ccttccacgcgttcgttgggngtttagctcgttccatttcttctcccccaaacccccctcctctcgtgcgcctttgtctcctctgttgctcctccccccccccccgggcgccttgattgcagtacnactaggccagnacntcatcacaccaagccctagcaccgcccctcccgtgagcccttccttcggtgaacccggtcactaacaaggtgcacctggtgcaccggaccgcgccccctttcttccgcgcgccctaatgggccgccttccccgcgcccgcgccggcccaaatggctcggccgagcctccttcaaccctcgggccgcgcccttgccgcccgagaaaatctaatatacatcaatcatccatttccttttccataaatcaattctttattattccaaaattccataaatcaattcctttggtcccgcacgtcagtgattgtcaataatattcttgagaatattatttctataaattccataaaccattcctcgtattccaaaaaattccgataaatcatttcctagtccggaaaatcccatttgagcttccaaaattcatatatctcgatccgtaacttcgatcgactccgttcagcttccagtatttccgtaaagttgagatctttttaatggcactattaattagtctaattaggatctttcttttggtcttttgtctagattttcgattgtttgcgtatagttgcggttaccggattttcgtcactcgtggttttctcgaagattcgtgaagctccatgaagaccttgagcaaggcaagtcaccctttgaccaattgctcctataattggaaaatcattattattttgtttgcaacttgaattattagaatcacacacttaacttgcttggccttggtttgcgtgccaaaccgacggacctacccagtagtcacactaattcttgtaggttgtactaccctgattccttgtcgctccacccttatgatacttcggtatccgtgctctctgagcgcgtataccaattatcccacatacaccgttgtttgttgaaaacttggaaaatgggtttgtgaagccttgaaaacccgacatgtggtgtcggtgtgtttgaaaataaaatgaattgtgaaaactcgcgatgcgggagccgtgcctacgtggcgttgtcccgtattcgcatataaggaccgattcctatgggaaactcatcaagcataacaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtagttggagttgatttgtgaatggctaaaatggcctatatttaagtgaggatttgatctttctatgtggcatgaggtaaccctgggtcggcttgggaaaggctttgtcgcgaacctctgacaccggccagtgtctggagtaagttcgtgtcttgtgggtaaagtgtacccctctacagaggttaactaactgtttgaacagccgtgcccacggtcatgggcggatgtgaggtggttcccgttgcgtagatttgtttgccagtgctttgtgaaaagttgttgtggtgtgggaatcgtaaccagaatcagcctatgtggcagatggatgacctaagtggtcagaaacgaatctgtgtgattcgggatgtctgcgggcatcatagactaggctttccgagtagaagcggattgttgtgctgctgggcagctggactctgggagtccgagaaaatgaaaaaggctctgggagccgcctaatcaagtgaaatggctctgggagccgataagtaatgatctgacccgggaggtcggtacattaccatttgagttgttgaaaagcatctcttaagtcgaatcgagacacaagtctccttttgacccaaagttaaaaagaaagaaatcacttagtgatttcaaacaaaggatttgcaaaacaaccttgcctctcttccaagcttgcattaaacatctaaattcccgtgacttgctgagtacgaaaaagtactcacccttgctctctctctctctctttatatatatatatatatatatatatatatatatatatatatatatatatatatatatagttcccccgtcgtgaagtgaagatgaagtgaagtgaagattagggttttgtcctggttcccagccgtcgcctgtggtgttgggtgttagttcgttggttctgctactgctgctgttgttagtgtttcctcgtccgtgtcatcggttgcattctcgggctgtctgagctgcaacctaagttaaggtaaataagtcctctatttattttaaagatttgcaatgattcatatttgtcaccgtgggtaccagcactatgtcctgggactggtactgagatcgcggtttcgtaggaagcggttcgcgccgttattcctacgacacgctcctgtcaggtgccgttgtacggcggtgccggattggggtgtgacagatgttatgtgatggaaagttgaaagttgagagtagttgggggtgaactaaacacggcctatgtgatgtggaagactacaactgccccagctcacaacatgcagcagctaattataagctctctctcttaagtaaaagtccaagtgtttgattctcggtcacactttaccacagtttattatgtctaagattagataagtttgattacgttagcagctatttgattgtgtccacagttgtaataagattctcttataataaattaggtctcacatatcattgactcgaaaaaatgtagtaagattctccaaggtttactaagagcaagtttaataatataaccaactactcatttcaaaaattgaaacatcatttataaccaatctagtagtctacttatacattgtatctaatccactcacatattggagcacgtgctgcaattaactactccctctgtcccaatatattacaacttagatggatctgactacgaatctggacatatggtatgtctggtatgtccagattcggtatatctggtatgtccagattcgtagtcctaggatgggtaggttgtaatatattgggatggagggagtacaaatatgtagtctgctttttttctctctcctccacataaatagaaatatgacgtggcaagatgtacggactgtttacgtcaccctattataggtgtgatcaagaatttaagacatatcaacttaaacaaatactccctccatttcgaaatgtttgacaccgttaactttttagcacatgtttgaccgttcgtcttattcaaaaattttttatgaaatatgtaaaattatatgcctacataaaaatatatttaacaatgaatcaaatgataggaaaagaattaataattacttaaattttttaaataagacgagcggtcaaacatatgctaaaaagtcaacggcgtcaaacatttcgaaacggagggagtactataatactagtacatgaacagaggtcgcaatgccacgattgggttttcatctggaagaaccgggctccaccgaaagtgtaattcttcgcctgggtgctctcaaaagaacgactaccgactagcaaaatctgttgaagaaaaaggttgtccaatcggcaacatgcgacctctgcaatggagcgactgaaactgccttccatttctgcatacaatgctccttcgcggttgcattctggaactccttggaaatccacctgcacatcacctctatgcaggagcttcacaacctggacaggcccagccggatcccgaccaaacactacgaactcttctaccttctttgtttctgggggctgtggaatcatcggcatgacatcgtcttcaggaatcagaacccctccaccgctcggcttatatcaaaatgcctagaagatgtgaacctctgggtggaaaggctagaatcctggaaagaaattctttcctccttgctgcactccaatgtaacgaattaatcatatgtactgtttctctcttttaaagaaattcagattgggaagctttcccgcgtgaccggtctaaaaaaatatttattgataaatgatgataaaatataatcgagaaccaaacgcacctgcaatgcgatcaggtgttttagcttcagctcgcacaagcacatgcaagaaagccggatttcctactaaccggcacctttttgagggctccatctctcaaggccattaaagtgcctatgggctcaccggccaataacaaactgctgttatccatccaatccagtgtcccaaagcaacattcaagctagcccaacaaccaggcctccaagagtagcaagttgagcgtgcaatccccggcattctcgactataaatacccgaccagaaacacacccagcttcatcactccatctcgccttgtctcattccaagtatagctgcagcctgcacgtactgtactgaggacaatggcgagcaaacgcttcttgtccctgtccctgctcatcctcctcctcggcttctcctccagcttggcagccgggcaagtcctgtttcaggtaagaggtcgccatgagttgggttgcaggctgcagtgaactgatcgtgttttgttctgagcctgagagaatggtgctcttgtgtttgatgatgatgcagggcttcaactgggagtcgtggaaggagaatggcgggtggtacaacatgctgatgggcaaggtggacgacatcgccgccgccggcatcacccacgtctggctccctccgccgtctcaatctgtcgccgaacaaggtccggtgctctctcgagcaccttcgtcgtcgtcgtcgatccatattgccggcaaaatatatccaattggcttgattgctgatctgcaggctacatgccggggcggctgtacgatctggacgcttccaagtacggcaacgaggcgcagctcaagtcgctgatcgaggcgttccacggcaagggcgtccaggtgatcgccgacatcgtcatcaaccaccgcacggcggagcacaaggacggccgcggcatctactgcctcttcgagggcgggacgcccgactcccgcctcgactggggcccgcacatgatctgccgcggcgacccctacggcgacggcaccggcaacccggacaccggcgccgacttcggcgccgcgcctgacatcgaccacctcaacaagcgcgtccagcgcgagctcatcggctggctcgactggctcaagatggacatcggcttcgacgcgtggcgcctcgacttcgccaagggctactccgccgacgtggcaaagatctacatcgacgccaccgagccgagcttcgccgtggccgagatatggacgtcgctggcgtacggcggggacggcaagccggactatgaccagaacgcgcaccggcaggagctggtcaactgggtcgaccgcgtcggcggcgccaacagcaacgccacgacgttcgacttcaccaccaagggcatcctcaacgtcgccgtggagggcgagctatggcgcctccgcggcgaggacggcaaggcgcccggcatgatcgggtggtggccggctaaggcgacgaccttcatcgacaaccatgacaccggctcgacgcagcacatgtggccgttcccctccgacaaggtcatgcagggctacgcctacatcctcacccaccccggcaacccatgcatcgtgagtagctaactcgatctctagcaaatattctgaatcatcctgcaaattgatcgatgaactgatgataaattctgcaaaattctttcagttctacgaccatttcttcgactggggccacaaggaggagatcgagcgcctggtatcgatcagaaaccggcaggggatccacccggcgagcgagctgcgtatcatggaggctgacagcgatctctacctcgccgagatcgacggaaaggtcatcacgaaggtcggaccaagatacgacgtcgagcacctcatccccgaaggcttccaggtcgtcgcgcacggtgacggctacgcagtctgggagaaaatctgagcggtggagaggcacaattagcagattttatttacctgcaattttttccaccctcgacgtataacatatacatgtgatggcaacgagttgtatgctgtatctgatctgaactatgtacgcgattgtccacaaagtactacctccgtaaataaagtgaggatatggaacatgcgtttgcatgcatggttttacaaataatggtatgcaataaaattttcactgcttatgcatttttgcttggtttgttttactaataatggaatattttattttactcatgttttgtatggcaacgttgttttagcacactactacaaaaatcatctttcgtggcggccattttggattttcgctggcggaaatcgcagccgccacaaactaaaggccagtgaagatcacgatcttcactagcggttttcgaccgccagcgataattcatttttgctggtggtcgtcttaagccaaccgccagcaaagatccattttcgccggcggctggcttaagacgaccgccagcgaaaatgaattatcgctggcgggttacagtgtgccagccgccagtgttaatcctggccaaatttttttaaaaaaaacgacggagcagagcaaccgctccgtccgtcctccgtcaacgctccaccattcaaaaatttcataaaaatttatcaagcattcaaaaatccacaaaaaaatacatgaacaatttacaatcaacaatttccattcactcaagcattcaaacatcacaaaaatcaacagattaacaaaaatttgaagtccgccaccgagccccgtcgggctccaccgcctccgccttaacgacgccgttagtgagccctgccggcctccaccgctgtagagcagcgccgcaacctccaccgcggcccgcgcgcagatctgagagagggagagggggtggtggcggcgggggaatgggagaagggaggaagacctggatccaccgcctcgattcgccaccgtgccgccgacgcgagccgcctgcccaccgccgcctcgacctgcgtgcccgcgcgccgccgcctgctggatggagtcgcctcgggcctcctcgcctccgctgctgagctccgccgcagctgagccccgccgctccccgcgcgcactaccaccaggtccgccatgtgcgccgacgccttctggatggagttgcctcggacctcctcgccaccgctgccgaggtctgccgcagtcgagccccgcccctcccggcactggatccgccgcgtgcgccgcgtgcacccggccaccgctctctctacagcgaccctctctgcagcgaagggataaggaagaatgagtggtgaggagtgaagggataaggatagggtggggagagattttttttatagctcgagtaatttttttgctggggctatgtggtgaacccttttcagaagcggttgtatgagtggactgcttgtaaaaaagaccaacgccggtgaatatctgccatttttgctggcggtgtattaagtgcgccgccagcaaaaactgtaatatctttgatggtggcccgcttaaatcaaccgccagcgaagatcagttttcgctggcggttcgaaacttcctaccccttgttatattttttgtggcggttttcataaatattcgccatgaaaaatgatagggtgacgctgtgaaaaattaattttgtagtagtggcaatgctagattgtcagctcacatttcccaattaatagtcacagaatttagaaaatgaattagaaggtagaaacttcaatagttacagaattcagaaaattagaagataggaactaggaaaactagtcttttttttcttccaagggttcaaaccaatgaacaactcataaactgcttatcaaaatctccagctcaccaaacataacccataccaatggaggtattagacaatcctcgagaaagtacctctatgcatctaaagtttataataaaatttttggtatcttaatatacttagcacctagaattaccaaattttatactagaaaatatggtaccttcagatattttcgattcttaaggatagtaatattacacataccaatatgatagtgcaagcaaaggctaaaaaaaactatataaatgatttatttaaaattacataaaaaaatcaaaagattaagaaatgagtaaatttcaaaaagccacaggtattattgttcgagttgcacaaaatcaccggagtttcggcatgtgttaagtaatcatcgatattgtggttctaaggttttacaaaaccacaatgtttaccaatctagtttagtactgctgcaatatgaaaaataatgaacttaaagtactacaatattcaaatgatgaattaaaaagaactcatatattcgatcattgtttggaactcatatgtatggtagacaaagaaaattttgtttacggtgtgaaactataaggtcataatacacatagttatgtgaaaaagaccaaaaccctgtagttttatgcaatttactctagatcataatacctatggttttgtgaaatttactcttcttatagtatatatgagagcttgtaacaaatacatgtctataaacaatctcaaatgagaaaacttttaattacaaagttgaagttctcatcgaggattgtaacattcacacgaaatttgcattcatctgacttcatatgtaaaagtttgaaaaaaaattaaatctgaggtttttccatttttagaggttgatagctagaaaaaaaaccgcatgcacactaatcgatgccatttttaagaagtctacttgtgaaaaactattttccttattctttgaaaatgactaaaatttaaaaatatttaaaaatttatagaaaatatcatattatgtgtgcagatacttcaaactataaaagacgtgcgatctagcaagtacaatatctccacacatgatatataggtttaatagtgttcttgtccctgttttcaactgcaaatgtaatcacacccctattttttttaactttgtgattatacccttatttttttaactgaagcttgtgtttgccccaatcccatcaagtcctattaaatacatgtatgccatttgcatatttgcctctacttttttttagaacttttagattgtgcctatattttgacatgattttcaaattttcaatactaaaacataaggtcaaactaaaacttgacatgaagtttgaccctttttctacatgcatttaataccgttaagagggcttaatggaatgggggcatacacaaacttcagttcaaaaagtaagggtaaaatcaagggataaaatcatacttgaagtcgaaaatatgggtaagaacacaatagcccaaaatatacatacatggttggaaaaaccggcaaatcttctcaatcttttgaattttttatgaattataaaaataaatcataaatcatttttaactattccttttgaagcttttggctacgcatcaaattttcgtagaagaacaatactgccactcgagaagtaaaaagaacagtaacaataattcaccagtacaatcgaaccaagcaaaaatgcataagcattaagcagtgcaaattttattgcatagcattattcgtaaaaccatacaaatgtatgtccctgatcctcactttatttacggaggaagtacttcgtggacaattgcatccgtaattcggatcggatacagctcgttgccggcacgtatatacgtataccggtcagggtaaaaatcgcaggttaaatctgctaaactgagagtctcgtcatcgtgcgctcagattttctcccagattgcgtagccatcaccgtgcgcgacgacctggaagccttcggggatgaggtgttcgacgtcgtatcttggtccaatctttgtgatcaccttgccatcgatctccgcgaggtagagatcgctgtcagcttccatgatgcgcagctcgctcgccgggtggatcccctgccggtttctgattgacaccaggcgctcgatctcctccttgagaccccaatcgaagaaatggtcgtagaactgaacaattttacagaatttatcatcagttcatcgatcagtttgcaggatgattcagaatttctgatcgagttggctactcacgatgcatgggttgccggggtgggtgaggatgtatgcgtagccctgcatgaccttgtcggaggggaacggccacaggtgctgcgtcgagccggtgtcgtggttgtcgacgaaggtcgtcgccttggccggccaccacccgatcatgccgggcgccttgccgtcctcgccgcggaggcgccacagctcgccctccacggcgacgttgaggatgcccttggtggtgaagtcgaacgccgtggcgttgctgttggcgccgccgacacgatcgacccagttgaccagctcctgccggtgcgcgttctggtcgtagttcggcttgccgtccccgccgttcgccatggacgtccatatctcggccacggcgaagctcggctcggtggcgtcgatgtagatctttgccatgtcggcggagtagcccttggcgaagtcgaggcgccacgcgtcgaagccgatgtccatcttgagccagtcgagccagccaatgagctcccgctggacgcgcttgttgaggtggtcgatgtccggcgcggcggcgaagtcggcgccggtgtccgggttgccggtgccatcgccgtaggggtcgtcgcggcagatcatgtgcgggccccagtcgaggcgggagtcgggcgtcccgccctcgaagaggcagtagatgccgcggccgtccttgtgctccgccgtgcggtggttgatgacgatgtcggcgatcacctggacgcccttgccatggaacgcctcgatcagcgacttgagctgcgcctcgttgccgtacttagacgcgtccagatcgtacagccgcccaggcatgtagcctgcagaagcattcaagcaattcaacgacctgtgcatgtattttgccggcaatggtgcgacgacggaggggatcgagagagcagagcaccgcaccttgctcgccgacagagtgagacggcggagggagccagacgtgggtgatgccggctgcggcgatgtcgtccaccttgcccatcaggaagttgtaccacccgccattctccttccacgactcccagttgaatccctgcatcatcatcaaacacaagagcatcactgcatcattctcttaggctcagtacaaaacccgatcagttcactgaagcctgaaacccaactcatggcgatctcttacctgaaacaggacttgcccggctgtcaagttggaggagaggccaaggaggacgatgaggaccgaaagggacaagaagtgtttgttcaccatggtgttcagcacctgcatgctgcagacacacttcggagatggatgattgatgaagctcctgggtgtgtctggtcaggtatttatagtcgagaattgccggggattttgccatgctcaacttgcaacttttggaggcctggctgggcttgaatgttgctttgggacactggattggatggataacagccggagtttgttattggctggtgagcccataggcaatttaatggccttgagactttgagagttggagcactcaaaaggcgcaggtcagtaggaattccatctgtcttgcttgtgcttgtgcgagctgaacatgaatacctgatcgcacacagagcatttgagagcagaggaaaagaatcgattgagaatgtacgcaaaacgagctgagccattaacgtataattaattgagtattaactattttaaattttaaaaatagattaatataatttttaagtaactttcctatagaaaatttttgcaaaaaatcataccgtttagtagttcaggaattgaacggtgcgcgtgtaaaacgagagaaatcttctctcttacacttgctgctgaattggtacatgttgcgagttgtggcgaatatgtattttttttcacctaggtgcaaccgcacccatcatttacatacaacttaaatgtacataaaaaaatgtagggcttgtttggtttaatacttaccaaaatgttggtagtgacaaaacctaggcaagttttggcactacaaattttttggtagagtagagttgtatttggttggaggccaatttagaaccaagcttttagcataatatagaaaatatcaaattggacattggcaatgccaatgatttggcttcaaaccaaacccgtcttatgcactgttcaaactatcaaaatatttgtagagcacgttttggcactaaatccaaaacggcccataattgtactatttttgagaaggtacctaaaggtgccacaattttctagtaaaatttggtacctctaggtactttatacctcaaggtaccaacaattttagtgtaaaatttagatacttcaaggtattttctcaagaactataaaattcctctataaaaaaatagtttgaaaataattggtagcatcaatcacaatggcataagtctatacacaaacatacacaaccatgcaaggctgaaacagatatataatcagataaataaaaaataaaaaaacaatattgtgaacagtacatctccagcacaaatagaatatgtgtatttctgtttctttactggaaaataaatttttgatgtgcatgtttgcatagtggtttatatcttctttatctatcttaacattttttttatgaaatatttacatactccctccgtcctaaaatatn

SEQ ID NO: 3548 - DNA, 7754 bp, Oryza sativa
aataaagggagtagctatgtaggtgacatgtatacacctagatacgattgcacctagctataaaaaatactttcccgtggcagttccacaggaccagggcatcaggttcctgttgccatgcacattttagcacgatttcagcaaatttcatgcagcacgttggctgtagcacattcattcctgaacacaggatatggtgcgtctgtcgaggcagataacagaatattcaagatgagaaaattttgtggatggaaccacttggctccaagtctatggtgtgaaccgccctgaacattccggttcaaacaaaacaacggtagcgtcccgagaactgacaccgcgaacagctagccatagtttcatcccagattttaattgggctgtttgttattccaagggaaaaagatagagcaataaaggatcggtcggcttatttccgtgcggctgcaagcctcctcgtcctttttggagtcaaaggcttgtataagcagaggctcatcaggatggttggcttgataagtctggcgtacacaggttgtttctggcaagagcccaagagcagatcggaaccgacttaacagaacagcttttctgcaagaagaacgaactgatgaaaagatcaagggaaagaggggaggcgccaatgcgccatgccttggacgtcacactgcacgcaccggcaaaaaaaaaaaaaagatttagttgtgtttgcgaaattaacagatagtggatcgaacagcgtttgatgttcaaaaaacagtgccgatggagacgcggggaatcgaaccccgtgcctctcgcatgcgaagcgagcgctctaccatatgagctacgtccccaacgatggtaatgtgtaacaaccagtgtatgatactttaatccatgcaatttgttgtttagaaagtgggatcgcggtagaagaatttggacagtcagatattttccgtatcttaaaacgccaacagcatctctaaggcaccacaattgacaagaacatctctgaactaattttttagactaagggtcccctttgaatcgcatgaatgagaaagtataggaataggaaaaacgcaggattttaataggaatgtaagtgtaaacagaggattgcaaaacacaggaatggtcgtttgattggaccgcagaaaaaacgcaggaattagaggagagataaagactcagaggaaagtttccaagaggttttaccccatgttagaattcctccaaaacttgcatggcattagacaatccataggaatttcataggattccataagatttattcctttgattcaaacggctatataggaaaaattcctataggaatgaaaacctctaaaatttatatgaatttccttcgaatcaaaaggggcctaaaattactactccaactacgccaactgcctctgtgtattgtcgaactccactcaaccctacagtttggatggcttggggaagatgtccggcgtgaacttttgcgccgcgcttatactccccttgatcttcaatttacccctgcaacaacgcacgaacacgatatcatcacgacaactcataattccttttttcctaagcaatctctgaatcaaatcaagattgaatcaaacagttctttccaatctcacattatgaacgccatctgagggttcagcttgccgctggagatggccaggaaatcgtcgtccgtgaaggagaaggtcgcgtctggcttcccttcgtacggccctgacagaaaaaggcagagcttattcagtacgacgacgcgacagacaaagacaagagtcgacggagatcgatcgccgggaaagctctacctttggagacgacgcccttcttgagatcgacgacgaatacctcctcgtcgaaagcgagcttctgagagaaaatccacaagtgcaacgccgcacgtacttagttaatctcacggaaattcatggtgttctagtcgattgaccgagatggttatattaccttgggagagatgttgagctggtaaacgaagccgatcttttcgacgagctccttgccggcgccggaggcgaggtggacgcgcaactgctccagtagcgcagccgacttgaggttgctcccttccatcgcgtcgcgcgattcttggttcagattttggaagtttgattgaaggtgagagacggagttgtgttctttgggctttgatctggaaggctttttatgtataaactccatccaccttgcagacttggggacacagaactcggttccggaggccttgtcatgttgttagtagttgcattgaactcttaattaactttcactttcatgcaagattggaacagttcaggtaaggtactattgtgaaatcagatttaggaacagcgatgaacagttgcagaatctgttcttctttatttatcaaccatcctctgtaagactgtaacgtgaatgaacacaactttgtgggctacaagatcaaaccaaaacgtgatagtacaagcgtgccattggcgaaggcattgtcgtctacgttacaaggacggggagagatcaccggagcaagcaaaccacccccagtctgtgctcctactcctcgttctcctccctctccctccgcacggccccgaaccgctcgaccaggatgtcggcgacgatcggcgccagctcgtcgcacggcacggacttcttgtacacgccggcgaggtgagagtcgctgccgacgcggccgccgacgaagatgtcggccgcctcgacgatcttgccggcgctgtccttggtgaggcagcccatgaatccgatgtcggcgacctgcacctggccgcagctgtttggacagccggtccagtgcatccgcaccgcccggggcaccgacacgagcttctccacctgcgacgtcaccagcagcgcccgctgcttcgtctcgatgatggcctggccgcagaactggttgccggtgcacgcgacgaggcccttgagcagcagcgacggctgcggggagaacttctgaagcagcggctcggcgagcagcgcctccaccttctcatccttgacgttcgggatcacgatgttctgctccacggtgaggcggagctcgccggagccgtactcgtcggcgaggcgcgcgagctcgaacatgtccgccgcctgcacccgtcccacgggcacgtgcaggccgacgtaggacagcccttcctgcttctgcgggtgcacgccgaggtagtccctcctctgccatttcttgtcgatgaggtccttcggcgccgcgcgctccagcacgccgttcggcatcctcttctccacctccgaccagaaaacctccatcccctgcaattgccaacgccgcaattaattgataagaacattggaacatacgtaattcagacaatggcgtggaaaaaatggctcacaagttcgtcgatgagccacatcatgcgggtcttctggcggttgcccctggtgccgaggtcgcagtacgcctcgagaacggccttgcacaccgggatgatgtcgtcgccggggacccaggcgtcgagcggcagcgcctcctcccacctcttggggctgatgaacccgccgacgaggaggttgaacccgaacttgccgtccttcaccgccggcatgtacgcgagatcgttgatgtgcgggtgctcgtacagatcgtgcgacccgatcacgcacacgttccacttcctcggcctgccaacaacacgcagcaacaacaagtcaacaaacatgtcagagatcgacgacacgaacagcacgagcatatcaagttgattcgattactgacaggttggtgatggtggggttgccctggaagttgctggtgatgtaggagaggaggttggtgtaggatcgggtgtcgacgatctcgtcggggtcgatgccggcgagcgggttgccgacggggttgcggacgttgtccatgccgctctgaaggctggtgaggccgacggcgttgagcccgtcgaggatggccggcacgtcggggagcgtgacgccgcgaatctgccagttctggcgggttgtcacgtcggcgcagccatccttgccgtacgcctcgatcacgctcgccaggtacctcgtctgctcgctcgtcgtcacgccgtttggcagcttcagccgcatcatgaaccgcccatctgcacagcgtagagccgtagagcggccgttagcattttgggccaaattcactctgggcccccaaaacactagtatatgtttagcaaagagtctaattaaaggaccacgagcccacggctccagttgggccaggtgacggaagagaattttagccgtgagagtcagtatattccatttcattggtgtggctaagatagttgatcttttgcttttctagtttgttttaagaacatatatatatatatatatatatatatatatatatatatatatatatatatatatatatatagctatatgccattaaaaaactatatagtatataccgcaccaaccaaccaatgacagccaccaagtgagccttttcaacctagtaataaaatgtaaacagaacatagaacaaaatggatatgtaagcttatgtacatcctgcagatgaagtagaattgtaagggaccaaaatgactttcgtttttctttttggttcaatcagtacaaaggccacacatcagatgctggcgccaaataaagtactcatactattacttatcaaacggttgtgcgaacattatgttacttgttagagcctgggactgtggctatatgtggcacatggagatgaagtgattggatcaaaggtttccatgtttgctcaatataaatagtcattactcacgagatcgtaattaagctataaaaatcacagcaacttaatcagtcttaattatgttgctgaatgtgcatcttgaaaaaacaaatcagcagaatatcttggcgaattaattgaggtaattcttcctcggcgcgacagatcaactaaccgatcgaaagcaagaaaatgtgttgaacagaggagcaaaagagaggcatacactgatgcttgtggcagtggaagaggccgagccacttgagacgcacgtcgatgtcctccttggagagcttgtcggcctcgatctcctccatgggcatcttggcgagctccttgatgccgccctccatgaacaacgatatgggctccttccccagcttcaccttctcctacgggttcagccctgcccggtacttctccttgagcacctagtaccgcccctctcgctgctccacccgcggctccagccgctccgccgacacggcatcgtccgcgaccggtgtcgaggaggacggcgcggacacggtcaacgactgcacggggcgggtgcggacggcgggagggcggcggcgggatgctgccacgtgtgaggacggggggagaaagcgctgtagggaggcggaagaggccatggctggagacggtggtggtggtggtgcgctgttgcgatgagggtggccatgggtgcggcgcgtgtggttgtttattgcagaggagggagggggcacgagggcgctgttgttggctcttggcgagttcaaaagggcagatgctgcgagagatggcagccacgggaggaaaatttacaaacatgcccgtggcccggcgggtactgttcgtttggttgtgctggtacggaataggagctcgggtagacattaacatcattttgtcttgtgttgctatcaaatggtttttttttcccggtgtttttcatttttggaaagcaatggtggatccataaatttttcaaagcttggacaaaaaaacctatggcaaacggttaccgatatcagcaatatggaatatcgacgttttattatacgtcggtaagcctaggcagctaatagagctgtcggatagttaatgttgttatttgtaaagatttgtatcctgacatagtgtacattatgtatcgtagcttttgttagttgatttctcgtctaacaaaccgagagaccaagtcgtaaagggcgtggtccgccccatgcctaaatcacacactttctaaactgtacgccatgattggtgatacattggtgatactttttaggttttgtttggcaaatagagtagggaaataatcccattctccaaagagtaatattgtatcctaaccatccattcttcaccctcatttaatcctaaccattcatacatttcccttttccaaaccccctccctcctctcattatccatttgccaatgtacattagtcccccatattacaccagcttagtagtatctatctatctatctatctattatatactaaaagtccattaaacttcctaaaatcactctcaagttaacatgtggcatcctaaaaacactctcaagctgccacgtggtgcgaccagaggagataaaggacccacgggtgcaatccatgtatttgcgttgttggactccaaaattcagcaaaaatcctaaaaatttaaggaaaaaatccacgggtgcagccatgtacgcatgtggctgctttccttccattctcttctttttctacggtagttaatagattttttttaatcagtagttaaaagataaaatttctaataaaccgcttgatctaccaaataaaattctgaagtcttcaaccttgctgtttttcctctgtacgcatgtgccctttttcctctgttttttttttgctgtggttgttataatcggttgttaaaagataatcaatgcccttttatggtgacgaaatttctaattaactgattgttctataccattagatctaacaaataaaattctatatattctccgatggctccaacaagtatgcatgcactcttctttgcctttttttctgcgatagctaaaaaatatatttaatgcccttttatggtaaaagaattttgcatacatgcacattgatgtcccacatttatagtaaaacacactatgtccattgttataatatttttcgctcgattttagaggcaggattttagaatttttaatacacatttaccccataccgagttgtacactcaacacagttatctttacatcccaaattttagagatcaaaagcatttcaaggacatagaacatagatatctaatattccaaatgaaattgcacgcatgacaaagcgttgtatttgagtcatctaaggtgatcacgaccgctgcagcgctatagctttgccacatatcaccacgtggcagcttgagagtgtttttaggatgctacatgtcagcttgagagtgattttaggaagtttaatggacttttagtatataatagatttgagctaaactgaaacaaattttgttgaatccaaagcctattataaattgcataaatcatttgaacttttttgcttgaagttcaatatctattctttaaaaaaattgaatttcttaaagtttagaactccaaaacgaagatttgatatgtattaaaaagaacatatagattagatgatatatagttcgtaggaaccaactccatggttgcgacgtaatactttcctatacttcatggttgttgtaagtaattttattttagaatttatatattgcaagtataattagcattcaaaatagtcacaaacaatttattgacaaaaattaggttgagaataaaagtaggaaaagtcacgcatacacaaatattcatatgtgtagagtagtatttcaagcaatactccctccgtcccataatataaaggattttgagtttttgcttataacgtttgaccactcgtcttattcaattttgatgagctactgtgccagtagttcatgatgct

SEQ ID NO: 3549 - DNA, 8234 bp, Oryza sativa
  unsure (1)..(8234): unsure at all n locations
ngtgtgatccggaaccgttagcaagnanannnnnnanannannnaannngtttttgcaaatataaaaaataaaaaattatgcttaaagtattgtggataataaagtaagtcacaaataaaataaataataatttcaaaaaattttgaataagacgagtggtcaaacgttgcaagcaaaaactcaaaataccttatattatgggacggagggagtattaaattttagatgcccgcgcatttgcgcttcctttatagttatataaaaggagagaaggccatgcaagtgaagtgatgatctcttatgcaccaatcctacaccttaaaaccctaacatcaccatacatcccaatcacaaggaaatcactgggagggacccgaatagctaattctcatttctcacaaccgactgttgtcaacaacactacaatcaccattgtgagagaagttggacgttgcaagtcaatcaccagcgatgacgccttcagctaaagcgggagatctcactggtgcgggacttctacatccacatcgacaaactacaacagtagcaacatatgtgatactaatgacttcttctacatccggttagtaccaccaaattctgtattagattagatttggtgatacttggaactcctaaatttagattagatttcgttttaaatttatgttgaaaatcgctcagttttccaacagaaaaagatacttgaaactcctacagtcaaaatatgaacgtccatactataaactatctgaggcagaacagtgctcccgggcttaggcaattcagaggcagaacagaaaccgggggctttgcagagcacagcagttgtttcaaagggtttagcgacatgacgcagatgcatgcgactgcttcacaccgaaggcttcgcacgcgcccttccacccaacccaaaacatccagaggctccagccacccacagggggcagggccaacgtcggggcagcttcgtaatctcgcagcgcggccagaatttttgggtattttagtttaggtggaggccgcaaagatcagaccaacacgataatagttaaacaagcctgtctagatacaccggcagcgaatgagaaacggcccatgagccgtcgtaagggtggatctgcttgtaacgcatgtcgttcttctcaccaaatttctctcgtgtcggatcgtgctcgccaaagtgcagaggcgtgcccttgcttctcactgtgtgtcttaagactctgaacctgaaggagaaaatgaaaaattaacatgctttgatgatgttctacgtggagcatcgacattggcaatgttgataatgatatactcccttcgtcctataatgtagcaatctaaaatgaaatgagacacatcctaagactacgaatctagacgagaaatatcgatgctccacgtagttctagattgctacattagagcaggtacaatagcagactataaaccagctataaacatatttaaagagataaaggaagagagagaatagtagcgggatacatatctatagccagctgatgcacagactccaagacgtaatatatgtataacaggtgagaccagatattaatagtataggaagcaactattgtatgaattgtctattacattacactggttatagataatttagaactagcagtgagctacaatattaaacctgctcttatgggacggagggagtactgattataacacctaaagtcctgatgcgacgacacatggttcttctttttcctttttctttttctttttcttaggcagcaacttatgtttttctgaagcctgcagatgttacttacacacctgatatactgatactattcagcaatggtggcgatgaaatcatcgtgccatggggacagcaaggcaggcagctagtggccaaacgttcgaaaccacacgccgcggcccttgtcctttgatgcgtgtgcaagggcgactttgccttgcctatcctgctgatgcaccagacagacagcgtctgcctcttggacgacgccaacctcctgtccttccttggccagtctctcgcttgggcctccagcccgcagacaacagatagagaccacgcaatttaacacacacagtcgttttcaccaaaattgtcaacttccgtactctccaatttaagctttggaatagaaacatcagctgagattttgattttagacggatatggctgagaagaatatggaattgcaacattcagccaagaactagcacatatataacttctcaagaatgagcgtgctgcaaagtcaggcgaagttcaactggaagactaccctatatgtacacacaggagaaggaaattgtatcgagcccaacgagatacttagaacgggaaccttccacgtgtgcttgaacgtatgcaagatcacagggcattaagggcaaatgggccaaatcaaaatcagagaaatgttacaagaaataattttacgagtcactaattcggtaatcttgcctcctgcgaaaatgtctgagaatgaaactatctgcatacatggggtacttttgtcgtatgagacctttgatgcacttccagaatgaaaaatcaacttgctcaccatccttcctaactatgaaaagacatcttgagttctcaaattctggatgtaaccctacctgcaaagtagcgctaaaggttagtgtccagttggagtaaacaaataaagaaatcaccatttgtagctcataaccatattcaattcaattttattcaagaaaaaaaacgcaagttatttaatacacgatacaaaagtcaaacaagccaactaaaaaaaactacaacaaaatagtgacatttctattcagaatttttgttaaaaataaacatgctgaagtttgttggtaatcgtgattcatgggactatcaccttgacacatcaattacaaaataaagttaaactacaagctgtatgtctagaagtatattgagagctgtaaatcaaaactttctgtgctcaacactcaacagcaagaagagataaagatgataaaacattatttctttgttcttcagtttcgaaaaaaaaaagaaaaaaaacttgagtgtttcgcctctatgtcttaggagacttccttatatctgagagattacataccgtaaggtagtcaataccgcatccaattttcttctcatattgtgggtgataaggaagcaatcgttccaaaattgccttttcatgttcagggctcagtcgatcaccattttcatacctgcagcagtttcaatatcataccctctcttttactgaattctacaagtgcaatatatatttaacttgcaagaactagtttatgaaagggaatactttcagatgttcaatagacaataaaatataaacaagctgttgcaccttaagtatttcagttctgttgccttacaattatatcttgctgattgtaggcaaagcatggaaccacagtccacatggcatacctaatactataagaaggttgatacggtgaagcaatttctgacttgttatacttcaatagtaagaagccatgataacaaacaacacatgctttttgggaacaatgcaacaacatcgtttcttacattaacacaacatatcaacataattaaacaattcttccacacttaggatgctaaaagtgcatgaatcacggtgaactcattccatccaaaaaatggaaaattatatgacaggcacaaatattgctggcatcattcatgtgttctgtgatgtgtgtgcaactgatcaaagtttcataacacctcgttttatgaatcataaactgttaggaaaaattgcataaggcacgtgacactgatggtaagagaagaaaaatcatattttggctgtctgatatccatagctaattggttgcttgcatgagcatgatacactttaagattattaataaaacaaataagatctgtaaagaaaaggtgccgtactgcttccttgaaggaacatgtgtaatataattgtggcagctacaggcaggtgctaggactgatttatatcagatgatggtctggtgtgatgaaagtagatgaatatgaggaatagccaaatagagatatattgtcatttgagtaaaatacacggctggtccttaaagttgagcgcgggtgtcacttaggtccataatcttgtaaattgcacatctaggtccactatcttgtttaagtgactcattgagatccaaaggacctatgaccgggttgactggcttacgtggctgtcccgcatggcaacatatttgcattccccccctttgcttcctcgtgtctgatccaatcccttcttcgcatgacgcacgccggaacgtgccgacggcgacgtgcgccagcacgcgcacctgcggcacccacccgtctcaacctcgctgcgcctggtgacgcgcctcgtaccccttcggcagccgctcgccggcgttgcgccgcgcccagaggaaccgcacaccgtcgtcgacgggaaggagaagaaggaggggaaggggaaggcccccactcctgccagccgcaggtgcacgcggcaagcggctgcggcaactgctcaagtcgagctcgccctgccgccctgccggcgccgtcgagctcgcaccccgcccgctcgcgccgagcttggcgacacctccccgcacgcacgggcgcggtaggcgaccactcccccgggacgcgggcggcgacaccttccccgtgcgtgccgagctcttcaatgcctctggcgccaatgaccagcgggaagggagaccggtggatctggccgtcagtgaggcgcgagcgccaccggcacgctagctacgaagatggtgacggtgctccgagctcgcccaccatggtcatggcgacggtgctctgcaagctctcctctagttcccttcgccgcccgcaaactgctgccgcattcgcccatcgccgctccgctcgcagcccgccgccgcgcttgcccaccgccgttccgcccgccgcccgttcttcaagaaggatttgagggtggggcggcagggcgcccgctgttgagaaggtgatgctcatctcctgcaccggcaccacggccgacgtgttgtggcaggacggcacattgcggcgcggcgtgccgtccttggagttggtgtcgttcgacatcctcaacaaccacgagttcttcccgggtcagcacgtcgacgttgacaccatggcggtggcaacaacaacgacggcgaggcgcgtcggctttgtcgaggtccacgacggcgcgacgtcctgatcttcgagctcatccaccggtcgcttcgtcccctctaatattgtgtcgttggcaatcatgcgccgcttcgtcgaggtccacgacaacggcgatggaggacgctgatgttggcgaggcgaggccggagaacgtgacaagcgaggcggtgcagccgtggtgcgcgacgaggcgccgcagcagctcggccatcggtatgacgtggccagcgaaggggctggcgatgaggatgacgtgcgatggcgatgggcgaggtgacgacggaggcagccgagggatttggggatttttttggtgcccagggctctactgtagcgcgaaggggatatttgcaaatgagctgtctacgtggaatgcaacgtagacggtcagcttcgatcaaaccgggtttggacctcaatgagtcacttaaacaagatggtggacctagatgtgcaatttacaagattatggacctaagtgacacccgcgctcaactttaaggaccggccgtgtattttactcgtcatttggtacaccaaaatatcaaataatgattttgaactaactcatgcaaaccacaatagagtaaggcagtaaccagtaacatgtggaatgaattacattagaacgaattggcacaaacgaaaaccctaaatataatcagtttactgattagtcatatgaaccctgatacaaggcatatgctttgctgttatgccataattataaaaaattgcacttggtactggtggaaattggtctaattgtgcttggccacttaataattccataatgggatccgcataataagtttagcttgcacaccatatgttcgatgaattgtgtttcgaaggaataatggtctttataatccttgtgccatgtgacaacataataacacatctaaatatgtgaaagcaacaagctttctcaaatgatattaagccacgtcatatgatttatatgagccgttggatgcaacaaaaattcagcccctgccgttggatgcattgtgtaaaagagtctcagtaaaagagagcaaacggtcaagaatattctggataggttaggaagaagggaacgagagggaaagaaatccgctcctgtgccaccagccgtcgcctgcggccgtgccttgccccgccgccacctgcacccagcccgccgtgcgccgcccccgtcagtcccatgcatcgccaccgcctgcaccagcccgccgtgcaccgccgccggcagccctgtgcccctccgccacctgcgcccgtgctgtgcgcttccgccacctgcgcccggcccgccgtgcgccgccgctggccgtgccgtgcgcccgatgttcctgacggcgtgtgctactgcctgctccaaccgtggtactacgccactgctcctctaggtcccatgccggtacagtggcaaggcactggcgaggctgcatactgaatttaggtcttttttctgctgccgtttgagcaatctaacactgcaaggcagtctacatacaacatgcagactttgatttactctttaccagccaataagcaaataaataagtcttagtccatagcaggttagaatttagctgatgacttaagaattcccttccatatgctcaattcctgcatacaatttccaaaaggtgaacaaagaggctgatgatatcctctctaccagatattgtttattcattcaaatagatttgttcactcattttaactttgagttctgggttataaatttcagctggaagtcctcatatgaagtttgggttggagggggagtagtacagtatcatggtcattgatctttttggttcaattctagatgacttaatcaaccactgcaacagaaagttctctcttaaaacagtagttatgcttactgatcaaatggtggctttttctaactgaatattttattctagctgttaatttcaatttgtaacattttcgacttgcttgaaggaacataaagcactggtgattccctccactgtgccctttttgaatcctactgctacgaaggcaacatcttttcttcaattctgttattgccctagaatgagcattttgtttttattgaaaccaacggcaagaggtcaatcttgaatataatattttaacctttagttggaaatacaggtttgtctagacttaactattcttgttctcaggttatacaaatttgcatagattaaaattttaaagcatacaatttcatgatcattataattacgacgcatatctaaatatatacacatggattttataccggaatacaaagtcgtgcaacgcacgactaaatgggtagtgctagtgtgaattacaaatttcatctagaattaaagcgagaagaaaagatagttgcttacttgccggagtgcagaatcatccggacgaagccgacgagcggcacggtgtcctcgaggatgaggtcctcccaatccacccactccctctccgtccccttcctcctcccctcctccggcgtctcatcctcccccgaaccaccacccggcgaggactccgcctcgctcttcctctccgttgaaatgtgttctcttatccccccgttcttatactgcttatcgtgcccttacgccgtttatctgttaacgccctttatcccgtatttggctcctttcttctcccaccctataccccgccatctcttaccgcccctaccgctcccactcccttcttcttcttctgatgtccccggcgcttaatccacttttaaggaaaatagtattacgccgccacgccccctcctacgtttactagctcataggggcttcgcagtttatccggcttcactgcccctaacggctcactttcgctcccggcccctatcctgggcacagcgccgatcttcgtcctttgtgcggatcacaggctgcattcgccctatactcggggttttgctctcgtcccctgcttcaccccgttatcgcctcctcctccgtcttatacccgatcagcttgtaggctcccctccttacaccgggacatttcgccgcg

SEQ ID NO: 3550 - DNA, 45557 bp, Oryza sativa
  unsure (1)..(45557): unsure at all n locations
ngggtgtaangcccgacttgacanatagtcnnnanacnnnngntacatgntacttggttgattgggtggacctaccttgtgtacaggtgtcgcgatttgatttggcctgtatattactatgtgcagggttccctgcacctgagccggactcaccggggaaaggtcaattttgattcgccttcaaactaaggctgtgttcgattgtggggttggtaacccatcccctctgcacaaaaacggaacggtccatcagcgcgtactaattaagtattaggtaatttttttaaaaaataaattaatttgattttttaagcaattttcgtatagaaacttttttaaaaaaacgcaccgtttagtagtttgaaaagcgtgtacgcgaaaaacgagggagatgatgttgggaacctgatgcaacgaacgtagcctggtctgtaacatatttttaaaaaaacaattctctgtagcatatattttaaagtggtttcttaacaggatatctatatgacagcccaatcattaaaaataaatctacgtgtaagtgatcatctctcgtatttttcctcgccactccccctccccctcctactctcctcctcatcctctctcgcaccataaccgacgagcccttgagcgacctccaagatcaaaggctggtggcacaagttgatttcctcttcgccccttccagtcagcatgtgaatgtaaacgacaacgtgccttcagagctcccttgaattgatttggcagcaaagagcagtgaacagcgaggagggtgtcaatctccctcccaccttcctcctccatctcctcgagccttgtcaaggtctcgtatgctgacgccctcgtcaagctcccacgccaccatcaggctcctcactgcctacggctgcaccacacataaaatctatcgctaatgtaaccctttgcgcacatggttgtcgcttgttatctttccaaatgactcccatcccgctcctctacctccacacctcactcttgctcctcctcctcttcgttgacgcctctatctctacccaccacatctcactccatgtcaatgtgtccatcgctaggttggcctcgctttccctcgcattactcctaactggatcatcacctaccatgcttgtgacctccaccttgtcatacatctggaggttgcgtagagctctcctcgttgtgctgccagtagactcctcaagctcccgtgttaccaaccaccgtttgccttctcctttatcaacattatgacggtagcatatataagcttcggactatactactcgttgtccctacctttgtttggtcgccatagccgttgtgcatggcttcctccacgctctccagagtttgatttgctcacacggttctaccggcactaccactcgttgcctacaatcccaacattgacctcgtcctgatctagactccttccctagaccctacctgtctgcttcctatcatatcgtgccatcgcttatcccgccaatgaggtcatcctttgtacgccaaccctagtgaccattaggaaagacgggagagatcgagagagttgagggtgagaggagagaggtagagaaataggatagggtccgacgccaccgattaaagccgggtcaaacatgttatataggacaaaatcattgttcaatccggttggggaggcaacaacgaactggttttcatagctgggaaagacgatatacctaattttatggttaagaaatgtgaatcagattcgggcaaataattaaggatgccaaaatggactttgttccttttcaccacgcgtatcatctgcgcagatggtgcatttcggctcttttatggaatcgccatgttggcccaacgtgatttcgatcgggacagcccatgccattcaccgtcaggcgggtttggttcggtctgaggaggcccagccgctctcctcttggcaggctgggcgctgggctgtaggcaatcacgggcctcctggctactagctgttccctgccgcgcggggcgtcgtcgcccttcggcctttcttttcgggtgcccgtcgtcggtccaaacgccgccaccgacgccggagataccgcgcaacgctaaacgctgagcgtcagcgatctaaaataccaccgccgcgacatgcaacaagacgtacgagaaaacctccgcacacactgagccgaaccgaacagccagcgagcgaccccgtttatccggccaaccaccatccgatcgtgctgcgtacgtgatgggtgcagttgcgatgtggaaaaaaagccgccctataatgggatgcagctggggcaagagggaataataacgaacagcctccaaatctatcgtctgaaaatttcttcgtggagaaagctcaaacccagccgctaaaactggtcaagatttcccgcacatgctgctagctgcggccgtttgacatcgctgccgatccatcgtcaggtattccgtcgagaccgcgacaaaaacgaaaggccgaaagggtgtggaatatcttcaaatcgaaggcatgcaagagcaaagttttgatccagccaattagggccggccggcttctccactaatttaaatcttttggctcccacacgttggagttgatacgggtggaggacccagtcgcccagtggtcgtgatgaccactcctgcactgcaagtctgcaatgcacagctctgaaatgaccaacatataaccagatttgattaatgtgcagcttaagtcatgcttctccattagcagtaccgtgatggcgaaggcaaatccagtaggcatcggcaaccctgattcgttaataccctattcccacagcaacagacctatactgaggaagcattatattgctacctgtattatctgtggctgagttctacctgctgattctgtcaaattttgggagagagatataatttatgaggttccagccttccaggttgatgtttaatggcacttaatgcattgaccattgacgaaaaactagtgtcggttccttgttagttccaacccaaggtcaagtcctctgaaagagtacaaagatgttccaggtgaggtcattgttaggtgtagtattgtatttgtctgaataatcttgccttcttctcacgaaactatgttgccatttcgcagtgcgattaatgcaggtaacttctagtcagctgtcatgacatggactcgaagggaaaaacaactgcaagttgtgttgtcactgcataatggttaaactaattaaggcttttattttcttctgaattcagaactggcaggttattattattagaagcaaatgccaatttcagcctaggaacgggtcaatgttcagtttggttgtactcctaactggctacttcattattttacacagagaaaacaaaacaaaacgcttgtttaatcgccaaccaaaagcaatagcgaaaccactcggcagttcagctagacgcaacaacatcatagagcatacatatgcgtatctttatggctgccaatgccgtgaaatctccccaatacctgcaattataaaaggacattattgaagtaggtcgtcatccttctcattgttttacagattggccaatcagaaacgacgagcaagaacaagttgctcctgtatatcattgcacatcagtaccatctttataccggttgttgagacttgggagccgtccatgatgtaatcaagttaagaggcggtcttccatgacgacattgactaacaagaaaagtagcctcgcttatcaaatgaagctctcttctgatttatttagtagcaatgttgtaatttgactaagcagtaagcacgcatcttgaatttttgtcaacttacatatatacaaaatcaattgaaatacaggagggtttacattgctttctagaacattcagtgaaaagaaatcaatgaaatttcagaataattctttgttcgaaacatgacccaaatggcaagttaaaagcaccaactattttggagagaatggcattacgcgcagctattgaaagctagcactgagtattaagcaaagtcaagtatgccgtgcaaattatggcatgtccttgttcaaggcacgtcagggatttcgttttcttgacaattttagacaagtttagaactttcgatcgaacagtgtactgtgatatgctactgtgcttccattgcctttggttgctgaattgccatagttttttgtataaagttgaattgctgtatttagaggaagtgtcatattctaaatgggctagatatcttgtcaagctactcttgcaaataagtttgaaatgaactcatcccctcggtacaaatcattgaacgtgtggatcagacatgattaggaatgcttaattgcgattggcaaaccatgaaatcctggtgagaacacaagttccattgtgttgtcggaatcagattgattttctgatgtttatttctgggtgggaaaatggattttaaatatgtctgcagatatttttgtattgtcaatccatgtcgagagggattacgattgatagtgagatgcatgagggattgtggatactcaatcatgtaaacgttgatcgatcattcttctttctgtgcaagcaactcttaccacctaatgtggttagctgatcaagcaacggcaatgctatttcgattgcaggactttcacaaatttcaagcagtcaagctaaaaccgattagatcttggcatgattttttaaaaaaccttcccatgttaaaaccaaaatcaagcatgggctcttctaattatccaatttgaatactgataaaactattcccttcgtacctcctaagtgcaaaatcttcacctgattattaatacggaacaggatatggactgtggatcgattacagaagagaggatgggtgaatcagtggatctgcccactatgctacaccactcagaaaacatcgacgcatcttctcgcgcactgcaggttctccaagcgaatctggcaggagatccaacgctggattggtctagacctcgacatgtagaactggggcaaccgcacgtccgtagaggattggtggtatcacctcatgctgaggttgccgagaccgaccaagacgctgaagtcgttaatcatcctcattgcttgggagttttggtgcgaacgtaatgcaaagattttccaacacgttgacaccataccaccaaggcaccaaccattattgcaaagatcaagaaagaagcggttacatgggtgagggcaggggcaaccccactagcagagttcatattctaggaaacgcggactaactagacttttttcttttggcttttgctctttgtccctataaatatgttctatcaatatatactaggcaaagcttttgccccttttttttgaaaaaaaatctaattggttgaaaatgaatgagttgtttgcattagaatcggtgtcccataaacaattattatgttgtattaaaaaattttagtcgtataaattttacacatattattatattgtaaacactaattacattgccatatatttaaaaaatattatcttttactgtatcatcataaagtttctctgactaccggtcccacctgtcatcgacctgcgctcgtaaggcagccgagcagggcactcgtgtcgtacaaatactagtgtgtaccgcatcgcactgaaatcacaaccgaacccaccacagattcaaacgggcgaactcaaaatcggcgatttaaacggcaataaacgggtgaaattttagtgcatttgctcctcattcccgtgagtccgtgacccaaattaaatgcctttataattactgccctccgattcaaaccaccaccgttggatcaagggctatatatatatataaataaaagcttctttccctcttacgtcggcacacgtcacgcagctgaccgcgcaaaggaaaaggaaggcggcggcggcgggaggaggagaggataaaaatcccatcgccgcggcggcttcgagggcctcgaagctctcgtctcccacatccccccttcgcctcgcggggcgggggccggaggaggaggaggagggcggcccgacgcgacggcgtacgggcggaggaggacggagagggaggggccgacggctcgccgccgtcatggagaaggttagccatctgatgaacggcggctgcggcggcgtggggaagaggaggggccttccggcggcgggggtggggctagggctgcagaagcagaactcgtggtcgccggacatggagagggacgaggcgtgggagcggccggcgcgggatgaacaagggatcgtcgtcgtcgtcggcgctgcggcgggtgaggagcgtcacggacgacgacctcgacgagctgcgcgggtgcatggatctcgggttcgggttcgaggcggccgggtgcccgctgtgcggcgccgggaggagccgcctggtggagacgctccccgcgctggacctctactacgccgttcacggcaacgccggcggcggcggcggcggcgcgggcgaggtttgcgccgccgcgagcccctgctcgtgcggcgcctcctcgtcggatgtgtccgaggagtcgccgctcgggagccccatgtccatactctctccaggtatgtatacgtgtttacctcgtactcgcaagtcgcatccacttcattgatacatcaatcgtgctgttgttgattatacttccatgatatatatcaatcgtggtgttgattagattgagagaggccacttcctagatgcagagcacctgtgaatcttatcagagaaaacagagatttttcttttctgtaataaatatgatttaggtctcgtcgtctcgatgttttggtattcgattattagttaaaagttttggattttgatttcgattctgattgatcgatgtggtgcaggagacacgccggagacggtgaagatgaggctgaagcagtgggcgcaggtggtggcgttgtccgtgcgcaaccgttgctgaactcgtcggcgacgccacgccattgacatcttctcttgcatcgagaagaatgcaagaacgaaaacttagaaggataagaaaagaatatcccctgcctcgatgcgtcggatgcgggaaaaaaaaaaggaaaatgaaaggaatttagggtttggtgggccgccgccttccaccctccggccggctcccctcctcctatctatcctatcttgaacagttcaagttcatttaacattatcataatatcattcagtcattcagccatcctttttctttactttagcagatttcttgcttattcccctaattcagatctttatcaatcatcaatgtaaatccatgaggtagactaattttatttccaaaaaaatgattattgctcatgctcattgctctcaaaattcgatgaacaatcaaccatgcaaaagtgaaatgttctctgcaatctgcatggagacgaaagaatctgaaagcctgaaattcttcttgagaaagcgtcagccgtgaagcagagcagacggcccggtttgatgcaggctttgcatcatctgtacatcgtcgtcttcgtcatcgatgtgcagtgcattctacggagaattgtttggttggggtgggcaggacaggctgtggtccggctggcgccgaatgggggaggagggatgcacgcagcgcaggcacgtacagttgggcgtccctgtccgtcgtcgtcttggcacggcgatctgtctgtctctaactggtacgggggctctcgtctctttctcacttcactctacacacacgcagggtcacacccgtcacgttcgtcaggcgcacggcggcgtcgcagtaaacagcaacgccgtctcgccgtgcaaggtttgctggtactaacccggaggtcaatcttgtgttaattggcgtgcattgatgcgggctctttttgagtggcaaacggtgctcgtccgttggcgccgcgacgtacaggcattacggctgtgtttagtaccttccaaagttgaaagtttgggttaaaattgatacaatgtgactgaaaaattgtgtgtgtatgacaggttgatatgatggaaaaagttgaaagtttggatccaaagtttgtatctaaacacagcctacagctcacgatagaattgaagagctatagctagctctgtcagtgaacgtaaaaagtcagtgaatgtaaaaagaaaaggctctgacagtgcccttcaagtggcacgcgggtgtgtcctgtgctgcaaaaacgattttaccgcgacttctgagagaattttagcctgactaactaacgtgacctctgagaatgtttgttatactatccgacgctgctaataatacccaattggtgaaagaatcgtgagatgcttgtccagattctccaggagagctattccgatgaagtgatgaggtgaaatgagatgccccctcaggtgctgcacgtgtctggacagcgagttggatcaatcccggagtaggatggccacgacggagacggacagctacacgaaacgtcccccaaattcatgtcgcgtcactggccggccacatgaccaggcgcccccacattgctcgtggtgttatccatgataagcaatgcgtttctcacaaatttggcacaatgctatacagtatacacacacagcccagtgccatggttcatataaattcagatacatcttgtccaagtgttatccatgataagcaatccgtttctcacaaatttggcacaatgctatacagtatacacacacagcccagtgccatggttcatataaattcagatacacgttgtccaaaatgggttcatgtaaattcagatacatcttgtccaaaatggcaaggaaaagtacatatgtataagttcagatacatcttatccaaaatggcaagagaagtacacaaattaagaacaagatggtaacaccgacataggttcctacagcagcaaaatacaatacaggtagcaggcaccatggttaaataggttacatacaatgcttggatataactcagacaactaaaacctatcgagtgaatatctcaggcagcctgtccgcccaagagacaagcccacggactaatggttggcctacaagggcagatcgatctggcgattctgaactaacctactactatactcactttgaaaggactgtgttctagttacaggtaactggcagcttcaccatcctactactactgtaatcactgctcactttgaaaggactgtgttctagttacaggtaaccaggtcttcagcttcaccatcctacaactactatgatcactgctcacattgaaaggactgtgttctagttacaggtaactaggcctttagcttcgatcaccatggacccgtcagagtcctccgaaggcaaattctctttgctgtcggtccaacttgtcggctcattctctctagaacctgcagaaaccattaacagtgcattattagacttttacgcggtggtgtcttgaagccagaggaaaatctcaaactaggaaacgaaaagcttggaaacttctctcccaaatttaccaggaacaattgtcagatagtatgctgacagaaaaataaggaaccccattttgaagtcattaaaacccaaccaaaggacaacataaattaaatagaattgagtggtgatttgctttttcaaaaatgaattgtacagtttatgataacatcagaggctccattgttttcctttttaccaaaatacaattatgtcgagtagaagtggcaagagtctacaagaggctctttctcagaaatagaaataccaagtatgtgtgctacataccagtattagttagagcaagcattcagtaattcagtttttgtccaatccacattttttcagggttagagtagcctctaaaaaactgatgattctaagtttcaaaccatttgtggcactcccttagcttctgtacacattcaaactagtggtctaagatgtggaaaaacaactaggacatggagggagtgcggtttgaaattctgccgcctcagtgttatgagaacatatccctttttacagagaacagtcagtcttctcagcagagtttacaacgattggcctaaggaggtatccacagattttacagtgttgagagatgtgttaacttcatgtaaagttcagtcaaaattgtcagttaaattgattgtaacaaacaatattgacagtttcacaattgtctatcctgtcataacttttttaagtgttatgttgtggaaaatacagttataccccactacgatggaaacataggcattaaactatacacacatcaaataactgttttttgaataaactttaatatttgcttgcccttccaatgttgcatttagttaaaactgtattattatagatgaaatatcatttaaatggttataattcaacaatgatggcagttgactgatcaattcaaagaatttcttttttagtttaagccatttaaatgctgccacctaacccctgatgtaggaaaatgcaatcaatcacatcgacatcagtccttgcctcattatttctcaaccccccacaaagctttacttcatcattgcttaaaatcccatactataaggtaatagtgtgaaagccaaaactcacgaccagtagctatcaatcagaacataacgtttgacattcaaacaagtgaatcaataattgttaatatacacagcatacattttcctaacaataattgttaaaattcacaccatacattacgagcgaaaaataatcatagagcagagcatatgtatgatattgacagattaggctgtaatactcatgtaaagggtaaaactatcagattttacagagtaaaactttttggtaaacaagtaagctatcagtaaaacagagcatgcctaggttgcacagcttcgttttgtttcttgtttgacattaataagcaaaacatagtacctatccagagcaaaagattttttttccaagataagcaattacctcattcttttgctgctccaacatttcatcctgcacattagaatacataaaaataagttcaaatgctaaagcataatcaaatgaatagagtagctactgcctactagtccactatcctaagggaatagaattgtcaggtcttaaggcacttatgtttgaatcatgtaaagcctttcttttgttttccttctcagaagtacttaccatgaaaggcggacaaaacaagggcaaacctcaaagaatgtaataagacagtgcaaaatgaaataatcacaattgtgggtgtgggtgcaatgcaacattcataagtactattttagttagacttgcaattaagatgcatgataagctacgtatattacaatttataaaatgaaatatcctgtacaaagaaggcaagcaactaaccagcagtccaccaccaaactatttaaacagtttaaaatggaaccgactttgattactctaccatgccttcagttttgtttagaactaactttcaagcgtggaacatatttcatggtaacttgtcagtttagaattagtttccaatttcaagagtagactataaagtaaggggctacactagagtatagcgtcaatacaacttctgtcactaaaagagtggtattgtctatgttcatagctaaaaagatactcttttaaggatggaggaagtatatgaaaacacctataatatttctattggtaaggacctcacttggtcaaatgctctggagactactgctagaaactaagtggacatgtggcaaactagtgacaattgagaataacaaaaactgatagtttaagatttcaaaacagcaatttttttagtttgatgattagcaacttgccaccatgtgacagtgacacaagggtccctctgaaatcaatggcgtatcatcaaatccccaatctaaagagtggcagttcacaggcaaatgaataatatgccagcatcaaatgcttcattggaattccatatgtttgaaagtttaaagattaccaaagtgtactacgtacttcaactcatgaagaagtatttccaaattataacgaacaaaactcaaactagaaatgtaaacagaacatggagagtacctgctttttctggagttcatcgttcagctccttaagttttgctacctcagcttccaattccatcatatatgcctgctccatatcaggaagcacaaattaaatccataaaaaatgacaaaaagttttagaacatcaatagcaacttagcaaggagaaagatatgcttatgttttataaacaccactttgttttatgtttatagcgtgtatactaattttaggctaggcttaatacgtgcaaaagatatgtttatagcgtttatactaattaaatttcagtatgtttgaaccaaatacagcataaactttgcaaatatgaggcacatatcctagttagcaaataaaacgatcagcatgatgataaacatttctcacggttattactatttgttagttgtcgcatcgaaaagaaaagaaatgcttaaaagggaaaatatatgtgctacacatgtcactacaggcaagtactagaaggcaaggcaattcgacaagtaaatgctaaacagttgcaagttgcaacaaaaaggacttttcacctgtttcctctggcgcgacctcgcggcagactccctgttcttgatcatccgccgctgtcttctctcgacaaccttctcgatgcccggtgccttccttcccctcagcccacctttgaaaacgtacggcaccggcgatggcgacagcgacgacaggtccccgccttccatcttgccgaagccattggacgagaccggcctcaccggcgaaaccaacgacgcggcaccaccaccgccgtgtccgacagctcccgagaccagcccatttcccagcgagagcggaggcaccatcggagggaacacattgctctgaccgaacaacatcggcgtctgctgctgcggcggcggcgggggaggtacagcagccgccgtaggagtcggcgccggcgggacgggcgggaccgacatgtcctccctcaccacgccggcccgcacgaggaactccttcagcgtgatctccccgagcgtctgctgccggtgcgccggcggcgggggctccgcggcggccggcgcggtggaggcgccgccgccaccgaagcacatcatgtcgcgccagacctcgtcgacggtcttctggctgagcgtgcgggggaaggtcagcgacccctgcctctgaacgggcggggcccccaccgccgcgtgctccgccgccgccacggacgccgtcgtcgccgtcgtcgtcgtgacggcgccgacggcgtgcgattcctcggcggtccagatgctgcggagtagctcgtccatgttcatcgaccggaagtcctttcagaccccgcccagcgtgctctggaactcgtcgaacgtgagcgagtactccgacccgtgcttcgccaacggcagcggcgtcatcggcggcagctgttgatgcctcccgctccctcccggaaaatccatctccaaactccaaccaaccaatccccaacaccccagcaccaaactcacccaaccaaaccaatcgaaaactccgcacggggagcaaccaccacgcctgcttccccgtaacgcaacgagggatcagagacgggaacctgaggagaggtgggatgtggagctctggcgttggtgaggaggacgcgggcgccgcggcgaggcgaggagaggaaaccggacaggtgtcggcagcgaggagccgtgtggggggggcgtttaaaacgccggcctcgagagcgacgaagtgacaccctccaatctcgattagtgcgtgccgggtaataaagttttagtatactccttcctccccttttcgcaccgcgcacacagcgattggtccaccactcgtactccggtcatcagatctcgcgggggcttcgcagtggggccggggtgtcagtggtgtgggggatctgcggggtggggtggggtgggtcgagtgggataaggtattttaatcgtgtttggttcaattggttgggatgctggactcaacgtggtggggaccacacgggggggaggattgtgcgcgggggacgcgaaacgtggcggcatccgcacgatgctgacgggtggcgacgcgacggactgccctatgggaggacgcgaggtgggagcatctgtgcgggcgggaggggacaggtggacggtgcggatcgtggtggaaccaccaccaaccaggcaatcagccgtgacgcgggccgcgtgagagggagcacctagcattgggctggatagtgtggccttggtgggaagggcctaactgctttgcattaggccttttggataaggaaaaagtacaccacaggtccctcaacttgtcatcgagttacaaaatcgtctctcaaccgcaaaaccaaaaccagatacatggcatcctccaacttacaaaaatcatgcactccagatccttcgatggttttaacaccggttttatcctacgtgacggctaagtcaacatgaaacccacatgggacccagatgtcagcctcttcttcccctcccctctccacctatcttcctctatctctctcttcttttctcacttttctcctcatcagttgggcaggggcagctggccggtgggaggaggccggtgggggaggcgggagtccagcggccgacgacgggcgacgaggcggcggcgacgacgacgcgagagcaggagggcctcaacgccgggcgcaggcttctacgcgcgcgccagcagcggctacgtgcgcgccaccgacaggcgtagatgggcggccgcctgacagcggcctgcgcgcggatgaaggagagcaacgcgagcgtcttgcggtgcttgtaccgccgccacgcgagctgtacggcgacggccgcccacgtacgccacccgaccagcatctgcagcggcggcggacgtggagcctgcgtcgatggcggcagccgcatcaagatactctgcagcttcggcggccgcatcatgccctgcccatccgacgacgccctcaagtacatcgacagcgagacccgcatcctcgccgtgccccgctcgatacccttctcgccgtgtgcagatttgaagaagaaggtggaggagatgttcaggacggaggtggcggtcgtcgccgaggacctcgacgtgctcgtcttcgtcacctgggacgaggacctgacccacatgctcgacgagtacgactgctccaaggagaaacggtcgccgtcggcgtcgccacggttccgcgtctacatcttctcctccacggttccgcatgcaccacgacagcagctccggtgccctcgccgaggaggaggaggacgtggggtgcaatcgccacgacgtcgtcgctgctccggtccccgtcgtgcgtcgtggagaaggacacctcgtcggcgtggttcctaggatagccgttccgcgtcgagaggtgagagagagaaaggaggggaagagggagggtgctggcatggcatcctgacatgtggggtcccatgctgactcagccgccacgtagaataaaatcggtgtcaaaaccactgagagacctacagtgcacggtttttataagttggaggatgtcatatgtctggttttgtggttggggaacgattttataactcaatgacaagttgagggactttcggggtactttttcctttggacaaagtacatcgagtggagtaataacaagtacttcctccgtatataaatatttgacgtcattgatttttttaaatttgtttaatcgttcgtcttattcaaaaattttaagtaattattaattctttttctatcatttggttcattgttaaatatgcttttatatatacatataattttacatatttcacaaaaaataacggtcaaacatattttaaaaagtcaacggcgtcaaatatttagggacggagggaataattcagtatacgtgtataaaatattattctctccaagaaaatcaacatctacctcatcgcaaagtctcctcatcgcgatattgtcgattagaaaaataaattaagctcctctgaatatctccctatgcataataataacaatatatcctctcctgattatcttcgtgtagataaattatcgctgtctcgtgaattggcaaactaggccgggctgagtccggcgatcctggcgcactggtgagcgacgacgtcggccgtagacttgctgcgctcgagcaccacctcgtagccgtcggtccagctctccatcccgggcgccatcacctgccagaagaggccaccggcgcacgcgccgccctcccgcgccgacgcgtacaccgcgtcgtacaccgtgcggaagtaggcgtcccgcgccgccaccgtgtacccgttcgacctcgccgaccacccgaactccgtcaccagcagcggcttccggagcaccgccgccgagtcgcggatgtggtcggccatccacttcctcatgaacgccacctgctcgtcgctgctcgcgccggacaccctgccgcaatatgatttttcaccagttaaattaaccatatcacactggatggatggattaatttgtcattcgtgtgctataccattggtcggggtaggagtggatcgtggcgaagtcgacagcggggacgaggttgttggcgatgaagtcggtgccgacggtgtagcccgggttgaagttcttgtgcatcgactcgccgtagaacccttccagcccgatctccaccatgtggttcggatccacggatttcacgtacccggccatctccgtgacccaagcctgcaagcacattgatcaaacgatcacaaattagtacatcttgcaacacatggcgtgatcgggccggtgacgaattaaacgagggttaaaactgagttttgtttacctgaagtgtttttccggagaggtcgctctggcagcgaggctcgttgatgagctcccatgcaaagatggtcggatcgtccttgtacgccactccggttatcttgttcactctggtcaggacggcctgttgcatgcatgcgagcagaacgtcaaatcgactaatcgaggacgttttttactgtcagatatgttttttcctctctttttttcaggttataaactgtcagcgtatcggatgttagctcgtgccttgacatggtttttgtagaactgtttggtcacgtcgctccggaaaaaagtcgtcgtcagagcccaggttgtgtccctgatccctagcccactgcacgtactgcttcttcccgccgaatccgtcccagttgttcaccaggctcagtatcagatacagccctcgtttcttcgcttcggctatcacaaaatctagtccctgaatcacacgacaacattgttatccaaaattgtcaccattacgtacgtacgcatgcatggtgtacacaacacgtacgcaacgataccatgaacatgtcctcgttgtacacgccgggggacttctgcagcggccggtagccgccgtcgctgaacgcccacgtcctcaccagcgtcgcgcggaggctcgccgcctgctggaggacgccggccgccttgctccggtcgccggggtcggacgccatgtacatgagccagtacgcgttgaagccgttcgagtagaacggccggccacccaccgtgaaccgcgtcccgctcgccctcgcgaattgcccgttggcgacgtcggccgcctcgccggcgtgcaagaggacggctgccgcgatggccaggacgacgacgcccaaagttggcagcaagattactcgccgtttgctccccatgatacgatctatgttgtattataatggatgttgcagtgatcgatcgaacacaacgtagatttggatatgtgtactgccgttgtgcatgaagtgcttctttatatatagatatggctaaagcttgccggccggccatgacatcatggccacgcagggtttcctgttctggtgtagcggcagccggcatgaaactaactctcctgtatatgtaaagatggtttgtggtgtaagctagaatgggtttcatgaaaccaatcctgcagattaggctatgtagagaatgcgaggccgttagctggaggaagacgaaagtatgttccaatgtcccatgctcgaacgtataaatagctctcgtataggacggttctgttctggtataaattaacgtcatacaaccggactattgcactttaacttatcaggggtcaggctgtgacctaaggttctggttcaactcaacttgaacccatagaacaacaaaatagaagaacgctgtactcctacttatgcaaagagaaactctgagaacctctatgccatgaaggtactcccaacacaacttcaatttgtaccataaaaaagcgagcaacctggcgttcaatggcctgcatacaaaattttggccccagcggattgtatatggattgtatatgttcgttttgttttttcatcaatgtatttatgcccatgcaatcatcactttatatactcatgtatagctagtgctacagcagttactttgcagtctcccccaaatgttgccaacattgactaaactccaactctacatcagttctgggtgagcaaaggataatctgaaattctaaatagacaatcacaaataactattggcatcctggatgtctaaaaaggaaacgtatcgtatgcacacaagtcgtcttttcttgtacacaccaactaacaaatatcgtaaaaaattctttaaaaataatgtacctttagtaatattccatctacacataaaatccaatctttaaacttttggtgaaactttttagttaatgtgcgtagtatgtacacaaaaaacttgtatgcataagatatagtaacatctaaacagaaccacacgggcttcaaagagcaaaactggacaagagagcaagctgcagtcgtagcttgcagctctcataacctctttcaatacaatatatcagtacaagccccaaggcttgctttgcttacagaatcccatggaaagatacatatcaatcagaatgagaaccactgaacctggccaatctggtggtgactagcataaagctctcgaactcgaaggagcttctattgggtgtacagagattgattgtaggcacagaataacgggagcaataatccacgaaattaactacaatatagattttgctcgatgactgatttataccactccactggcactacaggtatttcatcgatcagaccatgcaaattctctttaaataaccccgtcacctccagctgccacagcaaggaaaaatctgacttcctgattaattctgatttgttggctgacatgagctgcaacgtcctgaagattcatgcgaaatgttaataaattttcaagtaaaaatgctctaataagacaggcaacaccacaacagtacattgcaccacaattagtttaccattatacgagcaaaaactcaccaaaaagtttctacaaaggtacatccattgctacgcccacggtaccaactatgtcacaactagcaagcacgataggtgaaacagcaactgaatgatttgcccgttctcctcaagtatgatgctttcttggttgctctcactccacattgatcttcactcacagaaactgcactacgcatgtcttgcgctttcttttgagcagtgcgtagtttgcccaagattctatccatcgatgatgacctcttcttttcaagcttcatctgaaagtacagaaggcagaacatgtaaccacaacttattacattaaaaagacttaattccatataatcaaagaaaaagtaaaccttcaggaaaatcaattatacaagcatgcatttttatggtacagaagtacaaaagactacctctaactttcgaattgctgcctctgcttttgctttctgcagattttcccaagcagtgatcttcgcttcctccctcttgcaccttgacagaaataaagtctcagcaatagaacaagtcacagtttgtggccttaattagtaagtcaatattacatactaagcactgcaaaattttctctctttttttttgctctgtatttaaattatgacactattgactttatctgctcaaactttttaaactttgaccatcaatagaactcaaaatatttagtatgaaaacataaaaatcatatgggtagatttttcattaataagtacttttataatattataatcttgttagatattaccattatattctaatagaaaattaatgatcaaagttgcacaccaaagaccaaataaagtcaacagtatcatatatttaaatacggaggtagtactattatctgtccggagttctggtattcacgaagggtaaagaaagaagtaggggaaacatatttttcttctgttcaaagggaaaaacaggcacaaggtttaggttgcataactgaatactaaaaagtagggactgagaaaatttatagataaaaaaaaggctaaatttacatatgactaagtggatatctcatccatacaacattggttcttgattatattagtatggttttgtcttttattcatttttttctgccacctagctagttagaccgtataaaaaaaaataaccatttcacagtctagtcccttatattataaattggaatgctgtgaaaataactttataaaagaacctgtggcttactggcttgtgatcctatggcatcttgaaatagatttgcgcattaaaatcaaatttgttgcatagtatttgtttcttaagaaggaaaatgagtaaatatttaatttgccacttattggcagaccatataagagtcaaatcgaattccgcttgcctatgtatatgtacaagcatacaaccaaatcagcttcagcaggagacctggagtgtggcatagacttctctttcaggtttcaacaaaaagaacataagactttcaaaattcaaaccaacagagaagtatagtcactatggcactgacagtaggttggcagtataggattatgagttacaatatgaagtacatgactgtatgctggtctctaggcataaatcaaatttacaaataaaaaaaatgataaacatggggaaaatatcttactttgatacgcagctttctctttctttttcatcaaaagatggagctcgagtctcaattgttttcttcctccactcgacaatatttgttgaccgcctatcagaccctcgtgttacatgtcgcttggaccaccgggtcacagttacttgatcatctacctggacatctcggacttcaggtttaagtgcattactatttggttctttaataggatgtcctgatggtaaactggaacatgaatgtcttgcttttggagaagacgatatactgtcatcaggactcatttgtgtggcaacatctttctttattattggactggaaatggcaggagtttctcctcgcaggccttgcaatttatcatctgtgcgcagggtacaaatttgttaagaaatttaattagcatatatgaagatacatctgaaggttgttgaattaactgtggaaaatccccaatacataaaaatgccataacatttttattttggttgacaaaaatctaattatatccatttcattgttaagcaagatggaaataacataatcctgatgtacactatctgatggcatacatggttatggaaagtcttttataatgtccatctaaacgacacaactagccttctgaagacagaagatcacagaacacatcagacacttgaaaggccttagaactggaaaaaacaagatgttacaagccgattcaaatgttcccaaacaatctaccagtccacatgtcaaagaattaaatgttcaagtgcatatgcatcaggtgtttttgcatgcttagaaatgtgaacaggtaagatcagtctaaacagaatggatgctcggatttgagtgccaaggggttgtatgattgaaatctccacctttgtgctacactgtattgattgaagaactttagatgcattaacaggtagtagtatgacgttatgcatgtgagcatctttcttattatagtatctcactgcaaaaatgacaggatatgcaaatagcataatgtcatgcatgctcactaaccactacaaactaaagtggaaagttcaatttgatgataccaaaacatatcacaaacgccatgcactcttttggcctatcccaacatcaacagaaagttggaaagtcgcgtattcgaagcttgtgataacaggcaagctgttacttgaattatgagtccacgctggacaagtgacacaagctgcaaaacttatatcaagcgtcctcatgaaatcttatgcaaaataacaaatgtgcagactgcagtagcaacagaatcagaacgcatgacaagataccaacaaataaatgataacaatggagaagggactgccgtaatcaaaccttgtgcagtttcttctgagatattagcaaaggcggatgcttccataagtgtctctgtccacgcatgtatacttgctgatctcaagatatatgggtccttctctgcagagtaagatcggctactgccatcatccccacttctacctcttccactgctgaagtcaccattgcgcacgtgctctggcatgagaaccccagcagaaaaaggagaatgtgctgcaaaattagccgctgccagaacaccatcaaagcagggcacaaacggcgaagcagccgcataagcacccggtattccgcctgggtggccaagtgggccactctttgacttgggccgtctatggtgaggcgccggggctgacatccttccaatcccatcacaggaaactggacttaggatccacttctctgcatcctcccattttgatggcagcttcctcccattgttgaaaggaagaacaaccccactgcccccatacctcctattggtaccacctccaagtggcacccgctctgagctccatcccttagggtactgcatggtgctagcgcaatgccggtggtagtttggggtaccggggctcgggaatgtgcctgatctgctccgtgatgacgctgtggagctcttgctcattcctccaacattacccccaaccaagcacctcggcgagagcaccagcagttctatgctcccaccacctccgccggtgagctcatgcttggccggtgaaagcagcaacgcagccccctccgctctgagcttccgctgcttctggcactctaccaaccaacagattccaaaccgaagtcagcaatcacactcaacagagcacaaaagcagcaaccgtactacaagggaagattaatcacctctcagcgagtgggagaaggagtcactgaccgcttccccctcctcctcctccgagcccgcgtcgccgtcgcctctccactcctcctcctcctcttcctcctcacctgcgtgtggaagaggttagctggcgacaaatgtgcgggcactgggataacacagcacacaccaagccgatcgcccgcccaccaacctcgcggtgccgtgccacgcgaggcgtggctgccgatgccgatgccgtgcacgcgcagcggcgagggcgctggatctggatcggtcgcgccgcgaggccccaccgccggctgcagaaaccgccaagagagggcaatcgcctcagcaatcaggagaaatcaaaaccaccgaacaccactgcacagtcgccgcactagtcacacactcacactaccccaagcagcagagacgaattcgaaacagcgagcgatccgtaagccggcgaatcgcaccaaaatagcaatgatagaaaagcgacgaagcagtcagatgcggcgcttttgcctagctttgttcaaattcgcccgccctctttctcctttttggctttatcttttgcttgggcgggatggtttcgccactaacctcggatccgccatgtgagcggcgcgcgtggctggattggatctattgacttctaccgcgcccgcccgccccttgcactaaaatactcgcgatgcgcgtgccgcagccatccctaacacgacaatgcggcggaggaaggggaaggttaagagcgggatatgtttattactgctgcggccgccgccggtcgccttcgccgctgcggcggcggcttcttccgtcgtgcgggatggtggcgtcggtcggccgcggcggcggcggaggcggagtcggggaaccctagcccgggctcgaggcgtcgcatgctcgagcgcgcggtcgcattccccgatgaagcagagggggtggtggcagtggagtgggggaactgggaaggagcagccgaggtgtggacgcggctgccgacgagtgcggcaaggtttcaaccgggcgcgagggggcatttcacactcacacatgggttcctcgctctcgctgccaggtgggcccgtcccccgcaccgctcgcttccagtacagacatggaaggtgggacccacgggcccggggttttgacttggcgcgaatctttctgtcggggtggtagagggagtagtactattcctttgcttcgtttaaaacccagccgcgaacacgtggacaccgtccgcgtcgtggaccccgcgtgtcagcggcggatcacgtggcgtgtcaggcggagccgggtgcgtcggaaaggtggtgggtcccgctcgatacactgcgacagtgtgtgggccccccatcgaggtgagactgtgaggtcgggtgatgatactgccgtgacagtaccagtgccatgcttgccagggcaggtgccccagacgcgtgcagtaataaacggcgctttgctttgctttctccacttctccgtggcgtctttcaggcccagcgtaaaggattcctgctccgagcgatttttttttgtttcaaatggtgtaattctagcatctcttattgatttacaggtcaggttagtacaatctgggttgttcagctgcagtagaaggataatacattcttgatttaccgctccagctaatacagtactactgcccctgccactattttactgctaggcgcgtgctgtgggctgtggcatgatcatggtcagctagtactcctactgaaaaaggttcacggagagagaggcgttaaacagtctagggaattggtggaatcatgacacttgtgctccccctgctcctctctcgagtgacatactacaacagtggcactatgctatccagcacggttggccggtgatgcttttaaggagaaatcaagtcacgcagtaagagcaggtacaataacgctgttagccaactataaacacattttaataagagcaggtataaagcctgcttatctaatattttaacatatatgataaagagagggaaagcagagagaacaaagcggacgacaattcagtcgccggctcaagcacgagcgcctaggggctctgccactgccgctcgggataaccaatcgaaaattagaacttgaacattcagaagttaccaacacctgacaggatgcgttggttaaagcatgggtgtagccaattgctgtatctaccgttgtttagttatctcttaaataatgtggtgaattttggagccggcagttaactctctctactattgaacttgctctaagataaacgatgagagagagaagcagcgggctacagatctgtagccagctgcagcacggattctaagatacactatgtgtatgacatgtgggatcatatattaatagtatagtaagcaactattgtatgaattggctattagattggttataaatgaattggagctggtagtattctgtactgttagacttgctctaatgcggtgacccaacaatcgtgtagcaggggcatcgatcggcatcagcatccgtacgagtttgcaatcaagtcatcaacacgcctggttctccgtcagcgtcaacggacgtcttctgctcttcatgacgaacagttctttccggtatacgatgtgcgtacatcagctgcaatttggcacggctctgggttgcgaaagcaaagcttcgcgcttttgtagtagggccgattggtacacatgattgcgctggatcatcacggaccagcctgtccgttgtacgctcgtagtcgtataataaactcaacagatcacggacgaaccgctcgtgatagtcggacgtccagagagtgatcgatgatcatacatggcaaagaaagtttactgatacaatcacggagtgtttatgttcgtcttcttctccacaatgcacaatctcgactccgcccttatcattggggtgaatccactagagataggccgccgcaagtgagatatcatattgtaagttttcttttagatgattgcagggaaacatcacgaagtcatggctttcactcgcaatttgttcgtgttatgcttaccgatcaagattagctgattactcaataaatacacacacccaagattcagcctgaccaagaatcacggtactacttattcaccgccctgctaccgttgttggcctccatggctacccgcacgtgccctccacgtcgaccggctccgcctcttccccaggttcgttgcagcgaacacgctgtaaattttgatatattaggttattcctaactcaaaacactacacatagtttccataaactctacatcattaaaaaactggtactagacactactattccaatacaaacatcactatatatatttaaatttaatgctatttatctcatatgatgtcttggatgttgtgtagaaaccaagtctcatataagacaaggtttccttctcttttctcatgtattcactttccacatcatttttcatcctaggtgacagttttatttaatgttacggataccatcctagtcattgggttggaaatgacctacttattatagttggatttgcggctttggaaactttctagcttcactaccgatcggttagatgcgtagtcgtcgggatgtagacgggctcatggaatgacggggtggagcactggttcgaccctggcacggcatgcaagaaatgccacagctagtggagggtggagcgctggtccgccaccggcgagtggcgtgcaagaaacacaacagtgggattgggggagaaagaacgaaggggaaaagggtaatctcatgcactccttaaattttccaaagctgtctcaaacgtcaaataaaaaaagatggagacaatatatttttttattctaatatcacataagcgtcacgtgagacaaaaactaaatcaacaccatcacgtaggcattacgtcagcaaacctccgatgatttaaattgtaccggttttagtagttgagggatcgagatatccgatattacgattttgaagactggttcactagttttaaggtaatcaaagtggacttatttcctccaaataaaatctgccacatgggcctcctttaagtgtctaaaggttagatgggccgagcggttctcccttctgggcctaaccggtaattctctctttctctctctacaaattgggcccgaaacgctgaaccgttagcccgcacgacaactctaggtcagccacgaatcgtttcacctcacttcccaccacctctcgccgcttcgggcatcgtctctcccagcgccggccggaccgatggcggcggagccagcagcggccgaagccatggatgtcgaggcgccggcgcgaccaaccaccaccaccagcactgtatccacctcgaagggcaagtccccccacgacctcctcgcggagacccgcgcctccgtggaggaggtcgccgcccggatcctcgccatcaagaaggacgacgcccccagaaccgagctccgggagctcgtcgcccagatgtccctcctcctcatcacgcttcgccaggtccgtgccgctcccgaatccgcaacgcctcttcgccgggaacccctcgcgttagatctgctgtttgctcactcgagggtttggatttgcgcaggcgaacagggagatactgatggaggaggacagggtgaaggcggagacggaggcggcgaaggcgcccgtggactccacgacgctgcagctgcacaaccttctgtacgagaagaaccactacgtgaaggccattagggcgtgcctcgacttccagaccaagtacccgggcatagagctcgtgccgacggaggagttccaccgcgccgcgccggcggacatccgcgataagacgctcgctgctgacgcgtcccacgacctcatgctcaagcgcctcaatttcgagctagtccaggttgtgtaccgtgatcagttgattcagttcctacacaaataggagatttacttgtcatgggataaattcttgtgctttgttcattgttcgtctaaatgattaaagcatcatagagagtgtacaggattgtatgagcatttagattgggggtttgttctgaaggatcagggtaataatcgaaagaaagaatcacatcgtagctgggttgacctgctagtaaatttaacgtaaatatttagcttggcttgcaggattggttctccaaaaattcaaatgtatatatagaaaatgttttataaattcaccgttatttttgtagtttagagtgctcatatatcaaactgttcttaagtagaacgctttgttgttatggaaactctttttatgtatattgattttagtcagttgcataattcttcttaaatctgataattctttgtgtgactagtgatcaaggtttgtagtatgtttttggatatgatttgatctgcttaatttgtttatcacctctagttgtttgaatatgtgtttgcttgctaggacaaaagtcccttactccctttgtgctagtgtggtcttgatttgtttgggtcccaatatttgttctgatatctaaagtaagtttgaaatctgaaacagcggaaagagctatgcaagctacatgagaaattggagcagcggaagagcagtttgttggacacaattgcaaatcagaaaaagttcctttcgagcctcccaacccatttgaaatcactgaagaaagcatcattgccagtgcagcagcagctggggatgcaacataccaagaaactaaagcagcatcatgcagctgaactgcttccaactcctctatatatagtttacacgcagtttttaggacagaaagaagcattcggagagaatattgaagtggagatcactggaagcacaaaggatgctcagatgtttgctcaacagcaagctaagcaggaaaatggttggttcatataatcatatctcattggaatatagtttatttgatttcctattacagaagtgcaatactcgcaataattaatgacatttattctatctcttctcatgtaccgtatgatatgtaagggatcctttttactacttttagaaaagcaatgtagcgtagccacatattaaatgaccagatgcaatttcctagtagatacttgtgtctagcataaacagttcgttctcatatagcagtatagaagccccggtcttttatggaagctgttatattttagttcctcattacaaattgaagctgcatgtaaataatgcatgcttgcttcaatacttgtataatggttagaatcaaattgctaatggttctcttccacttgttataatctgtaaaggtgggtagactaggaaatatttctgataaagcgtgtcttttgtatctgcaatagctggcactttgtcaaatggtgataatagagtggatgacgatgcaattgatgatgaagaagatgctcaaagaagaaggtcaaggtcaagaaaaagtgttgtgaaggaagctagtaattcagtagtggcatatcaacttcatccccttaaagttattctccatgtatacgacactgaagagtctggagcaaagcgtcgtaagctcatggtcctgagattcgactacttggcaaagttgaacgttgtttgtgttggaattgaagattcaaaggggctggaccatgatatcctatgcaacttatttccagatgacactggtttagagttgcctcatcaggttggaatcagctgattttgactattgctagctgaatgcccttgcattttaatggaattaaaagaaaaaaaatcatatcattaccatttcaaatattaatccaagaattcatattgctgttggaatttgatatcttccccttaaatactttgtataaaattctcttattattgttttgatacctaacacagtatacctacttgttcatatcactatttgatggtcccacatgtcaggagatatcatagtggtaggttaaggcagattcaccattcaccaccaccacttgagtttttttaaaggaatatatatacaaatcattctgtgacaatctctagttgataggtcattttggtttccttatatttgtggccataggcagcagtgagctatcatggctttatctcatgttggtagccaaatgtttttggttagttctctgttatattatcttaaagagagtcgttttatcaattttatgcagatggctaaactttatgctggggaggttccgaacttcagtgaaaaggattcaaggccatacaagtgggcacaacatctagctggtatagatttcttgccagaagtgcctctatctgttggtgatgattctaacagagcatcgagaagtgcggacttgtcatctgggcttgctttataccgtcagcagaatcgtgcacagactattttgcagagaatccgctcacggaaggttgcacagatggctcttacgtgagtcactgcttcacaatcttgtagtttgggatgtaacaaaatttggatggtagatccttatagatggaggaaatgtactttggctgatgagtttttgcttcattgcacatgtcattctgtgacgtgctacattattagttgatgaaaaatatttgatgagcaaagtttgtgaacatctcgtctcctttttcttatgagtactatgcatttcctttgtgattagtagcatcttgtatcttttacttatgacctcttatatgtttttgagttatttgattacaggtggcagcttgattatttaactaagctgaagtggcctcaaattgaacacgagaatgcaccatgggcatcacgtaccccattgtgtagtctgcatagctggtcatttactgggatatttcctgagccagcacctcgttctcctttgatggttgttggggctgcaggaagtgttgacagtgatatggagcgaagatctgtgacgcattgggaagaaactgagagtaccagggaggatggggagcttctggccgtggttcctgctgaaaacacgccaagtgtttctaaaatatcacactctgaagtgtcaccggaggttcgaaaccattctagaggcttatccctgatatcaaagagcgccacaccatctaaactaagcatctcacacagttttggtagaaatgaggacgatcttgatctcttgatgtatagtgacagtgagttagaggaacagacatttgttgaccaagaagtggaaaaagtcaaccttgctacagacaaatcctgggaggactatgcttccagggagtttaccctggtcttgagtaaaactctgaagaatggtccaaaagtaatgctggaagccaaggtaaattcttcagttactcttttggtgtgagccttccttaaagtatgtccatgcacaatactttctcactgtggatttttcattgcagattgcgatcagcatggaatatcctgttaggccaccttttttcacattgcaattgctttcgggaaagactgaagctttaaaatggcacaatgatcttagagcaatggaagctgaggtttgtactgctaactgctctcactttaatgtatttctcagtgaagcttcactgcttatgctggctacacttatgatgcaggtgaatcttcacatccttcaggttgtaccttcgtcatatgaggactacatacttactcaccaaattctgtgcctggctatgttatttgatatgcattttgatgaggatcatggtaaaagaaaggttacttcagtgattgatgtgggtctatgtaaaccagttagtggaaccatgcttaccagatcagtcaggggaagagaccgcagacagactatttattggcgcagcgctgattgttcttctagttgtttatagagtatgcataatgctggccctactgaatcaagcatctcgtctcattttgaggaaattggatgctgacagtgacagtctttcattccttcccgccacggagaaagttgcctaacatggattcatggttattcctactggcttgacatagatgatgagctttttccttttcttttgtttgctggagagatgcttcgctgttgtgatactgatgagattatctaactaccctgactgtagccaatggagtgttgtcgggcttgtgtatgaggattttttttttttttgggtgggggtgggtaagagccaatgcaagatatccacttttttcacggtcatcatcagaagatatgtaaccgtacaacattctaaaactcttgttgcatcctgtattcttccagcacgttttgggaagccttcagcattaagcaaaagaacagcttgcaccaagtatagcttgcgtgccaagggtgatcagacttgtatgtgacttgagtcatctgatgtttcatcacttgggtgacatctgtgaggtaatgcattgctcgtcctgagtcctgacccatggattgactgatgttagccatgctatcttggaaacattgttgtatgccaaccggaccgattttcatcatattattgtgtttaagccatgaatttacatcgaatctacactgtcttgttcaagaattctgaaaatgaatgctgcattccactttatgaatcatattattgtgtttaaggcatgaatttacactgtggatgttgcattccacttcatgaatcatgaatcacaagcctgttactagtttactactaaatgtgttggcgccgacgccgacgagctacctatcggagcggctcgagcgaggcggcgccgagcctggtggcgttcacgtagtcctgcggcgcgtgcggcggcaggcccggcagcagcagcccggcggccctggcgatcctcatcagccaaccctcaccgtactccggcccgtcgacatagccgatgacgaagctccgggcgagctcccacgccgcgttcgcgtacttgggcaccaccgtcagcagcgagaagtagttcttgttcggctcctcctccgtcacctgcatcgccacaacaccaatcctcgtcagtcaccaagttcagttggaacacagttgtgggctacaactagcacatgctgcatctgccaattggcacagtttgcagcatcatcctcttctctccatcccacaccaaagtgggctccagttccaggctttcagcaagcaaggcaaggatgctgcccatgacgagaaaagaagcttctcactttctattgttcttaacaccaaattcttgcttgcaagccatgcttgcttgccttgaaaacatgaccgtgtgtatattggtcactggacccctttccaagctctttcaggggattggattagatgccaagaaacaacccaatctaatgcaatctgtcaacaggccggccctacactactaacaacgtactcgctcaattaataaaaaaacaacctatgcgacatattctaatactacaaatctaaacagacacatattcaaatatattatattaggatgtattatatctgatactaagttggtttttataagatctaaacatatatctatctagatttataatactagaatgtgtcacatctcatattagatccgtagtactataggtagaaagactagagttggacactgacatggcctttgtagaagctgtcgaagtagaggcacgtcccaaagtgcttgaacagaagggccgtgtcgtcgtagggcaccctgggcacgatgtcgttgcagtacacgaacctgaagtaccggctcaccggcgtcgccaggtgcccgtccatgaaccggcagagcccctcgtcgccgacgcgcggctgcccgaacgtgtacacgccgtggagcctcgccagcatgtcctcctcgccgtgcagcgccagcacggtcgggaagaggatggcgagcgcgccgccgaggctgtgcccggcgaccacgaaccgggcgcgcgggttctccgccaggaacgccctgagccgctcgcggatgacgtagtaggcgaacggcttcttgtcgctgccgccgtcgtctccggcgccggtgggttgctccggccagccgccgttcctctgcaggcccagcgccttcatgaagccgccgtggaccttgccgacgccggggatctcgtaccacgagaagtccacgtcggcgcaccactgctccgtgtcgaacggcttcgtgccgcagaacgccaccacggcgaggctcgcgtcctccgccttgtccgacaccatgaacgcctgggtcgtgtagtcctcctggaattctgcacaaaaaatggaacaaattaagcgagttggtgaaaatggcatatgcaactcacaatgtgcacgaatttactactccctccgtttcgtaaagttgtttgactctttttctaattaaattttgttaagtttgactaaatttatagaaaaatttcgcaacatctaaactattaaattagtttcattaaattgaacattgaatatattttgataatatgtttgttttgtgttgaaaataatactgtattttctataaatttggtcatacctaaaaaaagtttgactagaaaaaaaatcaaacgacattataatgttttccaaaaagttgtatttttaccattccagcagttgtagaagcccacgaaattcatctgcagaagaaacagactcgtgaggagaggttaaaaatgtgacggcgatttcaagatttgggactatgcagagtttgaacgaattttcactgacctgccagtggttctgaacaacagttctgacgacgagttcgttctcgtaggctagttttgcagccatgatcgacagggcagcgtggtagtttctatcctctggtttgatcttctcgtcaagatcgattcttgtgtcaagcaatccaatgcatgatcggtaattgatggatgatttgtctggcattttcacctttcctgcagaagtgcagagatagcaattatcatctttttttttcttcttcgcttatatcattacttcattatacctcgatgaacagaggatgcaatgaagaacatattttaagtagctagtctacgagaaatcttcaactgttgaaatagaaaatgatagggcaaaaacgacaaaaaaaaacaaaaaactagcgcttatttttttgcatatctaattagagaagcgcaatcaattaagcagcccagaaacacggaatatgataaatttgcttagaaaaaactgaaaaacagccttaaatatcgagtctcccttgctttgtaacattgaacactagctaggagtagaaatcaggatggaagttagctgctagctgtatactgctacgttgtaatacgaggaaatgttcttgtctgtgatgcagagcaaactcaagatcggagcacgcacgaacgtgaaagcgaaataatcataaatgcaaatctacgaggccgtgataaatgtaactgacagctgtatttgtacgaggagcaagtttttcttgcaagtttaactgcagaagaacatgcaagccaagctagctaggtagctagttaacctgtacagagttaaaatctgtaccttgcagagcgttggtgatgagcatgaagacgctgccgccattctcgttgaggaggttcatccagtactccgtcccgccgccgagcagcgccatcggcttcttcgtccacagcagcagcatctgcgccaccagcgacacgaacagcgcccaccgccgccgacgctcggcgatctccgtgccgatggggcagtccacggcggcgttctccgccaccttgcacgaccacagcaggtggaacaggtcgccgatgccgcccttgtccggccgcagcaccatgaagtcgccgccgaagccgccgccgccgccgccgccgccgccgtattctccagctccggccatttttgatgcttacgaccaaagccaagaaaaccgcgagcttcgaatcttcgttggtgttggcttagctagcgtcgacacagctcgttgctcttcccgtacgtcgaagcacagcgatgtttatatagaagtggtcatgcaatgcaattaggtagaggcatataagcgcaattagcagctgacctagccgtgtcaactctgccaattagcgtatgagattagtgcaaagcttggatgagtttaattaaccagttcaaagtgatcagtccgatcaacgatgatatataaaaccgtgttcatgtccacgcgagtacacacacacacaatatctttttcagccaagtcagactcttgtttttgcgtacatttgtaagatgcgatatttgaaatcctgaggcatttcacaatttcgtaacagtttatttggtggtttttgctgtgcgtgcatggtatgcgacgtgcatcttaagtttctttcttgcaatatttctcagcataaaggggattggccagtcacagttctcacggagaagcgtagatgtactgatctctagctagtgcgcctgtcatgcgtgcaacgatagcgacctagccaacagttcatcattaactacagatttatctgacaattaacaatgcgattcctttgtcataaccttgctactagtactagtataggcattgttcagctggcggcaaaaaaagtttgtgtacatttcgtcagcagtagacataggtattatcgatcgagatggggtatcatttggctggaaaacgagtcctgaaagaatgattcaatagaagcaattaagagagtgacatggcaatttcatccttggaagctatcaccatatccgtaacaagccaccccagttgctgcagctcgattattgcttgatgcgttccttcaccccccaccatctcggtcagaaactagctatgcaatatgcatcaccggctgttacgtgaggctcacgaagcattggagtgatctcccaactaacgaggcatcaatggctggctagctacttctcttccatttccatttcttcttggtcttggcgttcgattcgatccccgccgggctcctcaagcaaacaaatttggtggaaaacaccgcgtgatactcctaagaatttgtccttaatttcctactgtttttacttaaaaaaatggtgtgatgtttttgttcatagttaaattgctacacgtgtgcagtattttttagaaacacggtacaattgtaagcgttcataatacgcagactcatcccgcctaaacacacacgcacaccctacccctatgagcacgtttagaagattatgccgatatatcttaaaatcgacgaagtcaccatgaatatctcactaaaaaaataattagtcataaatgagtactgtgttaagtttaaaacttgtatcaaggtgggttggtttcaccacaagaaacctaaccagttgtgcactcgtgctacactcacttcaactacgtgtgtgctgtttgatacagtggatgtggatccacatggaaattatggtccaaacagaaacaggtgtatgtcactttgtgtgtatatctcgcaaattcagacgaaatggatgaaccattttggatcttactctccactgaaaaagcactagacatcattagtaaatggaaaataagtagataaccacgtctccaaaaatagaccggcaatgtagtagcatcgagtctttggtcttcctggacgtcgcttacaagataacgacgtaaagcgtcgcttacaagaagaatacgccttagtaacaacttctactagcaaatatgcaaagaagcagctcaggaaaaatctcaattcttcagtgatctggccattagtcatagtaaaatcagggcgaagccaggatagatggtcaccggggtcactattaattaacgatcctaacaattggctatagcttctaataattttaagtctattgttgttgagtagttaccttttacatatcagggggtgtttagatctaggggtgtaaagttttagcgtgtcacatcggatattatatagggtatcacatggggtgatcgggcactaataaaaaaaactaattatataatccgtcagtaaacagcgagacgaatttattaagcctaattaatctgtcattagaaagtgtctaccgtagcacgacattatcaaatcatggagcaattaggcttaaaagattcgtcttacaaattagtcgcaatatgtgcaattagctaattttttagcctatatttaatacttcatgcaggtgttaaacgttcgatgtgatatggcgtaaattttttgtgtgggaactaaacagggcctcaattacaaccacatcattattgtactaggttacactatttgggaaaagaatataacaacctcttatatggtgaaaatcacctttgttatattcctgttaatagtgaaatttggtaattggcaaagacgtcatcggcttagaatcattatcggctgtagcatctcggaatcagtcgatgggagttatcaagtcgccaatagtcggattcctgctatattcggttaaggaaatcaatctactaaaggaagcttattcctaagtgaccgagtttaaagaggatgcggcatgacagtttatctattaattaggaatagtttgttagtttccttttatctttaggaaagtgtgtttagtgtccgataaggactttatattttccttttatctttaggttagtttctttcttgtctgacaaggacttgtatcaacccatgggtataaatatgtacacccggggtctatgtaatatatcctcacgatcaatacaattcggcgcatcgccaccttttaccttttctactttattttatcgtccggcgggacttggcacctgacgcagggctgcatcggtgttcgatctccggcgaaggggtaagtccaatgttccgttggcccaggcaattgtctcatctacgtcggcgtcgttcaaggctgcatcaggacattcgacctcttggattactctggtttagataatatatttgcttggctatttatcatatgtctatgttaatctagtcctagcatctcaatttagttctatcggctatctctcgctttagggtttctgccagtatcggttaaatcgccttactagattagattagcctaggcatctaccaccctgaaaatcagtcaacggcttaattgtctagatattgtgtttcttttcatacttagtgctacatcagttaagtttgatctactaagtcgtgcttagaaccataatttctagtctgcttcttgattgccaataagggtttcatcggggtttcagccgatgagttatctggacgttgcatcggcttacaaggactgcatacatattggatttagccgatcgcaataagatttaatttttaaatataatcttgtggattttatgacatcggacctccagccgatgtatgctttaactttcggatcgatgcttatttatcatatcattgctagccgattggtttatattggattgtattgttattttattacatcatcatcagccgtttgcctttatatcattatctacattggacatatagccgattgcttaaaccctatcgctatcggctggtatcggcatcggctattatcggctatcggctggaactactccataggcttgtcagccgatcggctgttttgatctaccatttacatatcttgtcagttgtaggatcaaactgactggcacgcccgcacctcattaatttttggacctgcacaggagctaagcagatctcccaggccggtgtgttcgattttttcgtcaacaattcccccaggctcatgcatcatgatcatgtaactgaacttgaaaaatcagacgtttatatttcaaaactctaatttcctcaaattcagacttgagagactaggttcaaccaaattgtgatgataatcaagaaataataataggattagttggctactggagcaattaatcctaaataagggccactttatgagcgccagtctaaaatgtatatgtatatctatgtagactgatatataatcacaattgctaactaattttctatttgctagctgataatggtatcgttccttgccaccagttgagctttaacgaaacaatcaccagggtctagtgttttctttgaccggggtcatagctgtaaaataaaaaggagtataagggactcagaagaaatcatcggggtctactgaccccaataacttgctatagcttcgcccctgactgtacaagcatctttattatgttaatgatggtgtaatctggtcagtaaaagcgattctgtgaattttgcctgctccagagtatgccaagtcaatgctaatctggcctgtacgtatcagataaccaggacacctctgcttgtccagtttggtcactgaaaccgtctgcgtcaagaacctaactttggtatgacatgtcgatccaattcggagttaacacagtaagtaaatagtaacatgtatgtacaattataaacgtgatcttttcttcacgagactacgagagacgaagacgatggcatattggaatgtccattctgccgcctgccgccgtggaatctgatgtccatggggccagggattgccagatttggatcgctaccgcctaccagtggttgcgacccatattggggtgggccgaaatggctgaacgttctgatacgggcctttcctcgatccaaaacgcgaagactatgggcctgaaaaggtccataacaactcgatgtgggcctccggtgctcaaggaaacggcccagcggtaacgaaatcagaggccattagttgttgggcctcaaagacctactgagaaaagaagcctactacactatctccagcctccagctctccttccgtcccttccgtctccgatggctgccgtcggagtcatcaactcgtcagatccctgactccatcttagagcaatgcaaatccactgttatactgcacctgcagtacgtgtcactgacatatgggtcccacctattccgggcccacatgtcaatggcacttactgcacatgcattacaggagaggatcccaactcaagtttaatagtatagcccactactagctccaattcatctatagccgatctaatagccaattcatacaatagttgcttactatattattaatatatggtctcacctgtcatacacacattgcgtcttgaagtccgtgctgcagctggctacagatctgtagcccgctgctcttctctctcatattttatcttattaaaaatatgtttatagctggtaaatagtctgctattgtacctgctcttagaaagcattgagttaggccatgtggactcatgatgctggaccccatttgtcagggtccctcaggagttgcgtcccctatagatctacggttgcctcatcatcctaggacctgccatggcgccccttcgacctcaccagtggcaagggaggaagggattgaaattattgccagattgtacttgtacaagatacaagaatttagtaggtagacgcattttaatgtaagaatttgaaaattgggcaaactggtacactaacgtccgaggcaagctaaaaaactgtaaatttgccaatcagaagactaccagacaatcgatttacttgatcattagcttcaaaaacagaatcgagacacatttggctctaatttagatgattctttttttggcaagactataatataatgcgttgacatattgaaatcacatagataattaaaagctcttgattttctacgacaatatttgaagaaactatggatcgggcgcccaaattttctccgacaaaatcggacgccctcctcttctccaatggatgcttgatgcctgtcttgtcgcatgcatgtttcctttgcctctgcatgcttatattttcaattaaaaaaaatctatagtgctatagctctcttcctccatgctctctccaagtaacttttcaactaaaccatttctctcttaaattacttatccaatttaaaatctaattacactattatatttattgcaactgaatctctggaacagaatctcaagtgattatattttagattaaaaatttatgattatactcctaattaaaacatatcatacatgcgacatggaattgtaaatgctgaaacataacgaaatgcatgctgaaacattcaaagaacactacatgcaatatgtgcaaatgaactagtgtcgctgaaacactctaagaacattacgtgcaacatttgcaaacaaactagtgaaacatctcaataactattatgcaacattaagcacggatccattgtaatccaaaaacttaaaatgcgcaacatggttgatttacaattgaaacattaacttctttcatgtgaaagtgaaacctcatatctaaacatggttgatttacaattgaaacattaacttctttcatgtgaaagtgaaacctcatatctaaacagttgaaacatgtatatttttatcatcagaatatagtcatgtcatattttgttataaaaatatagttacagtgactatatcatattatagatcgaataaataatttgaaagaaaaacataaaactagttatatgcataagagagactggagagagagaaagaagggaatcatgcagggagagaaggcggtgatcgacaaatcatttgatggtggttgtaggccggtggaatgaatcgtccgattttatcaccatcaagcgacccattctccgtcaactttcgggtgtactgttcaagagatggaaaaacattactccatgctcccatcgcatcaaatggcctacatgccggtgtcggcatggaaggcaattcagaaagagtttgtttaaaatctgaatttagatgctccgaaggtgattacgaatcagaaagcagcagattagcaatcagagcaacttaactagcatcacattgagcagcgtccacatccagcaatagcactcttggtacttgggtgtcatgggggcgatgtttccatggcccaattacaaatttacatggggagcttattgatcttgcagtgccggtaatctttgaacttcttggccttgtacttggccgggctcccgtcggtgacgagctgcgggtgcggcccgacgacgtgctccggcggcggctcgacgaacaccggccacgacatccgcgtcctgtccttgtccaccgtcgtccgatgcagcaccgccttgtacctcccgttgctcagaatctgtatcgcatcacatggcagctccatgcatgtcaggtgttcgacgcaatgcgcgggaggcgaagatgaggaggaagaagagagcttcgtacctcgatctggtcgccgatgtggatgatgagggcgtcggggacgtacttgacgtcgtaccagtggccatccttgaatacctggaggccctggacgtcgttggggacgaggacggtgaacgtgctcatgtcggtgtgcggcgcgacgccgagggttagctccggctccgggcacggcgggtagaagttgatcttatgcaggaacaccagctcgtcgccgccgaacgcctcccacatggcgccgccatccagtcccagcgccgtcgacaggtgctcgaacagcttccgcgccagccgctgcatgtgcttgcagtactcctcgttcgcctccctgccgcgcccggtcgccattagcttccgcttccggcgcgcatggcgagctatgtatggatggagacgcgtacctgtagccagccggatggctgggccagatgtcgtggttgaccatggccggcggcgcgacgttgtggaagaagaagtcggcccacgccttcttgccctcgaggtccttctgcagcttgctgccgtagccctccatcttgccggaggacgcgtccatggcgtaccgcgccttctcctcctgcggcagcgcgaagaactcgcgcccaacgcgctgcagctccgccaccgccgcggcgggcacgccgtggttcaccacctggaagagcccccactccgccgccgcctccgccacgcgcgcggcggactcgggcgccgccatgtcgatcaccgggatctccggcgcgtcgccgccgcggaacgtggtcgcccccggccgctcgtgctcggaacgcacgaactccggcggcagcgccgccagcgacgacgccagcgcctgcacgctctgcacctccgccattacaacccaacgacgacctctggtggtgctatcttccgagaaggaagcagcaaccgatgtgacaatggcgtctcagcaaacacacgcgtcggcaacgagacaagtggagctgagatttaaaggggcgactgcacttgccggtgatgaaatgatctgatgcacggcgacggggacggcaacgagaggacgagagggagactaggcggaaaacttgcctttttccgtttcgtccttcatttcgcacgcatcgcgcatgcaattcagttgcttgttcagatctcgtaaatagtaccaacgagtaacaatcgacgcaaatggcgtactttcatggcacacgataaactaacaaaggcatacacgtgcatatcccctcctttcttgcatatcaactaaataggtctcgtaaatagtaccaatgagtaccaatcgacgcgaatggcgtatttgcatggcacacgataaacttacaaaggcatacacatgcatatcccctcctttcgtgcatatcaactaaataattataattttttttaaaaaaattataagatatattaatatgtaatatatcactccacaaatgtttatggagtgatacatttcatattaatctgtgatggcaatttttttaaaaaaattttataactatttaaataacatgtatgtaacgagacaacatcttttggagggatgaaaatcccgtcccatatatgttgagttttataatccatttgaaatgagagatgtgggaaagtcaaaacatttacgaactcctttagaattttttgatcactgattcacttggtcaaccatttccaccaaccaggcagttcgatttcatcggcttcaacccaaaaagaaaaaaaaactcacttatccttccatttttcttgagaaaagcagatgggaaaacaggacaaaatttgtatagacctcacgaatgcacaaattaatccctctgtttacaaatcaaccaaaatgatcaatgcaaccgtataatctatctctaacaacacaatcttctcgccggtgtgcgccgccctatcttggaccggagagctgcgacgacgacatgtacgacggccacccgctcatcgtcgtcaccgtcgtcgtccccgaccttgtgtggtccccattggaacccgccatggcttgcttgatgccgccgccgctgccgcccgagccgtcggccggtccggcgaacccccggccgtagagccggaggaacccgagcgactgcacgcgtggctcccacagttccatggtgccctcgagcatgccggccaccatcgccatgctcggccgcagctgcgggtcctcgtggaggcagcagagccccacctttaccaccctctccacctcgccggcgaccaccttcccctgcagt

SEQ ID NO: 3551 - DNA, 10245 bp, Oryza sativa
accgatgacggcgatctccgtgcagaactcgcgcttgccctgcatcccgacgccttcgatcttcttcacggccacggcggagctgtcggggagctcgcctttgtacacggcgccgaacccgccggcgccgatcttgatgcggaagctgttggtcatgtcctcgatctcctcgtgcgtgaaccgggtcgggagtccagggatcacaatgtcgttgccgtcgtcgtcgttgccgtagacaaggtgcgccgagtcggacgccggcgagcggtggcgccggagctgcacgtccctggatcgcgaggcccgcctccccgcgcgccgctcttgcttgcgccacgacacgacgatgacggcgccgacgacgacgacgagcacgaacgcgacgatcgtcggcaggaggatggcgatgagcgtgctgttgttggaagatgaaccgctcggcgaccccggtgactgcgagctctggaccttgatgaaaccgaccatgtcgcctcgcctcgagttggcgttaaccagggagccgatctggtgctgcaccaagaagcaagacaaggacgactcgtcgtagaagtaaccgaggcaggagcagttgccggagcagagtgcttggcacgacgacccgttggagccgaccatgtctggccgtgagaacctattggcgtagtacgcgacaccattgccgagactgatgtacgaggtcggggcggcatcaccaccggcgccgccgcaggaggcgacggtcatcgccttggagccgtcggccggtgtgcagccaccgtcatgcgacgacgcgaacagcggcgggcacgtgcagctggaggcgttcccgttgggcgcgcagaacccgagcgcgccgcaggagagcggcaggtcgcacccgctgttcggcgcgacgaacccagcgtccgtcggcgacggcgacgtggcgttcgccgaagcgtagcttgtgatgaccagcttcccttccacgcccagcttgacgatacgcagcttggcgtccggcaaggggagctggatgaggacggtgtcgtccgcggcgagaaggtacaggccggtgccgttcaccgccatagacgccacggcgccgtcgcgatctctggtggatttgacgtcgatggacaggagccagtacagtgacccgttccatgtcagcgccgcatcggccgccgtcacgtcgagccggtagccgcccaccgtgtagtccgagtccgacacggccgacgccaagaagcccccgacggggagccgctgcggcgacacgagcacgtcggtgggccggtcgaacgactgccagagcgtgcggttcctcccatcgagcagcgcgaggttgccggattcgtcgagccggagcgccgccacgggggacgcgaacgccggcgtcgaccacacgacggtcccgttgggatcctcggcgaagatccccctcgccgtgagccgcagcggcgcggcgcggtcggtgatgggcgcgtcgcggttggcgacccagacgcaggtcttggacggcgcgtgcaccacggcgaggtagtaccggtcctgctgccccgccgggttgtacacgacggcctggaacgcgccgccgccgccggactggaggaacacgccgtaggtgtcaatgaacagcaggtacgacgccacgaagtccggcacgaccacctccgtggcgatcttcccggcgcggacggcggcgccgacaaggacggcggcgaggagagggagcagcggatgccgccgcatcgacggtggcgagcacatgggacggcggcgggggaggggtcatctcatggggaaggcgggagcggcaggcggcgtgacgcgatggcattgcgattgcggggtgggtgggtttgtgccgcgagagggggttgactcgggtggcgccattggccgcgctgggatctgcgtgtgcaagagacgaagaaaaaaaataataatgcggcgagacgacgactcgcgagtgcagcgtgcggttagagagttggtgtcgctgccgcctgtttttcaaaaaaaaaatttaagtgtacggatacacatttaaaatattaaacattgactaataataaaataaattacagatttcgtctgtcaactacgagacgaatctattaagcctaattaatttatcattagtaaatgtttactgtagcactacattgttaaatcatggcgtaattaagctcaaaagattcgtctcgcaatttacatgcaaattgtgcaattagttttttttgtctatatctagggctggtttggtttgtggcctaaattggccttaccaatttttgtcaatgtcaaattttggtaacttttggcatggctaattttggcaaaggaaaaattgtgtttggattgaagccaaaatagcctaaattaacggttgaaatggcctattttcttaggcatgtcaaaatttagctccacaccaaatagacaataaacactattgaaattgctaaatattggtaaggccaatataggcctcaaaacaaaccaacccctaatgctacatgcatattgtgaccgaatttttggaagttcgaagggaaagccttgattctttgtgcgagccaacggcggcgtttgaacgtggcgatccatcgaatcggctgccggcaacgcggggagcggttcgattcgaagcaatcatattatttttttcatatgcatgtctactggccagccagtgtgttggttatctttgctgattagttaagagtttggtggatattttagacttaggaggagtagtattattagtacatgatcacatattttatggtgattataaggtggaatcaatcctgggtcctgacaaaatagatcacaagcagtgaggagagctagcgtcttttgaaaggggggataaaccaaaatatatgaagggttggtcatatgaacctgaccctttttgtgggcaggttacagtggtatagatcgagagaactgcacgatcaacatcatcatcgtcatcagtacgcctgtacttcgtctaagagcaagtttaatagtatagcccactactagctccaatttatttatagctaattcatacaatagttgcttactatactattaatatagtcccacctatcatacacatattgcgtcttggagtccactgctcttctctctcatcttttatctcattaaaatatgtttacagctgactaatagtctgctattgtacctgctctaactctagttaacaaatgtatctcttgttcagggaggtacttaactacaaattatatggttgtccgttggaggctaggcaaggtaggggcaccatgctgatctccatttatttctctgttgtttactcgtctctggaatgagtgtgcgagagcttgtttaacgtggtgtgatacgtgaagacgtcacgcgtgatgtacgcggcgtcgcggccgaccggccggccagccggagcacgacggcagcagcttccttctccggcgccgctcgctgtagcgtagtgcttgcgtggagatcggcacatgatccgcagctcatcacatgcgtgcagatttggttgattagttagcaaccaacgtgcaggcgtgcaagtggacgtgataggaaaaccgcacttggttttaaacccggctgatttactttcttaatcatgagcacaaacaaatcacatggcatcgctcagataagcaatttttttttctcctgtaactgaggcttctcaaggcatcatctatgatcagaagcagtattaatactccctccttcccaaattgataatcatataataaaatttaaaatttcttaaattgatcatcatataatcgcatgaacacgaattttatcaaaatacaattaatacagcataggagaatatgtgcatgctaagagaaagtttaatagtatagccaactactggctccaaattatctatagctaatctaatagcacatttatacaatagttaactataaaaatatactacaccactaatacccggtcccacctcttatacacatataacgtcttggagtacgtgttgcagccggctacaaatctatagcccactttcttttctctgttctcttttcttctcgatatgtaggaaaatgtgtgtatggtgtcttaattgatgtgatttaaattatcattggtcttggtgcataaacatttatgatgattattttgagaaagtgagagtaacacatatgatctaaacaacgacctcatccagaatgtcgatgtacaatcaaccggcaagttgctgttaactagacattgagcttgtacactcaaaccgtcaatttgatgttaagtagtagacatgtttcgatgcaattgtttttcgccgagtttgaagcaagttgcaattgttttccgaatcaacttgatgcatgcatcaagattttgtacatatcctattgccagtttgatagctgcacgttccttctgcagcaggttatgattatggatgcataataacatgctatacatcccaggtatgtattgtacatttgtacggcagcatcgctgagcacggacaattctggacgaagatcgtctgcttatacatgatgtagccgtagaaaacctgattgtcaatacgccacttgcatgactttcaccagggaaatacaaaaaccgctttaacgccgcaacactgcacatacgaaagtcaactagcgctggatgtcaagatcaatcaaaggtttaggtcaagcagcaaccgcgaaacaaagaagagaaactgtgtggcctgcattggacaagagacttcagagggctttgccgccgagatcaagaggattttagtatggcatgttccattttgcccccgatgcaaacagtggtcagattagaaagacagttgcaaaacgaaaatcctgaaggctaagaaaggaaatagaatgaagttctgccacctggtcaaaataagcacatcaagctacggcagccgacttggcagaaaaatgcctttagagtttagattcaactggtgtttagataccaacctcgggtgtgttcggacctctcccaacctaaatccctccttttccgcaaactgctaaacggtgcgtttttttttaaaaaaaagtttctatataaaagttgcttaaaaaaatcaaattaatctatttttttttaaaaaaaatagctaatacttaattaatcatgtgctaatggaatgctccgttttccgtgtggaggcattatgttcccatcatccacatgcgaacacagccctcgtgtagaaatgaaacaccaccgaaagcaagagattcctggtattgacagtttcacacacatatatctgacttgcaacaaaaaaaatagggtagcattgattcaaggtatgtatgcttttaaggaacacaaagatgtgagtattcctcagtacaggtgatgccaaaacctgagctctaacagccttgctgtccaaaaatttattatgtatcaagcatcaaactttcccgggggcaaaaaagacctacttcacctgattaatgagttcctctcatcaaaaggatgacacaagaatcatccactaaaattaagatttaggtgctaaactcaagtaattgatacaattccagccacaacaaagatggatcttcaggaatacatcgccattatctctgcataagaatcaagcactggcttgcaatgctttctctgctgcaccgggcgcgggcgtaacaccaccggttgttggactgaaaatatataaatgggccataagtccttgattcctcaaaagccttttaatgttctaacaattaaattaattagcaagcaaaaggaatacttacagtccaaccatgactttaaaagcatcataaataccccattgagcaccagtaagagttccaatcataacaatacgaaggggcagtcctctagtgaaaaggccccaaagaccaagctttttaacagcctgtgataatacaacaaacatgtacattcaattaacatgataagaacatgaatagaatacatgagacttgattccatatatatgcaggactttcgccatatgtatgaaacttgattccatatagaacttggtatatggtggtcctgtcgagcttagtacataaatatatcggatatcccatatttattaggatactgacagctcatttaaccacacaagttcatcatcattactggcagactatttttaataatccgcctatagaaataaacctctcttgtgctataacttttctagtgtttacgaagatttgatgggagcagttatgtaacattaactacaactttgatggactctgatgaaaggaacatacagaaatgcaactttcatatgcagtcaaccaacatgaaagtaacatcaagataagaaataaaacttgcacataatgggttttattagtagaagacatgcttacatcacccactgtagctcccttggcgttgttcaagaaagagaccaagttgtcagctggatgagagacaatggcacagaagactccagcaatgtaaccaccagcgaaactgatacccaattggaaagacttgctgcactcagacttcggaacaggaacagcgtgcttgtagatcatttcaacaatggtctcaaaggaggcaaacttcatcatagtatctggacacgatggaaatattcaatggatgcatagaagaaataacatgacagcatagctctcataaaaataaacaaacaaaaactcattggtgccatgccacactgtgttcaaatccccgtacgcataaatttatcacataatagttacatagctgttacattgacagctactgttaatccatacacagttgatggttcatactttagagtgttcaataaatattcatatatatataaatgttaacaaaagctaactgaggatagccaatctgcggaactacacatatagcagaaactacaaaacactttagtagtagtaaacttccgcctaaactgataactacattatccaaaacagaacagttaatttaaggaaatttgaaacggagttctctaccaacagaaaatagtaacagatgtgaagggtttatttttgtgttgtttcaggaaatagccagtgtttaggggtggacacaggacaacccatgggtaatctgaccaaccctagttcaactaaatgaattaaatttcaaccatgaataagtaaacagaacttaagtgaataaaccatataaactatgaaaaaaaatattgacaataaaaaaaagaaaagtgaataatatcagcatgagccatggaggcaatagaagttcacttgtacagaaaattcagttgacaagttagcaagttatgaagcagtgttggatattgcaactatcaaagaaaaacaagatagtgcagaattatcacacaagcaagtcctggaacatcaggttttagtgccagtctcgtgtagcagttacataaatgaaaacattaaaaataatatcaatgtagcaaagtgactaatacttacaagggatttggcgaccccacagaggaacaattcccttgtaaagcctgtcattatcaaggaatgagatttgtcaaggcgcataaaactagagaaagagttgccacatatcagattctaagataaaaacatgttatttatacttacccaagagcgccttcagatctgacgaacttggggagcccatcactcagtccacgagcgaatccaggttgggtttgcacacgaaccttcacagcttcaaatgggcagagagccacatctgcaatcacctcagcagaagctgatccagcgaggtaaattagggtcttgtacttctgagcatactcaggcccagcaatatctgagtagtacttcttaaagaactcataaaacccaaacttgcatgcgccctgagcactgtaaccaagcaaggtaggcacccatcccctgaagaagcctctaggtccttgctcctttaagaggacgccaaacccagatgttatgctcttgtattttgctggatcaatctgaaaaaaatcaaccaaaacttgtcagtccaaaatccataatagaaacatttcaattacaacttaaaacaaacattgactggacatcgcacattcaccgatcattttacctgcctacccaaccatctcaaagaatcaaactacattccaataaacaaagtagagaccggcaaaagggagatgcaccaatcgacttatcaaagtgagaaacataaagtattatcaaagtgagaaatataaagtatcttcaccaaaagatacacaagcattttgctccacgacactaacactaacaaaaagcttggaacttaacagtagataaatataattgctggtagcggaataatttgcaaccaagtaaagaagaaggattagtagtgtaacttaaataagagggcaggtgaatcaactctccagtttctacatacgccagttcaactgcagaaacactagtactgaacatgtttaacatcgatagctactctagtatctactcctcatcaatccctacgccaactaaataatgagaagcaagcacattggaaccgacgaagaacattgacgggacaaataaaaactacagattttaacgacagtcaaagctgtatgcacagcaaagcgcgcgcggctggatttacgcaaacggatggcgacatgcctagattcctagatggatatcacaagttcgcaaccacacgttcctctaaccatcgaacaaaactaaatatcaccagatctacgaaggagcagggctcccagaagcgccaaagccagcagggtcacagatccaggcgttcccccaactcacctgcatgttgcacttgacgaggtcgagcggcgtgacggccatgtgggtgagcccgcagctggcgatcccaccggcagtgcaggcggcgtagaacgccggcgagtacatctcgatcttctccctgggagcctggatcgagatgggcgcgccgcccccgacggcacccggagccggggaagctggggacaccggggaggggaagcgggtggcgccggtggcgaaggacctctcggcggaggaggtgtagagaaagctcgggaggagcgactcgcgggagcggtcggagagcgccatcgcagacgccgccgacgacgagagatccgggatggggtttggtctccctctctctctctctcgcgctggctctgtgctggtggtggtgctttccgagagctctcgcgttcgcgtggaattgacgaggcggcggagggtgaatatgaaggggggcggcgaggcgagatgggcttccaagttgttagggcatcgatcttttgggaggtggagatgaaccggagggtcgctgcgtgtggggcccgttaatatgtgggcccgatgtgtcagcgtctgttggggttgttgttggtgcctggaatctgggctgtggagggactactttatggctagagaatggtagcggtgccaaaattttctcgtgtattgtacactcttttgaatacgatcaagcactacctcttatttttttcttagtcatctcctttttgttatgagaaataattattggccaagagctacccagcagttcctttttttgggggtcaagagctactattttcgatatgaaaataccgaccaattaatacgtcgactttatatttggctgaaaggtttatgagactctacgagtactgtaaagtcatggactcatggtaggagtatatttctccgagcagatgcctcgcgtcgtcgtcggcggcggcgaccagttcatagcgtaacgttcacaacgactggcggagacagtggcaagaatatgcaggtgaatattcgtgaccggcacgggcagcattattccgcccgcccatccgctccacccgacgggacgggaccagtcaccagcctgacctctttgggcccgacagcattccaggtccacggttattcgaatcctgcctgattctctccagaataggcccacattcacatgccgatcctatgggccttgctgcccgcatggcccaaccgacacagttacttcccgcgagcgccaatgtcctcctcttcctcctggccggcaagcaagccgcgcgcttttgcaccacgcacaagtcacccgcgcccaacactgcacgcgcccttctcatactacgtacgccgtcgcctcaccacgccacacgccgccgcgaccgcggaatcgctttcgtccacctcgcaaagccatcccttcccacccgtgcactcgcttaatttccccgcgcgcgcgccgacccaatctgatgaactactgcggagacacgatcaaccg

SEQ ID NO: 3552 - DNA, 5907 bp, Oryza sativa
  unsure (1)..(5907): unsure at all n locations
gaagcttccttccgccagccggtaatgacatgacggccctccagtcttttgttctcgtcgctacttgcgttttcttcttctccttccttacttgaagtcttgaacctccgaccaaacactcaaaaggcaacagccactcttgatctcatctgccactcttcccatgagatcatacatgattatgtacaatgaatctactatggaagaacaaaagggggaaaagggcttccgggaattggcttcacttgctgatttgattgattttatgctattgttttgaagtttttgctgttcttcaattctcatttcagcattctacgcttggtggcgctctctgtttcttttctaaatttgaagatcatcgccaaatagcaatcaaagagaaatacctgtttgatcagttaagtaacctgatagctaccattcttctctttttgttactacctgattagtaaagttgctctgattaactaatgttttgttggcaatggcaggtagaatgtgtaacgaccatggaaatttccgaaagttggtgacaatgatggatggctgaagaacatctgctgtaaaagttgaccatgtaaatgatagacatggcagtgcagaatgttcctatttgagcagacaatgaaattatgtaatgctcaatgcaacgttttaaagtttatcaaacacggagaataaatttaaccggtgttttccaacgcttgtccgttcaacggtgtttttcatttagagagcttataagagatctaattttacctcaactgacaaggttgatctctcaaccttcttgaaaaattgagcaaacatgaagtagacaacaggtcaaaggaaagcataatttataatttgatcgattttacactaaatgtcatacaaaattcactgaatcgacttatgtccattgtattaaaagaaacaatttacttccgagaagcctgtccttttaaacctgaattgagcatagtctcgaagccagcctcaaatccagcggtgtatgctgcattcttcagactcgtctgcagtgaaacacagccgcgtccgttacatgcttcacaacttaacgaggtagaaatttattgaagttcaaactgaagtacatcaccacaccaaactccaaacgtgggcagtttgatgcctgattttaccacaacgaaagtttcttatgaaggccttcacaaagaaattgtgacttgcaacatttacttaggcccatggctttttttttttgtttggttaatttttaccacagatgcttgttcgacacatattagtggaagctagggtatttaccacggttgcctatcatgaacacaaatgagcaatcagtgctaacatatagcagaagagaactaaccgttacactctccaaatcaatagtggcttgttctttaaagccatcaaatatagaagaaagttcttcctgcttaacattcagtttctttgatacctgcaaaagaaatttatcaacaaaaagagtggacattattcatgagggtcatcatgcacaatcttattacctcagaaaggaacaacggggacatgatgtcaaatacatcatttacaaatttctcaacattagctccgtttgtaggtatcttgctctgcgtcttttctgcacccttgttctgaactttaggcttagccttcacttctgatacaagaacaaagtatgccatgtctggttattgtaacttgaaagtgtaataaaaaaaaacacaagaaaaatgtaaaagaaatggaggttaatgagtaaaagacaacatgaacaagttcacatgtttcatcctcacactgtcatctattcctgcttgtttaattaacaatagttgttataatacagtagtacctccttatagtagcactactactacgctcatgtactgcccaaatgtaaggactatagattgcatatacagaagaaataacaagggacaatatatatatcagtagataacagcttaccaggaagacatgttttctctttgggcacatcattttgacgaggaacatttgtaggtgtgaccttctcaattggttctgcagaatttgggacacctgatggtacaaaatctgctagatcaggaggattatccttgcctacaactggtgaagcctgcacaaaaccaataatttcacaatcccttcccagcacatactccctccatcccaaaaatataaggcacccttatttctaggaaaaatcaatattggtaacttttaactaataattaagctaataatatctatgtttagtgttacgcattcataacatttagacttgtgtatgaaagtactttcatatgatactaattttgtagttgttaataacattatggaagaaattaatgatcaaagtatgatattgagggccttataatttgggacggaaggaccgaatgaaatcatatgcacatattccggtgatccaaagattacctctaagtctacataagctggttgcctcccaatggacatgagaaacttgttcagattgcttgagctgagagctgaaatggagtaaatcaggaaaagaaagccattttactaatctattcttcttttgaaaaaggtaaagaaagttgaacggaggtctccctccttataaaaataatataacagtagccagaccaaggccttgtgcaacctacatgaaactgtgccatgataactaactaacggaatggtgtgcattctagtatcacagtaatgactaactaatgacattacacatggtgtgatgaaacagtgttggttacggaagtgatgatagtatcaaccataccgattgtcacatcatttgtcagtggatggaagtagcagctctgttttgacttgaaaccttggtccagtagtagtgagacagcactgcttgcaaatacacagttatatgaatcagttaaaaaggcaatagcataaccatgaaaaaaactgatatataagtataatataataggacacattaaaagctaagcattataaaacaagaggcatgtggttccatcagtcacaaccatagcatttgcatttctaatttctatcctaaaagtggaaaccatcaagtggaatgaaaacaacgacgctcggatataaaatgagcacatcacactagtaaatagctcttcaccgtttaaggtaaagtgaacagagctcacaaagtttttttttttcaagtttaaaggcttcaagctattagaaatacaaattccacaacaatggaccgaattcccattccaatcatatttaattaacatgtgaaagcaagcacccataccttgcagactcattaagtagtgcaaatggagtaacacagcctaagggtacctggacataatcaaggacaaaatacattaacatgtgaagaaaattatatagggtgaaactataacaataagctatccagctaaaatgctggtagagccaggaagcaccaaaattcaagtactcattaaagatgaaacagaaaaagggcaagacaatacatgaagggatatttgttttttcacaaccaacaatattcatcacaggcagaattttttttttaacttttgtgaaattttcacgtaatatatgaaactgaaagatgcactatatttcgctcttcgttgctttcaaacagtatgcagttttagataaacatgaataatggctgacctgaagcacttcaagcaaattttcctcaggagccatccgcagaccaccttttcccaaaccaagacgctgtgataaaactaatgggtttaaggaaaacagaaaattagttggcatacattcaaataagtaacaaagaggatatagttttcaagaaatgcacctacttttcatgtcaactttggtgccagcaagggcagaaacaacgtacagcctatgctttttgtcctgaaactcagaatttaaaaatatcaatacatgaaaataggttccaagaaattaactgtccatcacttggtaagacacataccttcagtagcaaatttttactcaaagcacctcctaaatgcccaacatgtttggcctaacattgcggaagttcaattagcacttacagtaaatccatcaaaagtattgtagaacgaagtgtgaacttcacggtttgcaaacctgttcctccaccgtcaacacaaccgggtgatcgtagcacgagaattcaatgttgagctcctgcacaagacaataccactaaattgagtcgcggtccactgtgatgccagaaggcaagcaattctagtttgccacacataggatgtgacaattctcgataatcgcacaatataactgggcaattccggccttcgattcatgcgcacatccggggttaaaaaaaaaaaaaaaaactatccgcagcacaacccaactaaattcggcagcaaaaacgccctatcgcgcttccatttataactatgctaaccaaaaccaaatcaagctagaacggaacgggaagcatctcgccgacgctacaatccgtagcaccggcgcatccacgaccaccaatccagccgatccccactaccaggaaacgacgcaaagcgaacagtcgaggagttgggaggtagagagcagtggcgcccagtgggcggcggcggcggcaccaacctggagtcgcgcgaggagctgctccttggtgtaccccatggccctcgcggcggcggcggcggcggcggaaggaaggaaggagacgagtagggcaaaggcgaggctgtctcggcctctcgggttcggatgcgaggctgctatggacgaggtggatcgggcattcgggcggctggacgacgcgcctttaacgggtcgggctcgtttcctcagatccgaactcgcattaccccgcgaaatgcggattcgggctcgagcgtgacgagaccgatacgtgcctcctctcgtttttaccctctctttttttttttgagatttggccggtcgctttcttctccgacggacactgcgattaatctaagcggcgcgccatgatccgctacgaaatccagctgttttacatgatagggaaaggaaattctctgttgcttttgaccacagctcacaacgcccatacccttttcttgcaaacatatacagatgcatactgcagttgatacgtgacagtataaaaataaatattgaccgcatcagctcgattagtaaataaaacgttttggatttgacaattagagaagcgggacaagtgtagcattttcagcagaggacggcgatggatcaaagctgggtactgaaatacgacagacgcatacgactgacaagggccccacagacacacgcacagaagttaatttaatttcagtcgtaaggatcccggaaattctgcgtcgactagataccaatcatgccataactgcactagtaaaaaggaccattatgctttggacataagttgagaggagtataattaacatcatagtaattgattatacttcattacttgcaattgcaggaacaccacttttacacatggtatgacatggaattgaggggagttttgctccatggaaagctgccttaaaacatgtagcttcatcagagctcccacgcaattcagaattagcctaaaataatcaagaagcagtagcactagtacattgattaagtatatactacatatatatatgtagataatagttatgaattgaatgattatatgattattattgtaccgtggccaattcttggtcacgtactgatatatcagtcagtaattgaatttgcgcttaatggtgatcactggagagtgtggaggcttcgatcgatcgatcacctccatggatttggtctccatcgatctccggttcgatcgatcagttgagggaggagaagctccagaggctgatctcaccttcgtcctcccactcncnncnnnngngtnnngncnnctccgaaccttgggcattacatttn

SEQ ID NO: 3553 - DNA, 16659 bp, Oryza sativa
  unsure (1)..(16659): unsure at all n locations
ctgcagtcgtcgcgccaccgcgccgccgctgtcgtgccgccgcgccgtcgccccgaagccgctgcgccttgcgccgccgtcaccgtcgtcgccgccaccgccgccgccggtgagccatctcccctccttcacctcgcgcccaccgccgtcgccacccggggaagcaaagagccgagagagagagagggaaaccgagggagggaaaggataaggaaggaggagagaaaccgggagggagagagagaaggaaaaaaaaagaaaaaaaaagaaaagagaggccggcagataagagaaaaaggagagaaaaagaaagagagggagagaaaagagagaaaaagaaaaagaggagagaaaaagagggaaaatagaaaagaagaaaaggagaaaatagaaggggaatcgggggagaaattaagaggatttaggaaataaaaaaatggtcggggttaatcatagattatttttggaaattcctcgagcgtaatagtatttcggtcgaaattccgagttaattataaaaatatgtttattgaacagattagattaaaattggtagtaatttagatataattagtagctaaacaattagatgaattcttatagattattatagattatttttggtaatctctataagtcatcggttcacggtagaaattcggatttaattactaggaatcttatccgtgtattatatttaatcatttagtcatagactaaattaaattgtataatatttctaggatttcgtccgatatttagctcgtaatagaaatttctaacctattatatggatataatgctcggggagagtaaattaaaaacttatgacaacgaaataattatacccgcaaaatagtttaaatcgaaattgggtttgccgtagttcgcagatagtaaagttaataaaaaggaatcgactttcgcattcgactttcatttggattcatttggatttttatttgaattctaaccgaattcaaatcaattcttgcacgtaactatagagcccgagggagttgcggatccaagcgaaggccaagacccgcaagactttgagcaaggcaagtcatcactattccttgaacatgttgatcctaattgcgaaattgttttgtttacaaataaagttgcatgcaatgatgaacatcctacttgtgattatgccatgccttggttattgtttacccttaaatctttgtaaccatgtttacgtatgagtccctagtcaactatgacaaatgcttagaaatgctattctagaatcatgcatactcatatttgtcaaatgctatatgcttgggcaattatctttgggaaggtaattgagatgcggcatgtggagacatgagcgccacattgccatgatattgaggacatgatttgtgaaaggagaaataaactaaataactgttttcgactggggcggacggaggatttgggtggtatctggaaaaggctagtaccgtccccggtcaattaaggaccgagccatgaagttaagcatgaaacgaccctcgtacaaccgcacttctcatatgggtatagacctagcggagtagatagccgagcggaggcagtatccctgcatagatggttcacccctgagtgaggcaggtgcgctacggtgggacagccattgaggtagggccgagaggcatgccctacatcggtgtcgccattggtaggactgccatgagtgtgtgtgagagagaacttaacttgagccataatttaatgtgtgtgagacttctctttcccgggagcgccagaactcctctcactgctagaaacatggacgcctagagtgcatgaggatttaagttcatggagcgggtactgccaatgcgaggttatcaaaaggctttgccgtggcgcgtctcatgtgttgggacgaggctcatgtgttgggcagtcgcggagtgcgggtaaagtgtacatccactgcagtgtgagtaaaccaaatctatttgaatagccgtgttcgcggttattgagcaccgggacatgtattacacttggctagactctaaattctttaacttgtgtggaatgggatattgcatgatgatttttatgctgatggagccacttcctgagaggcgggaatgtggacgtcctcagaaaaccataacgactcaatgacgggaagctatcattgggatcacaatgggtggtggacagaaccgtcattgtttaatatgaacactggtattaaaaacttgatcactctatgctaggtcttaggcttgtgaaaagaattacaaaacttgctttgcgcaaaagaaccatagccatcctttgaattcctctgtcatgtgcatcattgctgtgatggcctgctgagtacggttggtactcacccttgcaaatataaaattaaccagaagcgggagatgaagcctcggaggatccctatgcctattaccaggagggagatgaagacgatggtgctcagtaggtcttagtacggtcgttgcctgtggcaatggcattccgctgccttatctatttctgcttttggatatattccggaccgctcggtccgatgatttaagactatgcctgcgggcttatgatgtaataattcgtattagacactcgtgtatgtgcacttggtacttcagctatgaattcgtgtgtaccagactacttgatccagggaaatagtactgtttacatgattgattcctgttataaaaacgggggtccacgtgtcaccatctcaccgaatggtggtgcggtcaaatccttgccacatgaacttttcttgcgtgtcctccttatccagctgcatggagccaccaaatggttaaatttgtaaataatagtccccccgtccttaaatatttaatgttgttgacttttttaaacatatttgatcattcatcttatttaaatttttttaatgaaatatgtaaaactctatgtaatacataaaaatatatttaataatgaatcaaatgataggaaaagaattaataattacttaagttttttatataagatgaacggtcaaacatgtttaaaatagtcaacggcgtcatatatttaagtacggatggagtatttctacatgtcaatcttactttagtttttagaaaaagttggatatttctaaatgtctccggtacacgtgtttggccattattttcttataagtactctacactgtactaccttattttcccactcagtaatactatttttctattaacggaaagaacttttgggctttgccccttcatactaatttaaatcttagtgattagaattggacttattttaagataaagatagtggagtagtatatattgtaaaaaagctaaattgcatccatgatacaggaatttgacttgtgggtgcgatttagcgatcaagtttatagaaaaattttgtaacatatgcagcccaaactagtttcattttatatgacattaaatatattttgataatatatttatttgggttgaaaatattgctatttttttataaatgtggtcaaatataaaaatgtttaactaataaaagttaaagcgacttataatatgaaatggaggttaggaggtaaatttagctatattttgaaatgggatgtagtcaaaattttcgaaagttggtattaggaagacaaacagagaagaaatggaaggagtgttgaaccatgtggtactattcacatgagagggattgccgacatggtcagcaaagtagtcacttctcataataagatctttaggagcacagtacgatccactactccgtaagcttcattttcatcggtcaatgccccttttgatttggaggaaaaacatagaaattttagaggatttcaattctataagaaaattttctatgaagctctttgaaacaaaggattgaatcatatccaatcttttgaaattcctatgtaatggacaatcctatagagattttggaggaaatttagcaagagcttcaacctcttgctaactttcctttgagtctatctctctcatcccattcctgtgtttttcctgtggttcaatcaaacggtcattcctgtgtttttcctacgttttgcaatcctctgttttacactcacattcctatcaaaatcctacgttttttctattcccacgttttctcaatcctgcgattcaaaggggccctaagagttgatagtgtacatctttaacaagtagcaactgtttatacaccggccacatgacgatttttttaagagcagtcaacacaagagaatctatcagtgtgaaaagttcataatatccacgcttattctccagtgtaaaaaacagtcattaattactccgatctgttcccatcatcccatgacggtgggagaaataaattatgaagataacatcattagctggacttacatcccaatcaaagtgttaggtctgttagtacatcgtaggctccggcgaactgaacgctaacaagatgtcaaagacgttttttttctaatgttgaatggagatgtcaaaagaccatttttttaatgttgaatggagacgtcaaagacgttgaccttgacaagcccaatatagaactcccaaactggagaaagtcatacccccagtggcacaagtagatcgatcgaaaaacatgtggatgagttgatctcttctacgaatggctgaagccggtcacctaccatgccagcgaaaaggcaaattttctacccctcaccgtcgtcgtctcgtggacgtaggtgttcagaaaaggatactactacatcaactcgcttgcaaatgttgtggtctcgtccatgcgttgctgtcaggtcggcccgtggtcctcatttgggcaagtcggctcggagacaacatagtaaattgcatctccgtcatgtgcagtatggatgtggcaattgccgatacttggaaaggttgatgtgaacctcatttctgaggctgcgtctctccccgcagaaatgagaggttcacttcctcttttgttgtactttctcagtttataaatatttcatataattaatttttttaataaacacattataaacataaatgttcataacacgcacgcatacacaccctacctctttaaacaccttcggaaaactaggttgatatatattgagattaacgaaatcaccacagctatctcatcgtcaatgggtacgtctaccacttaaagaaattagtcgtaaatacgagagcacctatatcaaggctaggatgtgaaccctagatgagttggttccaccaaatcaacctaactaatttgagctatactcacttcgcgatataattaattttgattataaaatttagttatttgttatatttaaaagcttaatttaaatataaaaaataagttatgcttgaagtacctttaacaataaacatgccatggtaaaagaatggtaattatatatataatttttgaaaaataagacaagtgatcaagcttaaacttcatagttaaaatcagttgcgtcaaatatttatgaccctattcttagggttttgtcttaactaatataatataggactaaaatgctcccgagaaaatatcacttacatgggaacatattctgcacacaagtcttctcgtgtacacaccctgcatacaactaaaaaatatcaaaaaaaatcttaaaaaataatagtactattacatatatatgtaaagtcccatattcaaaattattatatataaagagcaacaaaaaagataaaattatgacatatttacactctcaaaacagtcagaatttttttcttttttgttgtggctaaaatataacgaatttgaggttaaaactttacacataagtgtaacattattgaaagtacttctatattttttttttctgaaatttgctacttgatgtgtatagtgtgtatacgaaagttgtatgtataggatatgtttcccacttacatataatgaaccaaagactatgatgtaacttcctgttacgcatgaataaaaagaaccctcaataggcaaatgaggtcgggctctctcccccaactaatccatccactaaactgctcatactcactttcatcttctcctccccggcgtgtttaagcttgggttccctctaatggaggagagatcccttgccatgtccttactatacatgttggattttgttccaacaattatattgtttaaataagaatggacaatgtactttgtagtgacaacagagtgaggttgagagattaactatgcatgaacgcaaaacatgattgcatctataactataaaggggttgatagatgcagatatagttcaatgtagggcttcaatagcattaagcccatgggacatggaatttttttgtaagttgcccaaagtccaattaatggggtcccttgaaaaaaagtactatcaatcgggctgatggaaatgatggagtagtactttgttcagtcatgtgcacagctaaaatcacaaaatttgcttgtttgggcaacgtacgtcagaaacagtatgatcatcttgatgttacaaggccggattgcatgtgtgcaagcatgtactatataagataatgaaacaaccaagctagtaatagtaaagactgctattgaaatattgaagatatacacctggttttagtctaacacatctatgtcatatatacaaggagacacgttaatatcacacattaattgaacacctgcaaattttggagatgatcaataaaatgatcagtacacttcgactgtatatatcacggcaaaccctgcaatgaacttgagtcaggcttcatgaattcatcaggcttggcactggcagaagcattgctgttgctccagcgactaagctatggcaaaataatttattacctgaaattataaaaaaaagtgatataaatacaatacagatattttgttaattatacctgttgtaagctgatttagattaattgattaattcctgacatatgtggatatgcccgccgtgattgttgtacggaggattctagcatactcctcccattacataaaaccccaatctgaaatagtaattttaacaatttaacccttttaaaaaacttattttggtattgaatcgtgccaaaaactaaaaaaactaatttttggcatgcttcaatctttaaataagttttctaaaagaatcaaattgtcaaaattacataaaataaaatgtgatatttcctctatccaaaaaaagctactcctagtaaacaaatagaattctttatctagattcgttttactttttgaaccgagagagtattttataatataattaatctggacagatatggtagaaaatattatatcttattttaggttgttttttacgagaggggaagaagaagaagttggttagtacgtgcagaacacattcaaagggcctcctgtacaagaaagcttttgcagttgtgcaacgaaagatcgacgccttttgactcataaaggacataaagaacgatgaaggttgcaaccgcacggaacggaaataagctgatcagccgatcatttattactctagtactagtagtgttttttttttcttggaatacaaacaactcaattaaagagtctgtttagttcgcgaaaagaaaaattttaagtgtcatatcggatatttgatcggatgtcggaaaatgttttcggacacgaatgaaaaaattaatttcataacttgactggaaaccacgagatgaatcttttgagcctaattaatccgttattaatacatgtcggttaccgtagccatttattgctaatcatggactaattaggctcaaaagttttgtctcgggatttccgctataactgtataattatttttttaatctatatttaatgcttcatgcatgtgtctaaaattcgatgtaacgtttttggggaaaaaaattagaaactaaaccaggccaaaatctggatgaaaccatggttgagcagttcgcctggatttttttcttttttagatcaaagcctcaaaggcacaaaggccaggtggccctgcttttcttgaacgcagatatgtggtgcctgtctctgtcctgctcggggcgcttctctgtttcgaccggaaagttcaacgtgcctcacgggtcaccatagacttgtagccaaggccaagctgttccattcacaaaatttatcatcttcaatactctgtcatctgcctcgacagacgcaccacatcctgtgttcaggaattgatgtgctactgccatgcaaagtgccgcgttaaatttgccgaatcataaaagttgttgagattatagacatataatgatttaatctattccataaataaatcatgacattacagataaaaactagcatgaacgcatcattagatctacacatgtaaactacacagtataacatgaacagatcaaatatgcgcaacatattgaacacgtactgaggtgacgaaaagaccagctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcaaaggcagaggttccggagacctgctctcccgatcgctggtgcacgccggcgagcgggatggagtagtctacgagcgacggcgcagtacagagtaggaggcaaaccctagattgattttgcgtatatactgcgtgaagacggcgggtcggtttatatagagaagggtcgcttgatcagggcacccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgcctgccctgccctgccctgccaggccaggcgaggcgaggcgagcgagcgcgcgcgtgtgtttcccctcttctctccaccacacatgcttcaagtggctaggaggacatcctcccttttaaagaggtcccactctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatatatattgatactctcctctagtttactaatggtttgttcttcctaggatctaattcacgggatctccgatcacatagactgggttaccaccatagtataactcacatgggtctcaaacccatctccttcgatgcattgtttatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccaaatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatatttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagttgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgagatacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcaaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacaaagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcagaatgtcaaaggcagaggttccggagacctgctctcccgatcgctggtgcacgccggcgagcgggatggagtagtctacgagcgacggcgcagtacagagtaggaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccatttgcacgcatcggatttttcggaacgtttccaaaacaaaaacgaatctgaatttgcagcaaaacaaaactgcaaaaggaggctgcatctgcgcaagggtgaggagccaatttttcggaccattcgacgcgtacgttgtgcacgcgcgccgcctgccctgccctgccaggccaggcaagcgagcgcgcgcgtgtgtttcccctcttctctccaccacacatgcttcaagtggctaggaggacatcctcccttttaaggaggtcccactctcctagaataagcaaggtggtactaaactccacatgcatgccatcccatgaggtgggcttttgtgattttccaaagaattaatcttcgagtgggctaaggcccattcattaattccaacaaaagtttgcagaggaaactgaatctgatcatgccctggagtggtcgttaaacagtcctgcagttggcctcacggtctcttcacttttgagtgcagggtgtgggagaggagaggaaaaaagaatggtcatgtgttgagcaccgtatggatcatgctgtcatgcctcactctgggttatggctgtgtttagttcctgaaaaaagttggaagtttggggaaagttggtagtttggaaaaaaaattgaaagtttatgcgtgtaggaaagtttttaatgtgatgtgatgttgtaacgctccgcttttcgcgaaacgttaaaaactaattcggcaaaatcctaaattgcgaaaattttcgttctttgtgtgcgagtctaagtcgtgccatggatctcaattcaatctccatcgttgttccctctcgtcgccatcaaaatcgcccacctcaagattccaattccgattcaagtctccaaatgaaattccgaaattcaaatcctatcttgaaatcctcgccaaatacatgtccccgttcccaaaaatatcaaaatctcattttgaatctcttccttgacttctcctcgagtctcccttgattcctccctaaaccctcgagttcgaatatcaaattttgaattcaaatccaaaccctaacctcaaccattcaaatcctctagaaaagtctagtttgcctcccaaaggttttgtaggccgattttgttcccccggccccaatttcccccctgcccatctccttcctcctctcgcacgttgctgtgcacgcacgtcagccgagccgagagagagagagagagagccctcgctctcttctctccctccctctctctgcctctctctctctctctttctctgacgccgctcccactcactgagccaccccgccgcctaaaatggaaggggcaaagccccctttccaccgccctatctccctttttccctttccggttcgacctctttctctctcgcccttgtccgcttgtgcttggaggcagagacgctgacctcggtgcgccagctcgccacccccaccttgaccgcgccaacccgcgctaatcctcccgctcccgcaatttgattctcgctgtccgatccaccgcctccaccgcgcccttgcatccacgccgcccacgaaccgcctttgccgctcgcctgccgagctttagcacgctcgctcccgcctcgaaccgacctcgcctccgctataaaacccaagccgagctcctcctcctctctttccctctcgttttcgcctgccgcgccttgtcgccctgctctgctcgcaccgtcgccgttcgtcgccaagcactggtgtcacgccccgagctagtcccgactggaattagcctgtgacgctccaaattaacctgttaatcgataccagtcccaggaaacagtgctggtatcacaggaagatagaatatcacagcaacagaggtctctttattatagagtaggagtacaatcatgttgggctgcggacagatcccgagctcacaactgcattagaaaagggaaacggaagccgggacttggaccaaacaacacaggcgcgacttgggaactaggccgaaaccctaaaactcatcgtaaccggcttgctcctggaagaactcctcatcagcaggatccgcttcatcttcatcagcaactagggggggggggaatatttatatagagcaagggtgagtacgggagtactcagcaagccatgggaaataagtgtttaatgcaggcttcaaggaaaggctggttgtttcgtaattgattttatttgaactcttttctaaaaacatctaggtgagtgcttctcaaacgacacggttgagacagtgcgttccgtccggtcggagtatgtgcaatgtatcaatctttagatcttaaaacaaagttggcaccccgtccacaagctttcaaacagtcaccccgggccaacaacttttaaatcggcaaccgggcctagctgtn

SEQ ID NO: 3554 - DNA, 730 bp, Oryza sativa
  unsure (1)..(730): unsure at all n locations
ccgccccccttganttttcgatatccgtttaccgcaagtagntcatcaatggaggctcatggcgtcgtcgggaaacgaatccaacgagtcgtacttgggctcctcccatgtcgacaagctcggcacgatcgagcaccacgacgacaggctgccggcgccggcgacgtccgtgggcaaacctagcgagtcgaaacagctctgatccatggcgaagttgagctcgccgagcgcggcttgcacgctcgcgtccgtgcacagcatggaggtggttgcggtggttgcagtactcgtcgggtcgttcccgctcgctggactggaccactcgccgaacccgtcctggttcgggtcgaactgcgccgacgccgccgccaggatgccggggctcagatcgctggacgcgctgaacgtgtcgaacgcctcgtcgacgtgccctcccgactccggcgtgacggcgccgagcccggcgtcggtcgacgggtggttcagaaacttggcgtacagcattgcgaggtcgatggtcgagccgtccgccgctgtggtgacgttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtg

SEQ ID NO: 3555 - DNA, 771 bp, Oryza sativa
  unsure (1)..(771): unsure at all n locations
tgaggtagaacgactactactgcaagtacttcatcagataaagtgaggctgggagccgaggggcgaggagctccaacggaatcggcgcggaggcctatcccctctatccgcgatggctggtagcgcggtggccgtgtgcgtttgtggtcgtcgcgtttcgccccccaggtgatcgaggcccgagctaagtcgagctactagaggcgagcacggctttgtcctgtaccgccacgtactacggcaacgcagcaagctagcgggggtgtagttgttgttgagcagaggcgccgacgccgacgccgacgtggatggtgcgagattatgaccaagtacgtcgtgttaagctgtgcgcccgatgtgacggcgaaacggttaaccggagagggggtctcgcaaatgggctccaagcctccaactctccaaggtagaagttgtttgcctttaatggcctagcatttacgcgtggaatatggcaccgggttcgacttcgagtgagagctacagggcgggagggggactcgcaggcgactggacgctttaccttcacgctaggctgctcgagcttccggtcagctcggggaagagctgctttaccatggcagtgtttagttttcccctatttctgactttccatcacatcataatacaccaaaaactttactatacataaaccttttaactttttttccaaattcccaattttcttcaaacatccaacttttgttagaaataaaacacaccccatttgacttatcctactnggatcgtctc

SEQ ID NO: 3556 - DNA, 763 bp, Oryza sativa
  unsure (1)..(763): unsure at all n locations
cgcgcccatttaatnnnnnnnnnnnnnnnnnnnnnnnnnnnnnacccaatgtggggaggtgatctctcatatatagctgagttacaatcaatgctagtgagatacacaagaccaaaggtctaggagataaacagcctatagactaataaataattctaatacccccaaatcagaagaaaacttgaggaacaaccatgtagtagtagcctagtaggaggaaagtatgaaaagtatgaatggagagatagacagcacaacagctgtaaattaacgcaagcttaaactatcttacacacaggagaaaaaatgttggacaccagaccaggtgaaacaatgtgtggccgaggagaattgaacactgcctgatggagtggcatgacaacaaccacagtgctatgtgcaattctttacatttggagtaaattgcagattggtccagcttttattaccaaagtgtcactttgggctacctctaattcaatcttttcacttaaagccaactattgttaccaattctttgcaatttgggctagtggcccacctgtcaataggcttatgagcttttctgtttctccttcttccttcttccttctctctttcggttcttcttctccaggtcgagcaacaacagagagggagagggatagggcgtccgtgctccggaggaaggggaatgatggcgttggcggcggagtgtgttcccgagtaacgcgcaaccgaggagggtggtggaaagcaaagggagtgagggagatggccggag

SEQ ID NO: 3557 - DNA, 8284 bp, Oryza sativa
  unsure (1)..(8284): unsure at all n locations
cgcgcgccatattctcctcannnnnnnnnnnnnnnnnnnnnnctctctctctctcttttctctcgtaagcccgctgataggtgggccactagcccaaattgcaaaggattggtaacaatagctggctttaagtgaaaagattgagttagaggtagcccaaagtgataatttggtaataaaagctggatcaatatgcaatttactcttacatttgagacaaagatagttttaactgtgtagtggggctgcttttaggaagtttaagctatggcaaggaaaaacaaattccacaaaaatgaacctgatattagtctaacataaatcatggggatacattacagcaggccttgcaagttgcaacggcagttgatgggctgccaaataaaaagtactagtactagtatactggcgataagttgtaaggatcaagcgcatgatgaatcagcagagtagatacacagagtatgatgaatcagcagagcagatagacggagttatgaattattcgcagcaacaacagcaagtaataatacacagagtggtgtatagcttccatcccaaagacctaggtttcgctaaaattaactcaggcgacagaggggaaaataagtactccgtgcgctaggtcggaggaagggaagggaagggaagggaatcttcttcttacggggtgcgagagaggcgatctctggaattgagggcgagagggttggcctcgcacagagactccgccgccgccaaatctcccgaccgcgcggccttgtgcagatgcaagtcatcctcctcgcctcctccgcggcctcggcctccacggccacgaccgccgccgccgccgccgccgccgccgtgacgcctccccatctctacgctgcagccgctccggatcagagaggaagaaggatgggaattggatcgaacaaatgatgggctgctgctctgcctcaattgctgcccaggctggcggcccattaagacagggaatcttaacctttatccttatctatatatctcgtgtctatctctatctttaatattataaaaattagaaatatttttgtcaaaattttaatatgccatccgtctttgaattgaattttaattttatcatcagactcttatatatcctcccatatccggccttcatcaccacgtagtgggcactgtgagtccaactttatcgttgcaaccatgtatataacatctcctccatctttaaaaaccggtgcaaatcgccttctttaatggattggaaagcggtttatactgatatgacaggttgacttggtccaaacatactgatgtgacaagccagtcatcaaaagggttaaaaataggagtgggtccctaatctaagtggcaaaggataaaataaaaaaatatgggcccacttgttagtcccacttttcctatggcttctcctctcttctatctctctctctctttctcagccgccgccgcaaatgctgcacacacgccaagaatgaatcggctgcgcacggcagctgtgctgaggccggcgcggacatcccatatgtgaagggtgcagccatggacggcagcgagccatggtgttagtgcttgccctttttcagttgcctatgtgcaggtctgcacgagaggcccaacagagtcgccagcggcgagaaggaggagtgggccgtggcgtatgtgcggttgtcgttgtcgtcggacgccatctcctactcctccagcatctccacggacatgccgctctatgagccccccgaggtaaaccacatccttctcgatctctgcactgccatgggttgatgcgacgagatgaccggaattcatgcgcgtcgctcgtgcgcgtgtgtgtgcaggtgtcgttcgacgagtacctcctcgactgcgcgcgcatgttccacgccatgttccccgacgagagcaggagccagcgccccagcgacgtaagcaaaccaaaaaccaaaaccactcccgaagtcctgttcgctctgctccggcaacgacgctaaagcttagctgatcctgtgtatgcgtgcaggaggagtggagagtctagatgctgtcgctgcatgtgtttgtttgtttgtctatttgggcacgtagacgaagtgggagctacgtgggctggagcgcggctacgcatcggcgagcttcgaccttggcatccgcgggtcgctctacaccgatagaagagtgcgcgactaagactgatgggagaaaagagtgcgcggccggccggtgaccctttcccccgcacgcgtcacgacctgcgacccctcctaggcgcgtcggttggccactccgcccccacgtgctgctgtaaggtgagagaagaggtagaggaaagagagaggtggagaggtaaggaagaatatagatggaggaggttgctgacaggtgggaggtggggcacacaagctgattcagtcaacggggtcaaaactgccacgtcgacgaaaccacctttctaaccgctgaaagaggcgatttgcactggtttttaaagatgggggagtcgctatacccggttttatgattgagggaagttatttaactagagcaagagttgagggaagcagtatggacttattctacttagaaaagagccacatatagcccccagcccaactaactaatccctagctcggtagctcccgaccccggcggccgccggcgctcctgtctccggcaggtagcaggccgcaggtggaagcgcgcggcgctggcggcggtgagcaggcaagcagcggagtacgggacggcgtgtccgcgcgacttcgcgagcgcgagcagcagcagcagcaggccagcagtcagcagaggccagcgcgagcaggagggagctgagcaggttgcagacaggcggcccgcggccggccgccggcgccagcgacgccacgggaggtcgggtgcgtgcatactgcctgcagtctgcagcagaccagcagcaggccggcggctgcaacctgccaatctgcaaaacaactaaacaaggtatgcttatcacttatcagtttatgcaaatatgcaattgtgattacctaagtggaaatttggaatggctcaatccattagcaatttagcacagtttcatcttgtgaagttgtgatgtatttctcattatttctctatttctatatgaaacttctttagaatacaacataatactatggtattataatattgtatgagacatgatgtgtttatgccgacgtttccctcaatttttcattcctggattcacccctgcttttcaagatgcattcatttggccatttaggcccagatagtctaagttaaatcaacagaacatggctcagatcagttacaggccaagttttcactacccaataaacaaggccagtttaacttacatagccattttactacagatcttcatagcatactatgtcacatacaataaaattactaaattcttggacttcctcatcagtttcccatttttaagttttaacaatgcaaaagtgccttactgtcatgcggtgagtctccttgattcaatatacgcatcacatacttgataggtgtatactggcagcaaaacttttagctatttactccaagagctgatgataaaccaacaatggtcatggaattttagctctcttcttcagattcttccacttatcctactccaaccacagcacgtagatcgatgcggtggcactaccttctatgtgtgttaggctcccatctttttgccaaatatggaaaatacgtcatatggcgtattagcaaaatatatttatatgtatggtgatacatatatatatatatatatatatatatatatatatatatatatatatatatatatatatatatatatatatatatgttcttagcgacttaaacgacaatcttcgacgaaaaaaaacttcaaaaccaagttttaaaatttaaattttggcatcggttgatgctgaatagagtaaacgatgggcgcgagggagagatggctgcgccgccgccgtgcacggatgggaggcggccatggtgtgattcgaaccggattctagcaggaggaagacgaaatgggccgatacgaaatttcggcaataataaaagggggtggctatcaagctaggaaagtggatgggtttggagacaaggaattttatacaggttcatgccttcttattcaagaagtaataccctactcctgtccggggatgattccgccgagtgtgttattgattgtatgattgggagaaaaagaatcgtcccgagaggaacccggacccctccttatataggggaaggggtccgtattacaaagtacagtccatatcctaacggaatatgggattacagataaaatacaatcgtaaccgactaggatcccgggtattttcttgacatacaagtttagaatctaacccaagtcctcataaagatattctatctatatttggtaccatatatccaactggaatataacctccatgtagatatggggtaaccataatctccacagtggcccccgagaccttcgcagttgaccaaaataatctccaaaaaacaataatccaagtgcttcaattcaacttgctccggcttgccgagtgctaaaagactgtgaagggcgaaaataaaacatggtgcatcgagtagatgcacctaattaggtgtagccctcgactatgtgattagttgaaaaactaaacatatagtcaagaaccgagtgattttatatcgaagcatgcatggtactcaataaaatacccagccgactgcttctcacttgaatatatcaaggataaaaaatatgaaaagggccgaatgataaacactcaaaaggtctaaaaatagatatatttggtaggaatccgagtaagaaactcttaaaatgatcctaggccataacccttaccataatcaaaataagcatataacatgctaggagaatgactactaataaaccagtcatctcaaattaacccaacagcttttgcagcctaaaaaagcttacaaaaatggtataacacctctctgtcgggcaccttttcatgtgcatcataataattccaaagaattattaaatcgcgttaaaaagaattttaacagcatcgggccgcatcattgtgagcacatattgccaaagcaaaaagcgcctaagtccctagggatcacaacgggccacgctgaaaacataattgggctgaagtactgtacaggcccaggcccattagtactcccgataccctaaaaataccgaagtccaaacgtcgtttcgtcttccccgccgagactctcgccattccccactccatgctacagtacagaaccgcgccgacgaagctagggttcatcaatctgctccaacccaccctcaaaaacttcacaaaatttctccccgcgtccaccgctccgattccccattcctctccagccatatctcggaccaaatttaaccatccagttcacattcatggcggaagaaagagaaagcttcgagagtcagtgggcgccctccgatgtgacagaagataatctgaaggagatggtggcgcacggcgttctcccagcgaaggagattatcgggtggcgaccggcgtccggcgaagcattcccgaccccggacacacacgaaatcatggtatttgctcatttcttctatggcggattttctcttccaaccttaagattcttccgggggattctgaacttctacaggattagcttgcatcacttgaatccaaactccatagtgcatattgccaatttcatccatgcctgcgaagcttttctgggcattaggcctcatttcgccttgttccgccgcatcttcttcctcaagccccagccaaacaaaagcaaaccatgcgtcgttgcgggagctggtttccaactcagaggaaccttgagccaaaaatatttctccatgcccttcaaaacctcaaacaaaggctggcatgcaaactggttctatgttcagaatcctgagcccgcagtccccgagtactgctgtcttcctccggtttaccaggatacatggaactcattgcctatgggagatgaagctgctcaagcagtagaactgatggagaggatgataaagctgaaagaatagggccttcaaggagaacagatcacccggcactttaccaagtgtcggttagctccaatcaaagaaagatctcgcacagccttcgaatttgacggcaagcatgacccaaaccgtgaagatccggattctcttgacttcaaggtcatgaaggaaaggatgtataagatcttctcaaacgccatcgttgtcagctactcacacttgctgccagtcgtaccgttcaatgcattcaatcctcctccaccggtgcgtattcatatacttcaacctttctcaaaatatgatcttgttttcttgttgaatcatttaacaatgaaggatattacacccaggaatttgctttgatgaagtcggatcccccaatcgctcaacgccgatctccccgccaccaaactgggcaagggagcggaagaccaagaattcggtatgaaactcaaccaagtgcttctgatccagtcggccagtcagattctcgaaagaggaagctggttctaagtgacgacgaagccgatgataccaccaggaggcctgtagaccgagagacgaccaagaaactaccaaaacaggctactccaaggaagaaaacatccagtcgtcctgtgccaaagatcaggaagtcttctaggtgcaactcatataacgatctctcttgtattgatgcgcacccattgcggcaataatactgataatcaaatttgcaggaaaccatctgatatagacccgtctgggaaagactctgacccaactaacatggacacaagtttttccaaagaaaccgggccaacagcagagaatcgtccgagtgacaaacaaccggcaaccgataatgtagaacccagcaacgagcccccgactgggaaccagtcgactgaagctgaagtcggtgctaaccaggagcccccgactggaaaccagtcggatgcagggccaagccaaaagattcccgaggttgaagctcaaacgaacagtcctctcgggaaggatgctgacaatgaatcagaaaccaggtctcctgtgaagacaccaaagtctactcgtccccgaccgggaatcatcacaggtagacacgctatctgaaatcgttttgatccaacagactttatttggctgcttcatcttcattcatggatacactagggccaataattggtgatgaagaagaaatcctccggatacaagcagctgaggattcactccctccgattctggtcaagtggtgggatgacaacatgcagcctcaagggatcgtgataaataagcaaaaagaggacgaggagctatgtctactgaagaaggcactaggtcaggcaacccgcattgtaaatgtaagccctctggtacctgatctcaaccatcttgtttgccatttaattcatgcgctaattaaactgttttgtagaggatttgtaacaccctgaaaattctcccaacgaaatcaaaacaccaaaaatacagattttcaaaaactttttaagtaataaattgcatcatgccgattttattcgcctatttcattggattttgatctcggaatttattaatcgcgaataatgaataactaactaggaataaaccttaaaaatcaagctggctaaataaataattaaaatataaattaaaataaagattaggtgggattggaaataaataaaatattatcgcgaccatattagcaataattaaattttagtacgatggaatgagaattaaccctaattaaaaattcaaataaattatataaacaaaatatgagtgatattaaattagggtgaatttttagttagtataaaacaaatatggagtaaacttcatttatgcaaaagttagaatttataggactatatttaaatagaaaatgggctaaaatcgggataaataggaaaagttactgttcattgcgtcataggtgttcgatcgtggtccccctggccccgcccccttccctgccgcgtgcgccgcgtcgcccgcccgtcgcgcgcgccgccgccgctgccgcgccgtcaccgtcgcgtcgccgtcggcctcgcgccttgtgccgccgcgcgcccgtcccctcgcgcctgcgccccgccgcgcggacgtcccctcgccgtcaccctgcgccgctgccgcgccgcccattccatcgcgccgagccctatgccgccgcgcgcgtcgcgtcgccccgcctgtcacgccgctcgctcgccacctgccgtgttgtct

SEQ ID NO: 3558 - DNA, 28099 bp, Oryza sativa
  unsure (1)..(28099): unsure at all n locations
gagagttgttgaacgcctctgccagcagntcatcagagagaaaagaaggaaaaagaaagaaaaagagaagagagaatggagaaaaagaaaaggaaaaataaatagaaaattaggaagaaattaaggaggttaatagtttaagaaaatctaaaataattagaatttaattatagattaattatggtcatagaattgcaaaatttaatataaattatagattattcttggtaatttctacaagaaatcaattcgcggtactagtttaaatgtaattaagaactaaacgattagatgaattcttatagactattatagattattttgggtaatctctataagtaattgattcatggtagaaattcggacttaatcactaggaattttagacgtatattatatttagtcgtttagtcctagactaaaattaaatcgtataatattataagataatttttggattccgtccgatatttagcttgcaatagaaatttccaacctattatatggatataacgctcgggtagattaaattaaaaacttatgataacaaaatatttatacccacaaaatagtttaggatatataaatcgaaattgggtttgccctagtacgcgaatagtaaagttaatataaaagaatcgactttcgtgtttgacttccatttggatttatttggatttttattttgaattctaatcgaatccaaatcaattttcgcacgtaactatagagcccgagggagttgcggatccaagtgaaggccaagacccccaagaccttgagcaaggcaagtcatcactattccttgaacatgttgatcccaattgagaaattattttgtttataaataaaattgcatgcaatgatgaatatcctacttgtgattatgccatgccttgattattgtttatcccttattccttcgtaaccatgtttacgtatgagtccctagtcaattatgacaattgcttagaaatgctattctaggatcatgcatactcatatttatcaaatgctaaatgcttgggcaattacctttgggaaggtaattgagatgcggcatgtggagacatgagcgccacattgccatgaaattgataacatgatttgtgaaaggaaaataaagcgaaaacaactgttttcgactggggcggacggatgatttgggtggtatctggaaaaggctagtagcgtccccagtcaattaaggaccgagccatgaagttaagcttgaaacgacccccgtacaaccgtacttctcaaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtatgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacctgtgtgggatgggatattgcatgatgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggtattaaaacttgatcagtctatgctaggtcttaggtttgtgaaaagaattacaaaactggcttagcgcaaaagagccatagccatcctttgaaataccccttttcatctgcattgttgctgtggtggcttgctgagtacggttggtactcacccttgcaaatataaaattaatcagaagcgggagatgaagcttcggaggatccctatgcctactaccaggagggagatgaagacgatgacgctcagtaggtcttagtacggtcgttgcctgtggcaatggcatgccgctgccttatctatttctgtttttggatgtattccggaccgctcggtccgattatttaagacaatgcctgcgggcttatgatgtaataattagcactagactctcgtgtatgtgcttttggtatttcagctatgaactcgtgtgtaccagactacttgatccagggaaatggtactgtttacacgaatgattcctgttataaaaacgggggtccacaggattcatcttaggaacgaagccaaaacgacaaccttagagaggttagtccctcatctcggaaccctcgaaaccaccaggaatcaactgcacgaagcgaaagaacttgccaggaagaatgaacatgatctgagggatcggatcgctgagctcaaggaatcaaattttgaactgagtggctcatcaaaaggtacgcacaaactctgctcaactgactcatactgttatctttgcaatcttgattaaccgtaatcaatgaagtgcaagctgccaagatatctcagttggagaagcagattcaaattctggaaaatgacaaggcagaactggcaagacaaagagacctggctttaaaggaagttgaaggtatcaacaatcaatacctcaaaagccattatcctccatatgttgacttattaatgtgaatctgttgatgcagaccgcaagatcaaatctcaagctcaattcgacgtccttgttggcaagatcaaaaaacttgaaggagcccgggatgaggttgctaacgctgctgccccaattgttcaagcaatgttctttaataacaacggcccgagtgcacttgatgcttctgaaattttcgataagctgagagttgctccggatacatatttcaagaacatcaaataagctggaagtatgggagcaagtctggcgttggcgatgaccaaatctctttatccaagggttgatatagatgccattgatggctttgcagacgggacgagcgaagaagctgctcttgacctcatcagcgatgcgcaaaaagccgctgacaagattgctgctgatgtagttgagagattccaggacaccgatcttcgaccgactggtcctgataattctgatgatgaaaagactgactgactaatgtaccaatgattttgatgattaatgatgatggaggcacaatttgtacaatactgatgaatttatgcggtgcttgatatcttaacttagttcctgatttcttaaaagtttttgtcaaaccttgttgagcctaaaacctgcaaaagttgttaaaaaactttcagtcctcattgactaagccaagaaatcaaacaaggcaatgatacatcaagtaaacaaattgaattgataaaaatcacactccattattattatagtagccccctgactgaaaacttcaaagaaaaacttaaagttagcagtcaaagaggaaagatacaaacgaaatgcctaagcgtaaaatcggcgaaggtgttcaatattccaagaattgttgatgagagtaccgtcttcgcgcttgagtcggtaagaacccggccgagtgacttcagcaattatgaacggtccttcccataagggagataatttatgccgatcctgtgttgtttgaattttcctcagaaccaggtcaccgactaaaaaggcttgtgatcgaacattccgattatgataacggcacaacccttgcaaatatcgagtcgactgaattagagctgcttctcgggattcttctagtcggttgatgtcgtctactcggccctcttcatagccctcctcgttgaagttccgaaatagtagtgattcaaattccacttcactcggcaacattgcttctgcgccgtaaaccaaaaagaacggcgactggccggtagcccgactaggagtagtgcgtaaagtcaaagtacggacggcagctgatctacccacttaccagcatagggacgtagtcggtcaaaaacgcgtgctttgatcccttgaagtatcatgccgttagcgcgctcgacttgtccgttactcatagggtgtgccacggaggcgtaacaaatgccgaagtcttcacaaaagtctttaaatgctccgccagtgaattgagtgccattatcagtgatgatccgattaggtaccccaaaccgatgcacaatgttgatgaaaaaatctctagctttatctgctgtgatcgtgatgaccggtttagcctcaatccacttggagaatttgtcgatagccacaaagagatgcgtgtaaccgccgactgcccttttaaacgggccgaccatgtcaagcccccagaccgcaaatggccaggacaacgggatggtttgcaactcttgggctggcaaatgagtttgtctggcaaaaaattgacaaccttcgcatgtccgctcaatcttgtccgcttcggacacagttgtaggccagaaaaaaccttgccagtaagctttgccgacaatagtccgtgcagcagcatgattaccacaaataccagaatgtatatccttcagcaattgtctcccttcctccaaagatacacagcgctgcagtattcctgacggacttttcttatacagttcagcttcatgaataatgtaaagtctgctgcgtctggaaatccgctcggcttcatttttgtcttgagggagttcttgtttgctcaaaaattttataaacggttctctccagtcagcttcaatcatgcttacgccttgagcatccatggcttcgactgtctcttttctaggcacggtcggttcataaagatgttcgacgaacacaactgaaggagctgcttcccgttttgaaccaaaattggccagtctatcggctgcctcattgttatgtcgaaggacatgggtgagctcgagtccatcgaatttatcttccagcttgcgtacctcttgtcggtaagcggtcatattatcatctagacatgaccactctttcatgacttgattaacaaccaactgagaatctccacggacgattaatcggcgaatgcctaaagagattgcaatccttaatccatggagtagcgcctcgtattccgccacgttatgggacgcagaaaaatgtttccacaatacatagctcaatctttctccagtcggggaaatcaagacgaccccagctccagtgcctgtgagcctcttcgacccatcaaaatgcatagtccaatactccatcttttcctctggcatgtcttcttggcactcggtccactcggcaaggaaatcagctaaagcttgtgatttgatcgaagttcgtggcttgaacgatatatccaaagacatcaactctaaggcccaattcgcaatccgtccatttgcttcgcgattgtgaagtatatctccgagtggaaacgatgtgtccaccgtgaccgagttactttgaaagtagtgagataatttcctgacggtaattaagacaccatataataacttttgaacctgaggatatcttgtcttggagtcggctaaaacttcgctaacgaaataaattggacgttggacttttttaatatggccttcctcttcatgctcgacaaccaggaccgtactcacaacttgggaggttgccgacacatttaacagtagcggctcttgtggatgtggcgaggccaaaactggtggagtggtgagaagtttcttgaagtcttcaaaggctttctgtgcttcgggtccccactagaaattgtcagtcttcttcagcaacttgaagaagggcatcccccgctcgccgagtcgtgagacgaaccggctgagtgccgccatgcaaccagtcagcttttggacgtctttttgggagcttggcggtttcatgttgaggatggcgttgattttcttcgggttgggctgtatgcctctttgagataccataaatccgagcaacttccctgacggtactccgaagatgcacttttccgggtttagtttcatcttgaaagcacgaatgcttgtaaaagtttcttctaaatccgcaatcaggtcatccttctgcttggtcttgacgactatatcatcaacataagcttcgacattgcgaccgatctgaattgaaaaacatctttgaatcatgcgctgataggttgctcctgcgttcttcaatccaaagggcattgtgatgtagcagtaggccccaaagggcgtaataaacgaggtcttcaagcagtcggattcttttagtcggatctgatgatatcccgagtaacagtccaagaagctgagtaactcgcagccggccgttgagtcaaccacctggtcaatgcgaggtaacccaaaagggtctttgggacaagatttgttgaggtcggtataatcgacacacatgcgccattgccccgtctttttccgaaccagaactgggttagccagccagtcgggatgaaggacttccttaataaagcctgctgctaacagcttggttaattcctccttgatcgcatcctttctgtcctgtgcaaaacggcggagtcgttgcttgatgggtttggcgtcttccttaacatgtaaagagtgctcaatcacctctctggggataccaggcatatcggatggtttccacacaaaaatatctttattatcctcaacatgatccgagaggtcgaacttaattgctatctctgaccaccgaagatattggggcgtgttaggctgaaccgcattgatctcccgttctgttagcttctgttttctcttagactcataagccaggggtccgccgaagatgtgattaagttctttgcgatgatcttgaaaaccagtcggggcatcgtcttcatcatctttcttctttgatgtgccttgatctccgtctgaaggtttacgtgcgttcttgacgtattgctccgcgaactgtttgtagacgaagcaatctttggccacgaggttggagttgggatgatgcgggcattgggagttcattatcttgtcgaaggtgttgacgcgggaacgttgtcggggaagatggagaggtggtcgccacaagttcttcgggcttacgcttgcgatccttgtggttgttacttccactccctcctgcggtcggcgtgtccttctttggcttccaagtggtgcccgactgtttggacgcggtaatagcatattcggctttggcatactcgtgggctttttcaaacatctgcttaaccgtcctgggaggtttacgcccgaacttgccgactaggtcctcgtggcgaatgcctttagtgaaggcggcgatgatgatgtcgtcggtgatgtcggagatcttgttgcgttgttcggagaagcgtcggatgtaatctcgaagggattctccagacttctgaacgacattgtagagatcaaactgtgtgccagggcgttcaaaggtgccctggaagttggcgatgaagtgatcacgaagttccgcccatgatccgattgtgccacggggtagtccgtggagccaggatcgggcggagttcgctagggccacaggtagatagtttgccatggccttgctgtctcctcctgctgcgcggattgcgagtccgtagacggtgagccaagactccggattagtggtgccgtcatacttctcgattccagtcggcttaaagccggctggccaatccactcgacgcaggtcattagtgaaggcagctactccatccacgtcgtcgtcgtagcgatttggtgaatggcggtgacctcgtgctgcacggcgctggttgatcgtgtcgcgaaggtcgacgggacgctggtgaggtggagagcgaggccgttcgactcggcgctccctgtgacgttcgggaggcgagtgaatagatcgttcgtcatgacccctgctcctgcgactagatcctgtgccgatgatgctgaggcttggctgatgataatcatgagatcggaggtgagggactcggctatcagtcggggtgcgggtgcttgcgcagttggctggaaccgaggcagcgatcatggtcttcgtctggttcaagatgttgacaacatgatcaacttggttgagtgcgtcttccttgaggagggtgtcgaggagagtgattgctgcaaccgcgttctgctgggggtgcgaaagaccgctgttccatcgacgtcttgttgcccaatgagctctctcgctcggcgcccagattccaaggcgcgttgccgtcgatcttcagcctcctttgcaatccgttcgtgatcttgttgctcgcgctgtagtcgttctcgctcctgtcgctgtcgctctttctccagtcggcgacgttcagcttcttgccgtgcgcgatcttggtccgcttctcgggcttggcgctgttcctccgtttcgttgtcagccatgaatacgccgaagaagaggagcgtgtaattatcctcatagctgtcgtcgaagttgtcgaggtcgccgtggtcatagtggtagccgaaatcgtcgtagtcgaggatctcggttggtcgagaactgacgccgggggagctaaggtaaccatccaactcttccgtcgagactgtcccaagaggttggagtataacgccaacctctctagatctagattggatcggggccgaagccggagctcgcctagatcttcgagtgggagatgtcttggcagtgaagacagcggccaaatcatcaggaagtttcatcaggattgagggataggacccgtcgtcttgatctggtcgcggaagagtagattggatctcgtccgagtggtttgaagccgactcgggagagatgctcttggagtaggcctcggccgagttcggaataccgaatggcacggggacctggtctctccccgactggttcgggtccgagtcaaggagagagatcttgccgaagtcgttggtgatgaagttgaggctgccgaaccggaacgcctgcccgggagggaaggcgaagtcgtcgatgccagaaacgaaacccatcgcacttagtcggcgagaacttgacgctacccctacctggcgcgccaactatcgaaacaagatttcgacaataataaaagggggtggctatcaagctaggaaagtggatgggtttggagacaaggaattttatacaggttcaggccttcttattcaagaagtaataccctactcctgtccggggatgattccgccgagtgtgttattgattgtatgattgggagaaaaagaatcgtcccgagaggaacccggacccctccttatataggggaaggggtccgtattacagagtacagtctatatcctaacggaatatgggattacagataaaatacaatcgtaaccgactaggatcccgggtattttcttgacatacaagtttagaatctaacccgagtcctcataaagatattctatctatatttggtaccatatatccagctggaatataaccgccatgtagatatggggtaaccataatctccacagtaaaacttatatatatgtgttcttagcgacttaaacgacaatcttcgacgaaaaaaaacttcagaaccaagttttaaaatttaaattttggcatcggttgatgctgaatagagtaaacgatgggcgcgagggagagatggctgcgccgccgccgtgcacggacgggaggcggccatggtgtgattcgaaccggattctagcaggaggaagacgaaatgggccgatacgaaatttgggcttggatgtgtgggagctgaaagtcacttatgctatcagccatggcccataccactagctggcacgctgcaggctgctgcgtcactgaaattccccacccacgcatcgcaccgcacgtcgccggcggcgggttgccctccccttctccgtccccgtctctggccatcctccccatccatccgccgtgctgctgcctgctatagcgcccctaggccggcagcccgccaaacgctgccccagctgggcagccacgcaaccagccgtctagcccactccgctcccagcgatagggccggagccggtcacctacacctccctctcgctcttatcctttgcatacttcgttctgcatctcgtctgatcgatcttctcctttgtcatctttcttacagttgcaagttgcttcttcaatggcaggttcggaggatttgagcggtttggcagcttcacttggagagttacacgtggaatcatctgttagatggatctccctccccttgagcccaacggctcaagggggccttgacccgcgccctgatcgggggcgcccagcccaatggctggtgggcccccgtcacactgtgccatataaagaggggtggaggacgggacggcataacgacacaaggaacgaggttcgtcgccgccgccactccaccccataaaccctaaccgatcgagggggcgcagccagtgacgggaagtccaccgccgcgccacgccttgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaatggtatcagagccatcctagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggagggggggaggggcaaagaggcaccggcgaggagccactcgacggccgcgcgcgcacccgcgggtgcacgcgcgcgccggcgagggggcccgcggcggcgccgccatctccgtttttcggccgccgctctctctcacacggtgggggctagagacggtggagggagcggagaagagaaaaggaagagggcgcaagggccgctggcagcggcgacgccgctccgctcggccgctccgcccggcggcgcgctagagaaaaagtgggcgagcggcagcgcgaggtcgccggccatggcgcggcggcgcaagggtcgccggcgtagatgacgccactcggcgcggccgcacccgcccgcaagagagaagaggctagggtttcggccggccggcggctggggtcgggtttttgtccctccgatcttagcgcccggccgtccgatcgaaaccctagcgatcggacggccgacggcggccgggccgaaagcggcccaagtggggagcgcgcggcggcggctttcccggcccaggcccaggttgcggcctgggggaggggagggggcgctcgcccgtgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaattttgaattgtttttgcatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcctttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaaatacctcgaaagtataaagagccagtttactggttcttcaaagttttatgcgacacagctgataaagcagctttttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcctgacttcctgacagtgatcatggcaaagaaaggtgagaacattattacatttgtaaagaatctcattatgattggttattctagatccacatggtggatttattctggagcaactattcatgtgtgtaattgtttaaagggattccgttcaatgaggactacgcaaagaagtgaaagatccattagagttgctaatggagttgaagcaaaagttgaagctgttggagattttcgcctagaactcgcgaatggcttcacacttttacttccagatgtttttatgtccattctttgcaaagaaacttgataataagtgtatccaaattggattctgatagatatgaaatggcaaatgtgaactatggtataataatgaatgtattggtcttgtgttgcaagatcagctttatttgttatctctttctgagaatgtgaatgttgtgtcctcgttgacaaaagaaaagaaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccgtatgagctatgaatcctccgtgtgtggggaagtcctgcaaaggataaagtatttaacccaaaacagtaagctgccattttattggttattctgaaagatcaaagggtcatcgtttctactgtctaaacagttatacaaagtttgtagaaacgagacacgccgtcttcttggaagacgaaatgattagggggagctcggtaatttgagaaattgatcttgaggagaggcgggtgtctgtacccgctccgtcgactcaggaacctttcttctctctacctgctaatgttgtgccagcaatgcatgccgttgcggtaccaacacctgttgttatctctcctgtggcaacaatgaatgaaagtgaggaatctgttctacaggattcaacagaaattattgccacatcagaggaggagctgcaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaagttttcacgcaaagagaaggcattgattacaatgagacttttctccagtctcttgtaaagattcctttatgattataatggcactagtggcacattatgatttggaattacatcagatggatgtaaaaatggaatttctaaatggtgatttgaagaaaaaaagtatacatggcacaaccgaaaggtttcgtcatgaaatgaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacatatgcagtgctacacctgctcctatagtcaaaggcgaaaagtatggggcatcacaatgtcctagaaatcagtatgagctcaatgaaatgaaaataaagccatatgcgtcaactgtaggaagcctacagtacgctcaagtgtgcacacgacctgacttggcatttgttaccgggttatttggcagattgcaaagtaatccaggcctagagcactggaattagtaaagattatttgcaaagaacaaaagcctcatgctgtcttacagaaaatcagaatcgctccacatagtggggtattcgaattctgactttgcaaaagataatacaaagttaacatcgggggatacatgtttaccctggcagtaggagctatttcatggaaaagctcaaaacatactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaacggctcaagggggccttgacccgcgccctgatcgggggcgcccagcccaatggctggtgggcccccgtcacactgtgccatataaagaggggtggaggacgggacggcataacgacacaaggaacgaggttcgtcgccgccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccgaacttcctcttcctcaacaacgactggtcacaaccctaaatcctctcactccctctttgttcattcatctattgttgttcatccattgcaaatagaaccacccgactagatctaaacctaggtgatccaatagacaaccctatcatcatcagcttcgaaggacagtgaaatctctcagcctgattcgtgtcactgcacatgttatcttagcctacttgttagttgtcattgcttgggatgtacacactagaattgcatcctgctatcatgtagctctgtttatatatttgaactgcttacaaagcaacctgtgatcaaatgatggttgtgcttgttgataatacaaagcaaaggtactacaataagttgatttgcgtgtgttttgttcaggcaattcggttgatgatgatgctattgctgatgatgatgtatgggatgatgtttcggattctcctggtcatggatccacattagacagagagtgggttcacaggcagaaccagtttcataaggtataaacctaaggcagcaatttgattatgggaactttgccctattcctaaaggaatctgtgaaattgttatgttccatttaaatcatctttactgcaatatatttctttagttatgatttgtgaaacttgtgtttggaccagaatgtgtaaagtaatctttccatttttcctttagatgggatacagggatggtatagcagaaggacagaaggacatcgcccaagaggggttcaatgttgggtttgggcaatctgtgcatgttggctataagtggggtcttgttcgtgggattaccaggttaaaatggatatttgccattccaagtatagttcttgtacgcagccgcttgtagcatccttattgattctgttttctgtttattgtccttaaaacagtgcattagctagtctccctgacagcttgaaagaaaaattgttgcccaatgtccagtgcagaggacaactccaagaactgaataattctgtgcaagaaatttcagcagaagacgcacttcagatgtttcatgagagcattcttcagagtagccattcatcagaggaaccagatgcaacattatagagagctacagattccagtaggttgcaaagcctctcaaaggatcttgtgattttgttgcatgaatgctcagatgtgaaagttagcgaagaactgagaggaggttcataaacaagttggcggaattgtgagcactaccaaccctatgtctggcctagttgctacttgcgtcgaatttcagtttgctgaacatcgaggaagatggtgattcaggggtgttgttggagatggaagcgattcaattccttgatctcacaaccatgatttgctgtttcgaactcaaaaggcttaagcctcaaagaccaagaaattaataagaatgtaattgtaaatcttgtaactaagatttcactgatcatataagcctttccttttcctgctagatataaccggtttcgtatctgtaactcgcagcatgcacacacacacacacacgcatttcattagaactttggcagctgctaagatgataacttcctgaatatcttctgcagaaagtctggtgtatgacagttgcattgtaactttgcatcttctggttccaggaagtgtactcacttttttatcaattgagaaggttcgagccactcctgaatgtttgctactgccctacttatgtaatgttgaatgttgatatgatgaatggcccttggtaatttcagtttgacagctcatgtcagtaagtggcccgcttctattacatgtggttggtgcgattggtgcatcaagctcagcacctcttttcgacatgtaccaggttggtgagaacatcaacacttctatccgttgcatgttgtgagtgttggttttcaatattaatgtcattcattcatgaatattcatgattgatctggttggagcgttcattgatattttatacagtacagttatcttgaatctgaactatgattgatctggtctcttggcttggttgctcctgactcctgaattgaatgaaatactcctgacatcccaatcggttgattggcacttctgacggtacatgttattctgaatagattcagtttattggattggaggttctttttttacccaatcctgtcgttaaatctacatcagaacctatagcaacagagtttttccttccctatttcttgttacatgacatgtattcaggttacatgctcgcatatcaattctgatttcttgttcccagcaagtttggcaccgtcttattgtcaacacgcttgcacagagactggcagactgctgtcacatatccaattctgatttctggttcccagcaagttcaggcccatcactctcctagcggtattctgaaaagctacttaaacttgccatcacttatcagtcaagttagatcacagctcagaacttattaagatggcgaaagatatgcatcttctgttagtgattacaggagatataggagagattgaatggataataatagttctgtacccatagataatcaagacatgctattgtagggagaacaaatgctgtcaataagagttttattgatctttgcccaaggaatacatcccaacactcttgccacttcgcaagtctcgtacacttacacattaatctatcttatatttttattaaaaaatcataattatttagttgatatacaagaaattggtgtacgtctacttaagagattagaatccatttaagagattagaatccatcctcgatgtcatggccatattttttttttgcttgtaacgataagaagatgaagatgacgtaggctgcctgtttattatcaaccaacatatcagctaacgagaaacatcggttattttgtagtatacacaaaacgtgttcactatcatgcacacgctgctgatgcacactcttttttaattatatgggctctccatacatatatgtgtgtatataaaaagtgtacgtacgagtagtatgtagtacgtagaaatcttaattagtctatggatggatggatggatgattggatggaatcaggagtgcatcatctgattattattattgtcgtcgtcgtcgtcgttggccggatgggttccggcagggtgcatctccgtctcgtgtagctggcggtagcgcttctcagcctcgggcatggcgcccatgatggcgcggaggcggaggttgacgtcgtcgaggcggtcgtacacagcgtcgttggtgaacatgccggcgcagaccttggtgatggtggtccagctctcggccaccggcagaaggatgatgacgaccgagcccacagtcccccacgcgatcgccaccgcggcccacagcgtgaagtagccaaggctgtacctcctcgccggcagagacagcgcaggccacgccacgacgatgacggcggtgaagacgaggccccacctgacgatccaacgcttggcgtgcaccaggcgctcctccttgagctcgtcgtccagcgcggcatgcacgctctccaccgtggtgatcatctcccggctggtcccccagtcgtagtgctgcgggcgcagcaggctgcacgccgcgtgcaccgccccgcccaccaggatggacaccaggttgcccgccagcatcggcgcgttccgacctgtggtgtccaggttcacgcgcccgtactgcaccttggccaccgtgagccacacggccacgcccagcgcgcagccggacaccgcgccgcccatggcgcccaccgcgttggccttgctccacagcagcagcagggcgatggggatgactgcggatcccacaatgactcccatggccaggtacatccaccccagggacacccccgccacgttgagcaccacggcgaggacccccatgaagcagccgaagccgagcacgacggccctcgacacgcggagtatctgcttgccggaggcgcccgggttgaggtacgtccggtagatgtcgtaggtgcagagggaggagacggccaccagctcggcggagccggcggatgtgacggccatgaagagcatggtgagtagcaggacggagccggacttgcccatgagcgctgttgcggtggccgggggcaccaggcccttggctgcctcggcggcggtgagcgggaggtccagggcgagcgcgccgaggccgagcgaggtggccagcgagaagggaacggcgaaccacacgaggccgcccagcaggtagcccttgtgggtggaggatggccgggcggcgatggcgctcatccagtagccctgcagcaaattaaattacttgtaattaattgacgatccaagataattattagtactacgtacgtttgggtacgtacgttgtctacgaacaccgttccaaagttgccgacgatgttgatgatgccgaagacgagcccccccgagctgagcatggtgaggtaggagcccttgaagttgccggcgacggggccgcacgcctggccgttgcgcgagaggtcggcggagcagtcgcgcgcggcgctggcgacggccatgaggcgatcatacaccacacgcgggctcccgagtttggagctggaggtgtagacgaggaagacgaagacgacgagcaccgcgtgcacgacgacggagtggatgtagctggcgaggaaggtggccttgaggccgccggcgagtgtgtagacgacgacgccgagcgggatgaggaagctggcggcgtagacgttgactccggtgagggcgttgacgacggcggagccgccaaggaggagcatggcggtgacgatgacgttggtgaggaggcagaaggtgaggaagacgaggtgggcgggggtgccccatcgggcgcggacgatctcgcagacggtgtgggcgttgggggccttgcgcttgatctcgatggccatcacgccgaagaggagcacctggatggtggcgccgctggcgtaccagaatggcccgctcaccccgtactgccatgccacgttcgagctctgcaggatggtggcggcccaggtccactgcgacacgatcacgctggcgatcagacccgtcttcacgctgcgccccgccgtgttgaaccactccgacgtgtgctgcgacccgacgtaacgcttctcaagccacacctatatatatatgcatacgtacgtaggtagtagccacaaattaattaatcatatctctgcgatcgatcgatcgatcgatctcaagagaggagaggccgaaggatcggaggctaaccaggaaggaggtgaagagcgcgaagaaggcgccgaagccgagcacgacggcgtacccgacggcctgcgtgagcaccggccttccgccgaagtagctgccggcgcggctgcacaccccgttcaccaccgagtagtactccgccccgaaccccagctccgcaggagggcacacgccgctcgccatcgccagcttcaatccaatcgatcgatcctaattaaatggggaatttttactctaacagacggatagatggatatgtactgtactagctagcagatcagagatgtgtgcctagcctattaggcgcgtatttatacacgtataatgaccatatatgcgatgcaagcaaagatacactctccagtcatagatgcgatgcgatgcgagcttaatttggagtgattgggtagttgagcacggaatcttctcttcttttgacccagtcatccactagctagctatattccagctgcatgcgtacatcatagagtagtacagtatattatacacactcgtcgttttctctgatggcgaccagattatacaaaactccatttatttcgttttcgcaaagtccaacttagtttactcacttatatataacaccaaacaagggcgcttcacttgtcaacaacacgtactgcacgctatcagaatcgatagctacacttccgtcgattctctctgcttcctcctccgataggccaggtttaagggaaatggcactaattaacaagccactaggatccagttgtaacgataacaatccaaggtcaaaatcgcccgcacacaactcgctacataattagttgctccagttgcgcatgaatgccatgtccatgtttctgtttgtcaacgcacaccgcttgcacccattctatttgtggagcaaactctgttttttttaaaaaaaaagcgttctcacaagtcatcgaatatgcaatgtcaacggcttacattaagtatggcagaaaatctttttaatcccctctaaagacgcagccgcggcctctccacatctgcatcatcgtggaggctgcctaggccgcgggacggcgggaggcgtggccttcgcttctggtccgcacctctattggatggatggatccattctctctagtgaagtttgatgaaacgcatgaaaatttccttacttgtgtctctgttctttaaggataaagcgacaacgttgccgcaacaggaattgcaacggttaactgctacattattttttaacgcatctgcctgtaaacactatataaataatatattttttggcttcctaaaggaagtagcacaaatagttgatagttattgttaccttccctcacaatggatattgcaaaacaggatgtgagcttttattgcttattcattgctttaatcctataccgtggacaactaaaaagagattggatagacctgaaagccttttgtgtgtatgcggagtcctgcggaaagcgaacatgcccgtacctatagtctacctaggatcgatctaatcctaggggaatatgtgactcatagtggaattagttgaacattgaaattcaaactttggtaggcaacccgtatagtctattgtgtacgggcattgagtattgcctttaaaaaaagggtatatgagactgccaaataatcgttcgatgaggtttaatgggatttcagacactttatgctgctcattgatctagggtttcctttgtagtttcttaaggagatgtttgtagtaccttgagaatcaggatgggaatggctagggtcaatccacttataaattgaatcgatccttaaatttactctaatgaatctttagaatcactccaaaatgtaaacggatcaaaccattagaacttgcacaatcctagcaacaggcgtccaattagtaattccggagtgccgcagccatggcgatggttgcgcacatgacctccctagctccaagctgcgcactgctacactgtgggcctcacatgtattggacggagggagtgtattatccaatggatacaggtaacccattatgggccccacatgctttgtataataaatcgttcctataaaatccaataagtttttatagtgtgagcacgagttttaaaaaaattgtatgtccgagttttacctacatgtaatacgaattttttggtctattagtaatgcagatgatccatttgggtgttcatggataatctatcgatataatgaactcgtagtggattgaccttgttagaccatggatccataaactcagtggaaatggtttaggcacgattcatatcctaaccattcccatcctgacttggcatactccaaaaagccgttgaagtgaggcctaaaatcttgaaaatggaagttggagattttgatcaatggtgtctccatcatcgccaaccacagtaaacaactaatgttcttgattacatttcataatgttcactgtagatggtcgtatggaatttgacggaggctaagatgacatggtaacaagattacaagactatggcggtgtcttatgggcagttttatggatggggcaagcacaagggacaacaaaaaagcaacatgttaggaggtggtatggctacctgtgtggtagggtaagcaaggaaaaactaccaaagaggaataaataggcattataggaaatgtggacattcatgttggtgacttgtacaagtgatatgtatagaaggaggtgcacataaatcttgattggtggagactctggttagggtaccatatgatgcagaggtgaaggtccccatgtggcagatatggtagggtggcctagctactaggcttcccttcttgcttgtcctggtaggcctttgttgctgacggcgtcaaggcttgacacaacaccccaaaaggttggatcccttgcctctcagcagcctatttgcttaaccttgtctcctttgccctctcatgaatgcagcctctgagaccaaagccatgcacgaagtcaaccttagcatcatcgcccaccgccgcgccactccttgagcccattaaccactgtccatttcgttgccttcttgcatgtggcctcggcagccgaccccccatgcgttccatggaggaggaggaggaggaggaggaggaggagggataacatgagagacgaggggacgggcaggtggcgcaacatccctagcactcacaaggcacgaccaaggctgcaacgatgacaatttagtagtggtagcgtcaccggctcctatagatagaaccaaggataaaggtatgtcctctaattggtgcaacacaggcctagatggaaagaagaaaatggtagcaaaaggtaatgagcttatttaattggaattagttaggtggcccgcacaattgtgcgctagcacctatacaaaatgatctaactttttacacatggttttattaaaaaaatgttaaatagccatttagttgccttagtctttcaaaagatcgatcctatcatcattttttgtttttagttttatatttttaaaagtcacaccagccaccactctctactctttcgccacactttttttttctgttgcccgacctcccactgcttctaatcatcatccttgtgacctttaaaaattcaacctgatatgcacacactagttttttacatgcaatgaacagtagcttcttctctctctttgtatagggccaaatttgccttaatttctagcaccaaaatgttgaggtgtgtctcattcattagattctgcttcgatcagtataaattcattttggatgcaacaaatagtagctttcctattttggagnttattaatttttcccaattttgcaattttcatatgattttcgaatgaaaatttacaccaaatttaagacgatactagtttggacctttcaagtgtgagcgtattttggctttacgccttcgtgtggagtaaacgccctttctgttgggcgggttcggctggatcttttgttcccccttttcctttcttctccggcagcggcggcggcgatgggggacggccgcgtcggaggtggaacgaatcggccggcatggctgcagcaatacgaactagtgggcaagattggcgaggggacctacggcctcgtcttcctcgctcgcctcaaacaatcgcatccccacgctgccgctggcgttggccgccgtggctctcccatcgccatcaagaagttcaagcagtccaaggagggcgacggtgtctcgcccaccgccatcagagagatcatggtaccttcctcagggagatccgctttccctactcctccctgccataccaaaccctaactaatcactagtcttctcctcttgcagcttctgcgtgagatcaaccacgagaatgttgtcaagctcgtcaatgttcacatcaaccacgccgacatgtccctctacctcgccttcgattacgccgagcacgatctctatgtaagcagcaacgcccatctccaatcttctctcttatctattgtacagtagtaatcatttgtttactccagttaacagctaatgaacctatgaaacatatcacaggagattatcaggcatcacagagagaagcttaacctccccataaatccctacacagtcaaatctttgctctggcaactgctcaatggtctcaactatctccataggtatcgtttacttcttaagttatcatgatgagtgatatgtaaaaactggagcctaacctagcacatggaactttttttgctgggatcctagcttattctgattttgtctccaaaaagaaatctaaaaattgatttcccttcctcagtaactggattatccatcgagatctcaagccttctaatatactggtatgttgtcatatgctaccttttgatgtacaactctgtcaatcttgcttttcctggctcaccggattaggatgatgtgccccaataggtcatgggagaaggagaagaacatggaattataaagattgctgattttggactcgctaggatatatcaagctccattaaagccattaagtgataacggggttagtacatccatctgtgtgcccattagcatgtttgctgctgtcttgtgtttatttcaaggcatataagggcaaaaaatggtagttatttgtaaaactactgcttgtttcctcttttttgtgatgaaccttcatatgctcatctgttcctttccttttttgtggaagcatttaatgtgttatcaatacccacaagtatatggctaaccaataatttccaggttgttgttaccatctggtatcgggctccagagttgttacttggggcaaagcactacacaagtgctgttggtatccttgctggagattgaaatgatatctttcgaccatcttttttcgctttattcacttcagctatttccttaatcaactctagatatgtgggcagttggttgcatttttgctgaattgcttacactcaaaccactgttccaaggtgttgaagccaaagctactccaaacccgtttcaagtatgggcattcacactcaagtaattgctatcgttaccttgtattcagaatcaattactagatactagactaagactgcgacattttacgttttctatgtgatgcttaatttcaagtaaagatattatcactcttgcctggaaccttcctaaaagtaaataggcagttgataattgtatgttgttgcattttatatatcctgctgtattacattttgtagaatatccatgctatgtatgccattcatttgccatttatttttatctcacagttgatttgcccatgtcttgtagcttgatcaactagacaagatttttaaggtcttaggtatggatgactcatttctcattctgactatttgattgtgtactcttcctgagataatatatgctctaggataataatataattattctccaggtcatcctaccgttgagaaatggcctaccctcgctaatcttccatgctggcaaaacgatcaacaacacattcaagggcataagtagtatgtcatgcattgttaagctgcttttaaaaacctgtgaaaatagcatttatctttccttgaggaaatagtttctcccttgcagtgagaacacaggacttcataatattgttcacttgcctcagaagagtcctgcgtttgatcttctctcaaaaatgctcgagtatgtaactggccttttggcctgctataaatccaacataaccttggatgattatcatttcttacattcatcttttgtactactaaatgttgttttaataaccttatatattcctgtttcaggtatgatcctcgaaagcgtataacagctgcgcaagctttggaacatgagtaagtaactacatccctccatttattcattattccttttttgcctagttggatacttcttatgttctcagtgtacagcaagtgcgatctggagttctaattgcttccctgaatctagtttagcaaccatgcaagaaaaacagttatgctttatttgcacgaggttttgatacttggacgaggtcttgatggtcctcagttggagctgattttgtggggtgggctggagtggtggtggtagtggtgtggcttaaagggtgtaaaattgccaagaccatctgtttagagtggctaacggtcaatttttccttgtaaatatttgtgcatcctaaacttatatatttccctttacaaatataaatatatgcaatcctagttgaatcctttact

SEQ ID NO: 3559 - DNA, 1423 bp, Oryza sativa
  unsure (1)..(1423): unsure at all n locations
nnnnnnnnnnnnnnnnnnnnnnnnnnnnnnnnnnnnnnnnaaggctataggccctctgtttctttttgtaaggctatagtcttccctcttcctctgtttctttttgaaaggcctagagttttttcaatcattttgcaaaatataaggcttgcatgttggtattgaatttttttttctttatgtgcccacaattattacatagtctctctcccacatttataagaagcatcttactaaccatctccacacctattcttgaggtattttagtatggtggcatggtcatttgaactcttctttctcttggttttccaccctccctaatcatttttgcccactcagaataagacttgtaattttaaatggagggagtatgatttactacagcaatccttctgaacaacccttttctgttgataggtactttcgaatggatcctctgcctggacggaagtaagttatgtgtaatcagggtcttaatatactttccctaacttgcaactcttaaacatttggctttacatttcctccacaaatgaagatgactaaaatctttctctggtcagtgcacttttaccatcgcaggctggagagaaaattgtgcaatatcctgtgcgtccagttgataccacaactgattttgaaggaacaacaagccttcaaccaactcaagcggtaatggatttctgtccctgtgccacctttttaccaagacttatcagtattacttagtattgggaagcgatatacagaatatgcattttctttggtcaattatctaagttctttatacagttggcaaaaatatcgtgctttagggcatattcaattggtcaaaacaagtcgatacatggttttcaatgccatcaaagatttggtccagtgtgatttaaggaacccaactccatgttggcacattttcttgcagaattgattcgggttgctttatgaggtgcatttttataatgttgtacatttgtatttcagccatcagggaacgcagctcctggcaaccagtctgtggtaccgagacccattccgaggcaaatgcaacaacccatggtcggtatgtcgagaatgggtggtacaaacatggcggcctttggtgcagctccgcaaggaggcatagctgggatgaatcctggtaatattccaatgcagaggggcgctggagcccaatctcatccgcatcaggtaaaaactgctgccttggaagtaaatgttgcttggaaaaaggcctgtgacaaatgcaacatttgattggcttttgatatgtgcaacagttgagaaggaaagctgatcaagggatggggatgcagaaccccggttatcctactcaacagaagaggcggttctgaccgactgaatttgtaattgtatatctatttggtgtgttacttgtgagcacgcttacttttgcagg

SEQ ID NO: 3560 - DNA, 21837 bp, Oryza sativa
  unsure (1)..(21837): unsure at all n locations
agagaaaagttgtatcacagctggtacagtacttcatcattcctactaaaggaaaaaaaatatacacacaactcttcgaatctgaaaattcacgaatacaactggttcaagagcaaccacaattatatcagtacagtagcagcttcatatatttacaaccactcccgcttccacgaaaagatgaactttcagtaagtaaaccaaccactcctcccaagtgcaagtgcatcactgtcacctgtctttcgtaacactacagttttgcctgaatcaaagctttactaaaaagcctcgcccagttcacgaccaatagctacaacaggagaggaggaaatcaaatggaaaagaaagcaagatgcaggcatcaagtcaatccacatagcgcaaggatcaactatcccttgttattcttcatgacgatgatgttgaagttatccgccctgaagctcgcatctcatccagagttgttgctaaccagtccaatccttcatagaggccatcgcctttgagagcacaggttccttggatatgccatatacggttgttcaggtcatatagaccaaggccctcgcatacttccatcggagtcattgcgcccctctacactagcagatacattacatgggtgagcaacaattcagtggcaaataataaagccattaagttatctagtgcagagtcatactattccaatggtttcataagtgaatgcacaatgccaacaaaatttagcatcatcataccataagcatggaaacatgccaacaattaattcatcatctgcaaactcaacaaaagatagaagtgcatcaaccatgaatggcagcaatctcacatagtgacatgggcgatgggaaacacaagttacatggatgtgaacttcaataacaaatgatttttttcatgtactacccagatgatgaatttacatatacaggaaacaattatatattggaaaaaggtaatatagtcatctgaacaagctagatgatgttaaagtagctgccataagaaatacaggttctggaaaaagaaaaagagacaagttgagcataccatgtcttgcttgttagcaaacaccaatagaacactattaagcataaaagggtcattaataatggcctgaaagacagattaccacacagtaagttagagcaacaaggcaacaaatgtcagtgcagaagcaaacacttgctgcctcataataaattatttatacatatatgtaaacctgaaattcagctctggctctcccaatcctctctctatccagggaatcaactacgtagatctgcgagtttacaaaagaagagaggaatttacaacgcaagaaaagtgtttctgaaaccaaaatgtgcgtgctaattaaataaagcaacgtggatctgtaacataaaaggtccttgtaggcaatcttgagcaaaagattattaggagctgtaatgctatttggcatagcaattgttgctcttggtgggattgatgtggtttttgataagcaagagaaataaagtcacaaagtgaattgcttgttcaaaggaggtacgttatgtgtaagaaatgtttccctatgccgctggataaaagaagaggggaaaaaaagagtgaccagagcatcggtgttgttgaagtagtgcctccataagggcctcaatttttcctggccaccaacatcccacacagtgaacaccacattcttgtattgaactttctccacgttgaagcctgcatgatgatgatgatgatgatgttaggttgggtttggatttggctcaaaacaaaataaaagattcgatgaggcggagggagggagggatgagagtgaacctacctatagtggggacggtggagagaacttcgccgatgtgcagcttatagagtatggtggtcttccccgcggcatctagcccaagcatcaccacctgcaagccaaaaccaccatcatccatgatccgtccaaaacccaatctgagacgagacagacaagagtggaaaagcttggggtacccgcatctccttgttgccgaagaaggcgtcgaagagcttgcggaaggcctgccccatcccttcttcgccgatcgtagcggccggatctagaagcttccagaagattccgcggcgagcgaggagaaggaggcgggtactcggctggagcctggagcggagccaaagccaagggagccaggggggagacacgagagaggagacgacctacctgccctgccctgcccgtcgtggattccagatgccgagccgaataatctgggccgtccgatctgtgcggggcccacctctagttgagtgcattacctttcccttttttattcatttcatatactttgaaatcaactttctagtaatattcatccattgggcctagaggtagcaagtggcaacggcttgcaatttgtagtgtgtaaagtagtaccgtaaagcgctttgttacgtgaattacttaaaaaggtttttaatattttttcaacaattaagctagaagcaaaagagcaaaatgaaattaaggaaatgtcacagttcattaatactaatcgtgaaaaagacaaatgatatccatgctttgatgcagaatatattgataaatatatattaagtattatagatatgatagatatatatgttaaaatattgtggcttgtggaaaagatgtgaaggatgatgattgaatatgtttgcatttcggtttgtagaattcaataaatcatagatgaggttgtatgcttgaatgaggtttgatgtgtaattattgctagtggataatgatatggtatggttacatattaagttttagacttagtgggttgtaattttatatatggtatacatattaagttttagacttagtgggttgtaattttatatatggtatagattatatgactaatgtactactgacatgttaagaacatcaaaaattgataatgtgtatagtactgctgcaaattagtacacaagttatatgtgcatagtagtactgacatgataagaggtgcatcgtaatacttaattagtgtgttcaataattatttgtcgattttcttaaataaccattatttgttgactaaatatgtctttcaccatctttgtgcctttggaggttcatggcttgcaccaatttgattgatatcatttttttatttatatgggctttaatcccgtgactatgtaaccctttttaattggtaaatagagaatcgatcattgtacaatgcttagcaagtgatcggttaccccgtagcaacgagcgagggtatgtgatgaggatgttactagctcgggtatggttataaccatacttatattacacatcaacaatctaaaagtgcatatattttatataaggtttacttattatatgtttgaacaaatgttactatatcatgagttttatatcttctcatatgcagtaggaattgaaccctgtatacgaaaatataatcaaatattatcaaggaaagttttctccatagacttaatgtgacacccaaaagtttccactataaaataatatggcattgcataaatatagagcaaataaggtaacaaatatttattaaaatatgaagaaatctaacctagcttctcaaatcaacgaaaagatatagctcaatatttttctaataaaacagtaaaattatatttctaattttttatcaattaataataatagaactaattatacactttacttttctggagacttacaataagcaaaactacattcatatataactataaccagtatggaatggctttaaaaagacaaaaaaaagtcattaggcaaaagaaaaacagttctagagcattgggctagaaaaaaaaaatcccattcaactgatcacctcaaatatataattatgtacatctagaatagataaggctaaagattttatcctatatatgataaatatatatattttttccaattcccataagaaaatccgagttcgtttcaggaatgcttctgtccgattcctatttcgacagacagtgatctaaccgtattcgtttccatttttgattcgaagaaaaaaaatgggaatatgtttgtttgaaaaaatttatgcccgacacttttcattttcaaaagcaggtgaaattttccaaacagttttcatcactacccctaaccctcaaaatcgtagtcttggtgccaccagcccaccacgcgacgcgatggccgttgtcttgacttgctcgcgctcgctctccggcctcgaccctcctggcctggcctcccctcgtcaaggtcacttgctcgtcgccagcaagaggtacaatgcaggaggtgggggcttcatgccgttggatggatcccgcgattggtgcggtgttttcgacggtactgtatgttaccaatcatatacggggtaaagaaaatactactttttgcagtgcgtggtccccgctttccaccttcttttacatacaatactgtactacttttgtggctggtgtgttccagaacatgccgtccttggtgttccccctttattcccccgcgcccctccgcccccaccccccgcttagcctcgccgacacggcggcgatggcgtccacgccgcagactaaccggaagctggctgttctacaccatgccatcggcgatggatgcacagcggcagatgaggttggtgtgtcgagcaacaagcccgctcaagaagagcttgcgagctcaatgtcctatacatatctcatcctgagttgcggctcgtcgtccggatctcccatggtcggattcgcgtaagcgtcctctgccccgtgctctttggatgattgcccttatcagctagctgtgtctcttttttttttctttgtccagtcttggtggtgagccgataggcgatagccctgttttttctttgttcagtggagattgcccgtatagctacttgatggagattgtggaacagcaagcagcgaatgtggggggcgtcgtgcagagtgatcttactggcgtgtgcgaacaacaaaaacatacctattctgaccaggagaattgctatgcagagaatgcgagtgagccgcctgagtccagcaatccttcgtggtgagtttgttgtttgtcatcattttgcgaaacagaaaatggtattgcgagttcgcgttctgcgtttcgtaaaactctttttttttttgccaaaacaaaatagtgatgcatattatgactatgttgtctcttcagattgggttgtttcttcggatcaggctgtagatgatgatatactgtcctttggatcaagctgacggaaggtttgtttttttgaatccgtctctgcattttgaagtttttttccggaacaccacttgtggaatggtaaaaaaaaaagagcatcttttttgcctgcagtgcttattggttgccaacattgaaagagagcactcctggcgccgcaatgctaattgatgagatggagctgaggcaagctgatgagcagcatccaggcgttcacgccccgcaaagtccagcagccgtgtccggtgtcacccgacgagctccggactgaccgcggcctgctcgagcgctgcgacaatctgctcggcagcatccttcccctgcccaaacactacgattttcattcgtactgtgagcggacgccggcgagccgagacgaaggaacaacacgagcttcttggaggtccttctccatccgttcattggcagacgctgagacgaggcaggagcacgcattcttcgtcgccgccacgcaagaactccagggcttttaaagtttcaattttttttagcaataatggtgaacgaatttgtccatggttgcttgtttttcccatacattttgttggacgaaagaaagaaacctacagcacatttgtttttgcacattctgattactgagatgttgtttaaaaattattgattataattaagaccaagcgagccaatttttgggatgaccaaaattgattcgaacttaaataaaatcttttttttatctgagcttatttgttattgggacatctaggagcacacctatatgtgtattgctctctgggcttggtacagtacctgcttcctctgctggcaaaggaagatagcaagatgaagttgagagagtgagacttcaaaccaaaagacctcgcttcttttttggatgtaacttcatttttaaattttatgatgtttttttttctctctcgaatacttttaaattgacgtgtgacgaaggtgttggtccaaggtaattaggtctccgtgcatttttttccatgtcttttttgctcctggttagccaagcgtggtgtcatgttagctgcaaattgtaaaaaatgtaaccgtcggagtaggagtcgagggagaccggactccgttgtgcttgttggaggggatgatggcgccattggaggggatgacaggtgtgtactgcgcgcgcatggccagcacacagcgcagtgagagcgccaactttatgctgaagagcataatgcctagaaactccaccttgaaccgtttcatcgagcagtttgcaaagctccagtttgatagagagagtgatgatgccaacgctgagaaggctaacaaacaggtattgtgtttaaatctaaaaaaaccttccttctcgattttgtaaaaattttgagcccacaatagttaacctgacaaaagaaatattgcatcgtgttgcagaagaggttgtggttgaagccaacgttccctgtagacggagaactaggggaatccacccagtacgttgtcaccggtcatgtggatggagttggtgctttgagggtaaggccgtgtttagttcacccctaactaccccaaacttctaaatttttatcacactatatcacatcacacataaacttccaacttttttttccaaatctttcaatttttcctaaactttcaactttttttttaggatctaaacacactaaggtacttcgatgcagcccgcaggaagtcatggtgcagagttgaatttgaggtacatgttgatatgtggagcagaagttttttttttttattttcaaccaatgtaatttatgaataaaaatgaaccacacaaatctataaggcatgtggcgcccattttcttccaatgctgatgtacattgcgtacaaacccagctgataccgtagacgggtgtctccccatgcttcggccgccccgcaagcgtgtcagcatccatcttagcttctggtcaaacattgctaattttggctcgacgttttgtggaatgctcagctccccctcgaacgcggcattgtccaggtaaaggatctaaagaaaaaaataaaacacggtggatgagtgatgaataacggtgcttgtttgtgttagcgattcatgacggcgccacgctgaacttacctgcaaaagcagtgagcatcccgccttgttcgccaccttatctttatgcttgatgtcgtgctgtgccttcggtgcaacgtcaataaggtggtcgatgacgtatttcgcccaattgtagttcttgatttcttccacattaaggagtgccccccagaagtcgttcgatccagatttgtgcgacatcttcggtgcaagaaacatgccgacaatccacacaacaaatgtggtcctaaaatggtcctgagcccaattgttcatggcgctgggaaatatcctcttaattacttcctcagcacccttcagtgcgttggactcgaagccaggagcactgatataatattgcacaaaagagtctttctccttttttgtgttgtgcggcattggacacacctccatgccctcaaatggaatgccaagcactctgttaacattcctaggactgattttcaactccaagtgtttcgatgaactcctgctggttgcccctcgagcttcccagccggctgtgttctgcaccggcaggtccgtgggtcccctgcgatggcaggatccccttacattgaatctgactcgagagcgtgtccagtgcctggagcccatgatacagttttagccctccgatccatcagtcatatgctgtggataggcaaaaagaaaaaaaatagtatgaattaaacacacagctacacaaatgcttatggattcacaggaaaaaaattgctaacgtgatggaaaaagaaacaaaaattaacaacaaagctacgcactgcttgtgcattttcacggaaaaaatacaaatgctaatgtgatgaaaaaagaaatgaacacatccatgcatgtgctggtactgtgcgtcgcggtatctgaatggactaatgtggcatcaggggatgggggtggaggggaaattcctgagtggtcttttacggtgcttggaaggtaccctaggtacctctttaacgaactgttatccaccgttaatcttcaaagggtaatttaggaacaaaaatttttattaacaagggtagcttagtaattacttaattctcaccccgtcgagtgcctaaccaatcggccatccacgatgtcatgcaggtggcgagcggctcacctcaatcgatcttcagaatatgtacgtagtgatcaaatagccaaattaggcgcagaaactagcaggggattggatgcgcagcgcagggcattgttgatttgtttttgctggcaaaatcgatcctcagaacctggaatacaactactggatgcatgaaggcctgacgacaaagaacgagcaaggaactagcagagcagacagcagcccggggattcgtgcggcggtggtgatggcgacctgctgctgcgtacctcagctgcgaccggcgggcgctacgggcgcgtgtgacgacggcggtgacggtatccggctgctgctttcgtacgctaggaccggagggcgtgtacagcggcggcgagcggcaggcttttacggcagcgacgacgaccaacaggtagttcatgtaggttcctctcgcacgcgttcttattcttcctctcttttttttcttcctcctgctgaaatgtttgtagcttctctcgcttttgcccttcaccgaaaaataatttaatgaaaatcaattaccattttaccctttcaccttacatacctagcccatacttttaaaacctttctccaggtactttctctctctatccgttagatcattgctgatcaagggtcctaattaattctaagcattgaagaagatcttacctgatggactcccttggacattcgtcggccggatactcgacgagaccggacggtgcgccgattccgccgacggaagatgcaatggagatgcggggcggcagccactacagcttccaggaggatgcgagtagtgcgtggggccggtggggcgggggacggcgccggtgggcggctggcgaccggcggcggtgggtgtgggttcggtcatggtggctctcagacgatggagagagatgaaaactggaaagggatagaatgtatcgaacggatatgtggcggaggatacatggggtcgtactccgtacacacgagctggtcccgcgtactacccttccacagggagtctgggaatcttacggtgggtcaggctgtatttgagcgagcaataaaaaaaaacaaataccatgctagcccatacatatactatctgatactgtaaaagtgtgcacgaatcttcaagccatcgtgtggttgtcagcctaggtgccgcagcacctaggtgctaaaaggactttccggtacaatgcaatgctgccctggtcgtatatctattgggcttgggcttctctgtttctgcccttttttttgacaaattgaccctattggaaaacttatttcgaaactaacccctgccaaaaacttcaaccaaaaataggccgtcgcctcagcgccaaacacattggcgctgagattggcagtgtcagcgccaacgggactggcgctgacattgtgccactgtggcggccgggccgatcccccagctgacgtggcagctacttcagcgccaacctgcctgacgctgaggtgggacttggccacaacgaccaaggtccagaccagcaagccttctggatggcttgcgggctgggacctcagcgccagccataatggcgctgaccgtgggaagctcagtgccaaccggcctggcgctgaggtgggacttggccgtttcggccatggcccagcccagcaagccttctggatggctgggctgggaactcagagccaggtgcactggcgctgaggttggacatgtcagcgccatttatcctggcattgaggtcccagccttgctaaactttagcaaaactttgcacacaacacaggcaaacatcaaatcacataaattcacaggcagtaatatatccagagaaccatacagaacatacatccatccatcaatcccaacatcattccatacatccatagaaccatgcatcaagtccatccatctatcgaaccatgcatcaagtccatccatctatccatccaaccatccatctatccatccatccattgaaccatgcactcacctcctcctacctctagtgcgaggacgaggcacgtcgggggtgtacctccagtcctgcgaaggagcccaccggcgtcgtggttgagacgggccgggctgcgagagatccggctgtgacgactctggtgcgtcctctagctgcgagggaccgagctcatgcgccttctcttatttgtacccctcctcttcttcctcctcatccccttcttcctcctgatctgcttcctccgcctctttgtcttgctcggcctgctcgacacccaccttcccttgttcatacccctcttggtgggcatgagcatgttcaaccacatcagtcgacctgcagccgagccttgctgacaacttccgacatcgctgccgtagtctctgcataaaaaataatccatgttaagttatcgcttttgaaagaaaacaccgtattttcatctctttccaacgattacctgtagggcgttccgaagggtgccgccctctccttcggagccaggagccgtgcctagcgccactcccgcatcgttgacggtccgcaagagctctcgagcctgtaggattgaaatgaagtaagtcacaacatatatggcattgaaatgaaataatatacaatattaatgctagaaactaaccactctgtcgcgaacaggtcccgtctcgaccgtggtacctagacgggtacgagtatcgtactcgttctgctcctcaacatcctcggggtcatccgctatgtcggctagtgtccaggccggacgtaggacaagacggtagggcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtcaaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgctgcatcacgcggtggcacatctggaactccactgcatagaagcagatcagtgggcaccgtagggtcttcaacgcatcctctatatggcacatgggattcagttctagctcgagcgcttcctgtgcctgatatggcatccacaccacctgcagcaacaaaaataaaacccattgaagcacatttagtactatatagtaagaaaccatcttcatgtgtgatagaaccccgaatagcttacatgttctggctgtaggtagtccatctcttttgtgtagtggtagtacgccaaattcctgcggcctactactggagatgggaccgattcccacaggtgagctacagagggacgtcggtctgcatcctggtgcggccaagcctgatgggtcctccacatgggccgaccaactggaagcctcatccacatccaaacctgcgtcacatacgttagcttccaacatgttagcaagaaattgaaatgttacgaaacataacatgcgtgaacttacctgtagcaaccaaacacagcatgctaggttcacgtccccgccttgccttcggcaagcatcacagagttgccgttacaaccaggctagggcagccgacccccagctgaaggtacccgcctcgtcccagtccgcgagcaacggcagccacatccaagaagccatgtctccaccagagtcagggaacagaatactgccgaagatgtatagcacatacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtgaccggaaattaaatggaatcattagtaattgcaaaaaaattaacaaatgaataggaagactcattagtaattccccgatgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgtgccatggtcacgaacgccaagagcttcgcccgctgtaggtacgggacgtaccagtcgtcgaatagtatgtgcgccgtgtgacctcttactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgttctgctttgaggctcttgaatcatgatctctctctctatgtacagtgtaaaaaaacaacaatatttcataactggttaattcggagtattcatttttctttctttcaaaaaattatccccttcagtcatagttgtttgatgtttatgacagaattcgattaaacttttaaaattatggaaaaaacttatcttaaacatcaaatatttatagttgtagtattattctgcatatgcacaaatgaacagggcaaagctagcaaatattaacaggatagcatatgcatatgcaacagcaacagggcattgggccaacttcaaatattttgtgtgtgttttatttgagatatctctatgatggatgatctatctgtacaaactaaaatcatagaagaaaaaataaattcgatcataaaaaaattccatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggaggacaacagaaagtaaacattgaagcaacaatatgaacttaacaaatgaatgacatccaatcccacctgtgtgctaccctcaccacctccccccgtcctacggcgctttttcggtcgatccttagacatgtctcgcttcgggcacctagttttcttatggcctagttcgtggcatagcgagtatctattttgcatgaccggctctgaatttgtattgttcggcttttgtgaccgtcggttggctgagcctttgtatgctttgtccatgtcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggggcatggcaagtgatggagctgagggaactgacaactacatgtgttatctcgagcaaccacgacgtagtgacgtccaccccattgaaccccagccgccgtgactccgccttgctcgctgacctcatacttcatcgaagggaaatcaaaacatgctgctctttgccccaaggttcgtctttgttgctcctccaacatgtccttaacttttgtgggccacttctttccactcaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatggcgacgcccgttggtatcaaatgctcttgcccatttgaccttaagtggcatgtggtcttctagccacttctttggcctctctccgaccacacccatgaggcgttttatctcatctaggaaaaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcagcttgtttctcaacatgttgatgaaccactcccagttggatgtattctccttctctaccagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgtctctgtactccatccaccatcctggacttctcggggtgagcctcaacacggaaatgcatggtagggttctttgctttgatggcacgcatcagtgtaggcaagcgaacatacgcctcgtcccaatctccccaaatgaccttcatagcatcttgcttagcacgccatgctttgccatacgtaggccgatagtgctatatttgctcaactgcctcgacaatcgctgctggagataaagtaggttcagctcgcacaaatgcatgtaacctatttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtggatccccatcagcaattgctagcccggatctggtaagattctcgaattgtgttatttccgggtttctacccaccagtttcgcaaacacagtcctttcatgctctgacatcttacgcactagacgatcatcatcggagtcggaagcggattcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccagcacattctcctccacattaactttctcccttaacggcacattatcctctgcatgtacttcctcccttaacggcacattctcctctgcatgtacttcctcccttaccgggtcattctcctccctgacctccacatccgccatatcatttactccctcgcccccctccacgtcttcctcaatcaatttttccttcctactacacctctccgacagttcgtgacagttaatgggtgattctatgagtagactttcattaaggtctataagttctttcttccctatcctaccatctttcttccatgcaaacacctcaagagatttgaaatgtgaccccaatactatatctatatatgtttgccattcgatctctccattcaagtctaacataaacttatgtgacatgacaccgccgcccacatcgtatctcccttgcataccaaccgactcgtcactccaatccaattcatgcttgatgcgagacattaactcctcaaaggtaggtttcacagaaaacactaattgtctaactgtcattccctcaaattggcttccatgtgtactttcatctaccacacaaccaccataatgaagccggaccaatctatccatctacaatttttaacccatgcataaaaattacttacttgaaaataatatgtaattaccattgcaataccaatacttcaaaagctaacaacatgtctaatttttccaataaataagtaccttactcaaatactacacattattgataaaaaaaactctactcctacaaattacctacccttcaccacacatcaacccctttcaaaccctctcaatcaccacaaatacatcccacatcctaggccatcaccacacatccatctcccatcaaaccctagtgcatcaccaaacattcatcccaaatatattttgtcaaatgtatcaacaacaaccaaatggataaagatatgccacctccacacttcatccccacccacattatccatctaataatccatccttagccaactattatcaaaccacgtctacaaccaaaacaatacaaaatatccaataaaactttggggaacttagggtttatagaggggtttaccttctcttccgatcccaaactcaatgccacacaaatcaccttcgattagagaggtttttgggggagattgggcgaggagaacgcggtggcgaccgaaccctaggcgggcggctggggaaaaacagaggactaactggctggggcggcctcggccgggctcaaagtagccaagatcagcgccaacgtacttggcgctgatgttgggcacctcagcgccgaagcggttggcgctgaggtagctgccacgtcagctgggggatcggcccggccgccacggtggcacaatgtcagcgccagtcccgttggcgctgacacggccaacctcagcgccaatgcgcttggcgctgagccgacggcctagttttagttgaagtttttagcaggggttagtttcgaaataagtttttgaaaagggtcaatttgtcaaaaaaacggctgtttctgcccaaaagctaccaattcgatcgtatgcagaaaagtttgtcgtcagttcaattccctggattccgatgttaaattcagaagcaaactataggctataggtagaaagatacaagatgcactgcttgcagactatgtatgatccatcttacagatgagatgagatatgcgtgcgtatatatggtatgtctatgatgatgatggatgaacaattaatggtggaggaagaagaaggagatgatagtggtagtggctagggatgagaagaagaatgcggtggcgagggcttcttggacttgtagcgggcggcgagcagcaggtagagggcgaggttggcgaggctgatgagggcccagagccagaagtagtagtcgaggtgggccgtgtccaggtccggcgccagccagccgccggagccgtcgctcctcttggtgaccgccgccacgatggtgacgacgagcgagttgacgtataagccgagggagagggcgaggaaggagaaagcggagcagatgctgcgcatggacccgggcgcctcgccgtagaagaactccagctgcgcgatgccgctgaacacgtcggatccagccagcaccacgaactgtggcacctgccacaagatgctcatcgaccgcttctcccctcgcagcctccgcctctccaccagagcagccgtcgccatggccaccaccaccagcacacgccccacgcccatccgctgcagctgcgtcagaccacccgagcgccaccacctcctcgccaccggcatcaccaccacgtcgtggagcagcacccacagcagcatgaacaccacctccaccgacaccagcgacgccaccggcacccggaacctccccccgaacaccctcgtgtccatggccatcccctgctggatgaaggtggtggtcatctgccccagcgacgccgcgtacagcacgcacgtcacccagatgggcactatccgcgccagcaccttcacgcgctccacctcgctcaccgtgcacacctcccacacgccgcccccgtccaccctcacggcggccttgtccagccaccgtaacccctcggtgtgcgccagcttctcatcatcgccgccgttcttgttcttgtcgtcgtcgacttcgtacaggccatcgccgtcggcgtcgggaggcagcgtccgggtcctgttcctgaaggcggccaccagcaccctgaggatggccttgatgggggtgtcccccgtggggaggcgcaccctgtagcagggcgtggctgccaggaacgccgccgacgcgatgagcaggcagagcgtggcgatgccgaagcccagcgcccacgacacgttctgctccacccacgatacaagcgtcccggccacgaagatgccgaggttgatggcgccgaagaaccagctgaagaaggattgcttcgtcttctccggggccggggcgccctcctgatcagtgtcgtggtcgtcgcgctcgtactgctctgccccgaaggggagcagcgcagacttgacgccgcctgttccgatggaggtgaggtagagcgcgaggaagaagacggagaactgggtcccggtggccggtgagcatgggacgccggtgcacggcgccgggcgcagggaggggacagcggcggagacggtgaggagcacaaggccctgcacaaggcccgccctggtacgttatccatctccatgctgcatgtatggatcggatcgagtatgaaagagcgaatgacttacggcgaggtagaagaggagggaggcgaggatggtcctgtactttccccagtaggagtcggcgaggaaagccccgatgacggggacgatgaaggtggtgccattccaggtgtcgacatgggcggcgttgaaggcgagggtgccgtgaaggacggtggccaggtacaccaccaggttcagcgccacgccggagaaggcgatgctctccagcagctcgaaccccaggatggtggccggcccaagcttccacttccacctcttcttcttctcatccctgcccctgctacgacttggtggactacccatcatattattcatgctcatgccgcccgccccggatctatcccctaccaccacctttctagctagtatctcatttcacgatacgaggcagcgaggtcgtaggctcgtagctaccaatatatggattctgtactaatcctcagctgctcctgctcgatcgtatatcatcatcaacaacaactgtccggtttaattagtttgattcgataccatcatcttcttcatcatcatcatacatatcgatatatatatatacactcgactccagactccagtactagtatatatgcgcgcgcgcgatgacaaagtcaaagcaccgcgctggctagctggagaaaactgtctatcgtcttaatctggcaggacatgaacctgattgagaatggaaagccgatatctaactcaactaattacaaaaatgctagctcgtgaatgataacaataaatagtaattcttttagcccgcgcaccattttaaacctattaagagatttaaaacatggcgatgagctcctttttacgctaatttatgtcacgtcgaacatgttttcagtatcaactaaagtggcgttgagaaattttagctgaacgccatcgggattgacggcgtttggaattagtttttgacatagtttatttttaaaaaacggtcaatttatcaaaattacggtagtcataactaaccgatacgtgtatgtgaagaattaagagaagcagccacaaccatccatgtatccagcttgccaaccaccacctccgttacatttttggataaagatcacctccagtacatgcgtatacatgtgcaacgatacaagatagcatagcaaagcaactactactccacacccacacagtggtcaattcatggtggtagttgagcgatccatccatcttgccatcccagctgcagctgcagctaacttggttaatttgcctttgcgtggctagattgcttcccttcaattcaagctatctatctatctatgtattgtatatagcagcaacctaacaacccaaaatgcatttcgatcgaaccaatttggcagcatggcactggcatgcggcttaattcaattaccagcagctgctaccacctgaaactatgaacaaccctttccctttcagactgaataatcgcgtccaactcccagagaaattaagctggcctacagctgactatatttatctacaattaatcctacttgtaaaataaataatactacgtctactgctctgttttaagtcatggggtaagacttgtagttaagatcgaataccactagtattagtatacgaggatagttagtcaggcacgttggattcggccagcagccaagcatcaggccaatagcaatatactccatagtactccagtagtgtatacacacagacgacgacccaaccgcactcagtcagtcagtagattaattgattgatcgatccatttgattagattaatgagggcagcaccgttcgctaggctcgatcgatcgactaaaactaatcacaggcaaggcaaagcacccaacttaatttgtcgttagaacttcttttctccaacgatctattctgacttcctactggagtaggactatacatcaaaaataaatttgcattggccgcttaattacattactagtggtagttaattataataattaaattgcttctctgaagtctggaactagaaacctcaatattattcaggggagagaccatgtgagccacgtgaagtgcaaacgtactctctactgtaatcacctgcttagttgcctaccaaaatatctcttagtcaactggaactgctggaattgaatggattaaaaaaaattgcacgtcgcatgcactagttgggattgaatctctacctctaaaattgatagaagttcatatgtccgtgtcgagcttgcttccgtacgtgtggaccgtgtgaaaatggcataacggagaacccaaattcatagtggctatgttcggcagccatataagctacagctactgcatcataaattcgctgtaaactacagcaattcttaactacttcctccgttcgattttaattttttatttgtactgtttgatcacttatcttattcaaaaaatttgtgtaaatataaaaaacgaaaagttatgcttaaagtattttggataataaagtaagccacaaataaaataaataaaaattttaaattttttttgaataagacgagtagtcaaacagtgcaagcaaaaagttaaaatcccttatattatacttcctccgtttcacaaaatagacgcnggacngcnggaggccctgccttcccttttggttcccaccctctattggatggatggatccattctttctaagggagattgatgaaacgcatgtatatt

SEQ ID NO: 3561 - DNA, 3375 bp, Oryza sativa
  unsure (1)..(3375): unsure at all n locations
attgggggggggaaattttggttttagcccccttttgaggggggataaaaagggccaccaccctttataaaggcgcgggcccgccaaagaggnngngggggggnnnccctctcatttttttcacgggagaatttcccattgggggctcttttccaccccaaaaaaccacgccaacccaaaaggtttttccccaaaattttgtaaaatggtctcaaccccctcggccggtggcttctttaccattgcagcagccggcgcgcgtgaatccatgcagctagcaacggtgtgagatcccgtacggcgcagggatggcgatggcacgaatccagcaaggagatggcagccacgtttgcgtatggagaacccaactgctggttgaatcctcgcatactaatactagtggtattcataaacttcaagtcttattactactccatgacttaaaacagatcgagattcgagcagtacccaaatccatggggctcaaatctgatttgagggagttgggcatggcagcaactagtagttggattctaccacattcaatccaactatagccaaagttcaatccatgcccttctaccgcgaaaccagatatagaggatcccttgttccgtgaaaccagatatagagtgtccctcaattattaaaactagatcaatttaggttcctaggcggttgtgatggtggttttgtcatgcgtgacgtcaatgttggcatttcaattagaataaataaataaatgaaatatgcagaccttacatatcattggcatcttcttcctctgccctctctctctctcatatcctcttatttctctctccatcggtgggggatgggcatgagataaagcgttctccgtcaacgggagcaccatgccggagcatgctctcgatgacagccatgacgttgaccagggcaaggaacaacgagcgtgcggatagcctactggagcccattgagctcaccattttgatcaccaatgccgcccaagccacactgcccgccggatcgggaggcatatttggtaatgctgcaccccttcaccaccgggttgcactcgtcccatgctccttcaccaccaggagtgccttgagcaagaagggggtggaggagggtgttgtgattcagtcagcggcgtatgccgcacaaagaaggctgcatgttcacagcctaggaggacctagtgtcccagaccatcgagcgaaggaaggcgactatggtcttatacacctcgatggttgtcgttgtgccgcccacgacgagaaggctacaagaaggcaccggtgctagtgagaggtggtaaaaagggctcttgcaagtgggggacattgtaacaaccggccctctagaacctcgtagcgcaacacatccgacgggtgggcacacttacacataccacctcacttattctttcatccttgcttcatgtaaaagggttaacccgagagtgatatggttggagtgtcatgcctttataaattggtttcacccttgctaaactagtattgtggtactaaacatacgcacacaactctcatgggctacataggtcacgtcctaattagcgtatgacatgccatgacatgtgcctcacgcgccatatgcccacacattgattcatacgcacaatcacgagggtcggctacgcagacagttctcatgggccacataggccacatcctaattggcgtatgacataacatgtgcctcacacagagcccacacgtgtcatgcgccatgagcccgcacattgattcgtacgcgcaaccacgagggtcagctctgataccatttgtaacaacccaccctccaaaaccgcagagcccaatgggtcggcccacttacatatatcatcccacttacactttcgtcctcgcttcgtgtaaaagagttaactcgggagtgatatggttggagggttaggctcttataagttagttctacccatgctaaactagcactgtgatactaaacatgcgcatgcagctatcatgggccatacatgccacattctaattggcccgggatgtcacaaacatccacaatgatgtgctagagcgtgtcctggacagtcgcacaccgcaccaggagcttgagcttgactagagtacaccgtcgtgcaaacctgcttctccgcatgccaccaccctcgctaatgtagtgagcctgaactccgccaatgatgatgtcaatgctcgtagatccaacaagggcgcatgggatgagacgcgcggaggcacgtagggtgatgagataactatcgttgcccgcgtgcatccaaatccccatgtcgttccgccaccgctgacagcggcggtcgagcttgggcacaaccacccttctcattgcctgtggtagcgcacggggacttggtagtgtccattggacttcaccatcttcttgctccatggggggggggtgcgttgtcaccttcatgtccatcgctgcggccgtgcaactccccatccttcctcctcactcccgcctttcgatcttgctcgtcgatgggcacgagcaggatctccggcggcgcgggcggcagcggcatcgtgttcaccatcgccaactgtggctagggagggagaggagggaaggggaagaccacatagcttgcgcccgccgttctttgagctcgttgcgctccatcactgcccacctttagtagtgagaaagcggaagtggcggtggccgatcggtgagggagcatgaggagggagggggaatgttgggagagagaggggaaagaaggtgccgcccgccaggggagatagagaggtgagagtgaagtgggggaagtaggacccactgacaagcattttgtttatttttttaattttgcttataatgacacttcaacaccgcacgagacaagggctaagtcaaaacaactaaccatgtaggtatccaccaaccaatccaaaccgtttttggatcttgtctgcactagttttaggatttgagagacgtgttatatctggtactgtggtaccaggacgtgattcaaactctacgtcaagacaagggatcctaagtgaacttattccttgatttgcaggtgggattgggaagaggatattttcctttccagtgggttaggttgggcagcggaatgataataggcttttggcccatattccattccactttttaaaaaaattcctcatgcatttgggctgttaaatttctgtccttttcttttgtgagggtaagagagacttattaattgaacataaggagcataacaaattttcaagcaataggacgtttggattaccccccgggtttccccagagtcgactccagctagccaaagagcactactacggcagcgtatagcatgctgagctagctcatgtgatacctttgtttatt

SEQ ID NO: 3562 - DNA, 28976 bp, Oryza sativa
  unsure (1)..(28976): unsure at all n locations
tgtgaatgccctctggttggccagtagttcatcaattgagaaggcagaagaagcaggaagacaagctgaagacttgggccgtcatccagctcgtctgaggaggcccaataccaaggtccaaggcccagactgggttgcgtgagtcacttgctcgcctgtgagctggcgtgatgttggtgttagttaaatactggtctgtaaactgaattaagacattgaattggcaactggaggcgtaagcggcggcggctcgatcctgttggatctgagaggaaactatcatagtgttgccaaattatgtgtgtgcttgagtgaatccttgtgagccctaacaatctggtatcagagcccttccgtgctgcatttcctcttgatttggctgtaaatttttctccagagcgaggtgggatttggctgcttcggcggtgagaaatccacaaaagtttcggctccctcaatctggttggctaaattcggagagcatgtgagggattacggtccaaaactagccatggatctagacgccaagtttgatctcttgttcaagaccattgctgacaacgagaagaagaggatggaggcggaggagcgtaccagggcggactacttggagttgaagaagacggtcgagggccgcataccggcgatggagaagaaggtggaagaactaggtgagtcgctgcagtccttgagcaccaaggtcgagcagctggaaggcaacacgatgcggcaagtcaagtttgaaccattctctgctgcaagtgcttcgggtgttcaaggaggagctaaggaggagcagttcggaggtgttgcgggaatgtttactcctaatggtacgcctgagaaattttccccttcccctattcctttcaattgcgattcggcatcacccacttttggtaacggaatggggacaatgaatctaagtagtgctattcctcctatgacttgccctcaatttactggtgataacccccaaatgtggaagtcaaactgtgaacaatattttgatgtctatggaatattgccagttcactgggttaagattgcaacactcaatttttctggtaatgctgccttttggtttcaatctgttagaaatcagatgagtgggatttcttgggtgtctttgtgtgatttggtatgctccagattttttaaggataggcagcaagctcttatcagacaatggttccatattaagcaagagggcagtgtttcagagtatgtggaaaaatttgatagtctgatgcatcagttgctagcttattacaactccctgttgcctgtttactttgtgactaagtttattgaagggcttagaagtgacatcagaatggtagttttggttcaaaggccacaagatttggattcaacctgctcagtcgcattacttcaggaagaggctatggaaggtgttaagttccagggctacaagagaccaaacaattcagttatgattagaaacaactcaccagccccgatagttggacaggcctccacaccccagaaaatcttctctcctcaaattactgaagatagaaggggcactgaagctgcaagagcaagagatgacagactgtcagctctgaaatcctatcgcaggtctaaagggctctgtttcacctgtggtgaaaaatggggtaaggatcataaatgtgccacagcagtgcaattacatgttgtgcaggagcttcttgatattttacactcaaaatctcctacataaattgaatcttctggtggagaacaagaaattgatgaagtgggagatttgatgtctatttctcaacaggcagtttgggggactgaatcctctcgttctatcagactcatcggctgggtgcagggtactgaattattgatgctgatagactctggcagtactcattcctttatggatgaaacagttggttctaagatggtgggtgtttctccactcaggaagcccttgtctgtgcaactagctgatggtgggtccttgttatgttcccatgagattgctaattgtaagtggtggatgcaagggcattctttctctagtaatttcagactcttgaacttgggtggctatgatatcatattgggcatggactggttggagcaattcagtcctatgcaggtggattggtcacagaaatggatggaaattcaagttaacaaccagcctgtcaggttgcaaggtataacttcccagactaacagttgcaatgctatctctgctgaacaatgcttgggtatggctagaaaggggtctattctgtatttggtccaattgacatcttctgtttcagaaatctgtgacactatgcctgaagcagtacataatttacttctcaagttccaggatgttttttcagaacctactgaactccctcctaagcgatattgtgaccatagtattcctcttgtacctgtggcaacacctgttaatttgaggccataccgctttaatcctgctcttaaggatgagattgaaaagcaaatttctgatatgttgaaatctggagttatccagcctagccacagtgctttctcatccccagctctgttggtcaagaagaaggatggtacttggagacttgtcattgactatagaaaattaaatgccattaccatcaagggtacttatcccatgccaatcattgatgagcttttagatgaattatctcaggctaagtggttttctaagttagacctacgagatgggtatcaccaaattagaatggcccctggtgaggagtataagacggctttccaaactcatactggacactatgaatacatagtaatgtcttttgggctgacgggagctccggctacctttcaaagtgcaatgaatgatactctgaaaacagttctttgatgatatcttgatctacagccctgattttgagtcccatctggatcatattcaccaagtactagccttactgtctgaacatcaatggaaggttaaattgagcaagtgctcatttgctcaacaacaacatacttatcttggccacaccatcagtgctaccggtgtccatactgatcagagcaagatccaggaagtgttaaactagccagtaccaaccactatcaagaaattaaggggtttcttgggattggccggttactatcgaaaatttgtgaagggatttggtctcattagtaagccccttacaaatcttttgaggaaggatgttccttttgtgtggaccactgcaactgactcagcttttaaccagcttaagtaggctctggtgactgccccggtcctagccttgcctgatttcaagaaggtcttcattgtggaaactgatgcttctgaagctggtattggggctatgttatcacaagacaatcatcctatcgctttcattagtaaggccttgggtccaagaacaaaaggcttgtctacttatgagaaggagtgcatggcaatcctcatggcagttgatcaatggaggtcttatttgcagttgggggagtttattatccttattgatcatcatagtcttatgcacctttctgaccaaaggttacacacaccctggcaacataaagctttcactaaactccttggcctcaattataaaatttgttacagaaaaggtaccagtaatgctgcagctgatgctctctctcgcaagtttcaggatgataacagtgaattgtatcacatttccagctccaccccactctggttgcaagaagtaacaaaagggtatgctcaggatcccttttcccttcaattcctcactgaattatctgtctgtccaacttccaggaagcatttttctctctctgctgggttactgaaatataagggcagagtttggattggtaacaatgataatttacagcttcaactcatgtctgcactgcatgacagtcccattgggggacactctggctttctagttacttataggaaaatcaaacaactgtttgcttggccaaacatgaagaaaatggtaaaaacctttgttcaccagtgccaagtttgtctccaggccaaacctgatagagcaaagtaccctggcctccttaaacctctccctgttcctgaaggagcttggcaaactatatccttggatttcaatgaaggattgcccaggtctgagcattctgattgcatcttggttgttgtagacaaattctctaagtacagtcacttccttcccttagctcacccatttttagctctatctgttgctaagctgttcatgaaaaatatctttaagttacatggtttgcccctggttatcattttttttagagataaggtttttactagccaactttgggaacacttgtttgagggagctggcaccaagttacatttcagttctgcatatcatcctcaatccgatggtcaaaccgaaagggttaaccaatgcctggaaatatacttgcgttgttttgttcattcagttccttccaaatgggctgcatggttgcatctcgctgagtattggtataacacatcctatcactctgccattcatgctactccatttgaggtcctttatggtcatcccccaaaccattttggcattggtatttcagactgttctattcctgagatggatacatggttcaaggaaaagaagttgatgcaacaacttgtacagcaacaccttcaccgcgctcagcagcaaatgaaacactttgccgacaagaaaagaagtttcagaacttttgctattggtgattgggtatacttgaaacttcagccgtatatacagacttctgtggctgtcagagctaatcacaaattatcattcaagtattttgggccttttcaagtgatttagcgtgtgggcagtgtggcttatagactttaattaccacctcatagttctatccacccagtgttccatgtgtcccaattgaagtccgctgttggattctctggtcttgttcaatccaaactgcccactgatacttctacattgcagtttcccttgcatattttggacaggcgtttggctaagaaaggtaattcaactgtcactcaagtgctaactcaatggtctgattctctcccagaggaagccacttgggaagatatggaggatctgcgttcccgttttccagctgcattggcttggggacaagccaattttcaaggggaagggcttgtcaggaagtgtgatcctgaagaagacaaggacaagagaagggagccaagtattgagaaggcaaaagaagcaggaagacaagctgaagacttggggctgtcgttcagctcgtctgaggaggcccaataccaaggtccaaggcccagactgggttgcgtgagtcacttgctcgcatgtgagctggcgtgatgttggtgttagttaaatactgttgaattgaattaagacattgaattggcaattggaggcgtaggcggcagcggctcgatcctgttggatctgagaggaaactatcatagtgttgccaaattgtgtgtgtgcttgagtgaatccttgtgagccctaacagtaatacaatgttcacaagttgggaatatgcgtgttttcatagttttggtctgctgatggatctcggtaggatgtacgtaattctagcagagatctggtttaaaagctgaaagattttttcctgttgcccctaggggttgtattttctcctgctctattcaataaaaaggcactctagtgctattttccgttaaaaaaagatttttgttaagaaactgcagaaggtaatgcatggattcagccctttatttggtttattttttatttggtttatatacatgctcaacgaatcaagtggaataataatacaagaatggttgattggaataatacaaggcagtgttgggtggatgagggagacgatcagtgcgagtgcgggacggcgagtctcttgacggtataattcttggcaaaggcggcgtacaccacaaagttgatggcgctgatccccgtccagagccagaaatagtagtccagatggccgtcgttgaggtcggcggggagccagcccttgttcgaggtggtggtgacgacggcgacgatggagacgacgagggagttgacgtagtagcccagcgagagcgccaggaaggagaaggccgagcagaggctccgcatcgacacgggggcctccgagtagaagaattccagctgagcgatgccgcagaagacgtcggagcaggccaggatgacgaactgcggcagctgccacgcgatgctcaggttgccgccgtccctgacgctgcgcagccgccacgtctccagcacggccgccaccgccagcgccggcaccgccagcaaccgccccacgcccatccgctgcagctgcgtcagccccgcggggttcccggtgtagcgcctggcgatcgggacgaccaccgtgtcctggaacaccacccagatcatcatgaagatgacctcggcggagttgagggatgccgccgggacagagaaggatccgatcttggtgttcatggcattcccctgctgcacgaaggtggtggccgtctgacccaaggaagccgcgtacagcacgctggtcacccatatcggcagcatccgcagcagaatcttcacttcctccacctgcgttaccgaacactgcagccaccctccacccccaccctcatccttatttatctcttccacctcctcaaaaaccactgccgccttatctaaccacctgaaatgaaacaaatataagtctatatccaaaagtaaccttttacacaaattaagattatcaaaattcaggacaagtgacacagccccctgtcgatcatcccatccattactgttgttcggtttatctcactccttagttcagtcggcttttgccttatgaatgggtagtgttgttgttttttttttgtacaatctatctactgcggcgatacactgggacgtcgtccccccttgaactgtgtttttaatcttataaataaagtgatgagttctcgaaagaaaaaaaattcaagacaactacaactatatcagctattttttagaggaagaagaacaagaactacctaaggccagcttatatatatgttcgccttgaattgcaaagcgtatataaagattaagtcacagaagtacctgaaaccatcagtatgtgctagtttgactgattgtccattgcttaaatcagcatcatccccttcatacaggagtgcgttatcggcaggaacctccagttttctcttcttaaaagaggcaacaaaaaccattacaacactcttgagtgggcttccactgggaagctggaccttgtacactggtgttcctgccaaaaaggcaactgtggcaacaacaaggcatattgaggagatgccgaatccgagagaccaagcaacattttgctgtatccaaacgacgacagtgcccgaaatgaacactccaaggttgatagcaatgaagaacaagctaaagaaagattgcttctttttactctcttcgaggtttgaatcgttgtactggtcagctccaaaggggagtaatgctgatttgacacccccggtgccaaccgaaataaggtagagcgcggtgaagaagacaaaatactgaaaccctgttgcaggaggacatgagctcccattgcatggagcaggttgtagtgatgggatgacagcagaggcggtaattacaagcaacccctgtttgtttgtggacatatataactcagatagtacatacttatatggcatgagcacaacacatgcaaatgcatatgagaggaattactactagatagctagctagtattaaacgatgcacaaaacgatactagtacatggcggatgcacttacaataagatagaaaactgtacagatggcaatgggcttgtactttccccaaatgtatcaaccaagaatgctccaagcaccggtgtaagaaaagtggttccgttccatgtatcaacattggctgcgttagaggcggtagttacatggaggacggctccaagataaacgaccaagttgagggagatgccagcataggcaatgctctccaagaattcaaaggctacaatgaatgaagatgtatgaagtatttatattaggatacaactatggagtccgtgattagatttaaaaaaatgccaaattggcagatttaactagacagttgttctgcaatcacaagacaagtattatgacaagtgtggaaaggcgttatattcatttttcataggagtatatggttaattaattatgtatgtgtagatagatccatgcgactggtggatcgaggaggaagataaattaattaagaagggggtgggggctggggttaccctacccaagataagagcaggagccttccagttgaaggggggcttggtatagtgctgattggatgcggaagcatgcaagcagagggagggaggaagacagtgagtactgatcgatacagggcggtgagaaattgagaatgctcaatttaatccaatccaatccaatccaatgggaaattaatcccttccctcccctccctttctaccgtggagttggagtatatactagtactgccgatcatatggaagcaaagaaaagcttaattaggaaggatttagaattggggatatatattagtagtagaaagagagaacctggtggtggagcagcggcagttgggcatctccgctctccatgcccatcttcttcttcttcttcttcttcttcttcttgctcctctcctcacctcctcctcgatctcggatcttctaccactggaatggaatggtgtaatggtggcgaacaagaccccaactcctagtagttgtatttgtcggcttgcatcgtcacggtctctgtcacctcattaacttgctccctacaccctataatataagcatttctagactctaatacgatctatattattttgaccaatagtatatactataaaaacgagatgttttaagtaaaaaaactgtagtttgtttaataataaatttagtaacatcaattttacatgattgaactttttttattttttctattaatagtcaaagttaaaaatgtttgatttattagtgtgataaaaatacttatattttgggacggatagagtagtaaattaatactactccctccgtcccaaaataagtgcagttttgtactattcatgttcaacgtttgactgtccgtcttatttgaaaattttttatgattagtatttttattgctattagataataaaacatgaatagtactttatgtgtgactaaatgtttttaattttttcataaatttttcaaataagacggacggtcaaacgttgaacataaatagtgcaaaactatggaggtagtagcatacaaatacaatactccacggaaaattgatgactactccactgccacttgcaacctgtgagctgctgttttgacctcgtggggatttttattttctttttcaattatttatacatatatttataagggaaaaggattggtgacccacgacagccacgagaaagcgacacagactgatgggcttaactgggcccacgtcactaggccggatatcaattgggctggatgcaatatgggccttcatctctctcgtcgctcgatccctcttggactcctccccttctcgaacaaaccctaacaacaacagacaagagagaggcattgcacgatgcggcggtggtgcgccgccgccggcctcggcctcggccgccgcctcctctcctcctctgtctccgcccctgcccaccgccctcttccggcgcacctcatccccagccccaggccattgcccttctcctcccgccaccacctcttgactcctcctctgggtctccatccctcctccccaccgccgatgcaatggcagacgcagcaggtgcgccacttcgccgccaaggacagatcgcgcgcgccacggacgcccaccacctccaaggtcaagaagtacaagatcaagcccccctcgtacgcatccctccttccactcctctcttccatcattcaatcactattatcaacttctcacttactacttttttactactagctccatgaagtttcgattcagagtcatgaatgacggccaggtccgcaggtggagagccggcaagcgccacaatgctcacctcaaggtacaccatcttccatcttcttccccccatgcctttcctgctaggcctaggaccttatcatctctctgttgcttgtacgtatccaattgttttcctagtgaaacctaatttttcgatttaataatgatgtatcatgatttttcagtttattactggtatatcatggatgatgaattccctgctctttgttactatctttttttgcaaaaccgcatatgtctcatcgtggaaacatggatttccctgccattttctctctctctctctctcaatatgtagttcaccatgatccaacgccaatctatgggttccgtgcccaagagagagagagagagatatgaatatggaccaattcggtaaaccttttagatgtcccgtaacttcagtctccagaaaatcataatgaccatcttctcttctcccccatgcctttcctgccactttaacttctctcttgaatgcctgttgcttgtaccagtgttcagtaccaaactttcgatttatgctgtctaaatggaaattttgatttgttactgttatatgttggatggtgaactctctgctctgttatctttgcaaaaccacatatgtctcatcatgaaaacatggttgccctgccattttctcttcctcgatatgattagttttaccatagtccaacgccaatctattggttccacgcccgagagagagagagagatgaatatagtggaccgattcggtaaacctttcagttgtcctgtaacttcggtctccaaaaagttgtaacaaaatctgacaacaccacttgagctacccttcctcctcctatacgctacacagaatcgaatcaaactcatttccacatagccaattgcagaactcattaaacattttccaaagttcattgatgcatccatgtctttcttatatgatcaaagttactcatagccactttaacttctcatttctactcactatgttatttagctggtactgccggccagtgcacaccgagtttgtatgtgatgctattgtttatgttgttgcagtcgaaggaagcgaaaagaagacttcggaagcctgcattagtgcacttagcttatgcaaaagtgataaagaagctcaacttctgcagctaggaaatcaggacagacatgatggagtttggcatgcgagacagattgatgagtactgagtgccaactactgcattcctcacactgatttgaaatgttatttttttcccaattgttgtttgatgcattctcatctggttttgttttctgcacaatctggctgataaagcccacccgtcttgtgctatgtacaatattcagcataatagtgggataactgctgctggtgaagaaattggtcttgcacacacatcgattctacttaacgtcttcatccaagcttcaggccaacttttaacatggcaatatttctctgagagtttagatatggacactctggtcacacaaaggcatagttgttgttttctcagattgcggccagtagattttctgctcgagggtgaatgccgttgatcatcgccaggcgattttgagtttctgaattcagttactgatgatgatgatgactacatcatgcacacataaacctaaagataagagcatagcggacacgatgtgccttgttgatcatcagttccagggagtgtttgagacggaattggtcgagaaaatcaacaagacgctatatatttcctacattgtccagtctcatcagctagcaccctagcagcaacagggattgcattgtggtaacaagattcttcttgtcgtttgagctttttatcttagctttcggacctcaggttttcctttcagcctgtgcccatctctcttttccttcttttcaattttttttcttcccttcttttgtggggtttacagtgtcctttggactgaatatcgccatctcattcattacgaaatgcagattgggacactgcgaagtgatggagatatatagagatccagattcaggcacacgtcgttgttaataatcgatttagcttgtttgctagttaccctatgcatatcactctccattcagtagaatgttgaatcaagacattgatcgagaacaaccaagctggtaacagcgtcagcgtgaaattacatatcaaactgacctttaatttcggcatgcagcttgctcactatcattagttggctctatagcatcgatagtttttttttctcgaaatattttttgcctcaattttcctcattatcatatagcagcaaaaggcttttttttttgtttcagtaaaaataacagggtaataggatcatactactactccctcaattagtcactagaagaaaatgggttttggacttttcaaagttaatacgactatttaatttcttttgtataaatccaaggttttataatatgaaatctattgctcggataaacttggctacaaatattttaatatgtccaaaatcgacacatcattttcataataatggatagagaatcggtttctatatctataaatggatatacacaaccaaagattacacaaatacatacactccacatctcataatcgagattaaaaaaacaaaccaccaaaaagaaaagacaaaaacactaacttcatgtttttcctcatcacttcaaacatcggatgtggagctagcatgtctttctacctgcacactctctcgttgacactgtagcaaccgtaaaaacttcatttgctctgccatgagcaaaggaaggggccaggactagtccgcccagctgccttgacatcaccaagcaccagcctcataccagacggacaatcaatgccccccttagcatgagcacatccatcgccgctatgtcgttgttgtcgtaaaataccacctccgctaagctaccgcagcttatctcaccaaaagtcatcgccacatcgcacaaaagcgatcatgctacccctctgctgtcaccgtagaatctcacatcagacaagtcacggaagcttatctcgctagagaatcatcgcatccacgctgtcatcaccacaaaccacaacctccgtcgagctgcagtagcttatctcgctggagagctgccgccacaacaccattgtcatcacaaaccacaaccttcgccgagctaacatcacagcatatcttgtttggagagtcgccactatcgagtcgtcttcacccctaacctctgccaccacccttggcattgctcctagcgcgccgctgagctgatcagccaccaccatcaccaccaagcaagccaaccgctactactgccagcaccaccaccaacaccgtcatcgccacctaggccccaagcactgccacttcgtatgccgctagtagctaccaccgtcgacccttccacctctcagaatgcccccaccacctccgttgtcactgccatcatgcctccatacccaccacgacctgtgctagctagggcctacgtcaacgccgccgttcgcctctaacgcggctttgccccgtctcggccgacgagacaaggaggaacgggagggaaggagggagaggaagccttatagtcaaattaacttctcgaaggattgaataacaagaactaagcctactagatgaggggtgaatggtaggaacaccaaaaaccaaatctattttgcaaaattaaaaagttaccctcaaatttaatgaagatcaggtctgaccgacgtgtgtgtttcgatttgactgggtagatgccgctggtttggccgacgatgctcttttgatctggctgccttgctcaccgctacaacctcctgacgccaccggtctatagacgtggataccgccgatttgaccaccaccgcaccaccagttggaccgccgctttgccgtcgatgtgaccgttgagatccaaataaaaacatatcaaagaaactcttgaaagtagatcaactttattgcattaatatatgtttataaattgcatctaaaacactcctccctctcaactcacgaactaggcccgaagcaaatagtaactttcctctcccaaaacgttgatatccttctagtctcaaccagtcttctatttatacccataacattactgcccctagccacgaatccaactagaactagcactcctaatcaacataggaaacctatcaaaccaggcaaacaatgtcaccatacaactccacactccaatcttctcaaacttggactccgttttaaatttgacctatctttccataggcacaactctacgtgtatgtcatatgaaaaccttcacctccacatgcattgttctctagcctgaacatcccattgtctagcgtgataagtcccaatccatcaccagctacattcccatggcctcaactaacacctacacatgaagaacaaaaaatttcatatttgagtataagttcgcaccaacttgattcacatcagcacacaatagtatcacatacgaataaaaaccatctagaactcatatacatgaaacaatctataaattccacaaaaacaatccaaaaccgactccctcctggagtctgccggttcgaccgtcgggcactccagttagactgcacgaacaccaccggtttgactggactcctagagccgacaaaaaccgtccacaataaaaaaaactattcactgtattttaaataaatactttactttgataattgttcatcaccaagattaatcatcacatgattgtgcaatgtggaggcattctaaacgatattccttttgtgacgggagggagtaacattttaactaacaattgtggcgtgctctgtaacaagtaattaagcacgtacgctagcttacattaggctatatatagatggtaaagtagctagctagctactagtagcttacaagaaagtgtggctagtcgaacaagccgaagctgtgaggatagtcttgatgaaacaagaggtggtgcttggtgtcaataatggtacacagctgatggtggtcgggctgcagcagggagggggagatgatcacgtcctcctgcttgaggtgagtggtcgtaagacgatcgtggccagtctgactctgatgatgaactggagtactgtcttggaggcgtatgttggatgagttggaggaggaagggcgggtggagcccgcgaaggcgttgccgtgggttggccattgatggttgtggtcgaaggtgtaagtgacaacgagcattgtggggtcggcgcggttgcgctccacctgcttccgggcggagcaacctttggagctgctgcagcggtagtacccgcgagggtagggcgaccccttgatgggcttctgcccgtacttcctccacgcccacaggtccgacggcaccacctcgccgccgccgccgccactcgcccccgccgggatgcacaccaccttcttcgtctggctcttcctgtatatatatatatacatccttacagctagctaggtactactccagtataagaagttaaagaatacctacgtaccttcgcttgatgggcggaacgacataatgagcaccagcaaataactcctcgccgtcgccggtggtgtcctcctcaatcgtcgtcctcgtcctcgacgctccctgctgctgcacctgcactactggtggtggtggcaacagcgcatggagaaggtcgcaagctgcagaagcatccaccatgctctgctgctgctgctcagcgtgttggctcactgctgcaagctggtcttctcctcctcctcctcctcctcctaagaggtgcacatacggcggcgatgcagcctgatggcgaggcgccgtctgcagctgaaggctggccctcaccacatccgagaggtccccttggtcggccgacgactgccaaaacaagctgtcacacatggtcgatcgacgctatatatctcgctagcaagagatctccatattaattccagaggagattaatcaggccggccggacagggattatatgtatatagtattgaagaagaagacgacgacgacgacgacttaactagagtatattgtggccaccatgccatgcccttgcatgcatatatgaatatataccagcacaacggaaagaagacgaaggaactaacacaccccacatccccatcgatcgatcgatcgaagctagatagtgcgatatatagctagcaagagataggtaatagctagtcttgtcatacatcaacaacaaccgatgatgatgatgatgagtactagtgtcactcacctacagctatactagagttactccatcatccattcatctctccttttaggctttatgtatatatatttccatttcctttcactaccaccctgttaattttactttgatgcatagttattgttttgattgatctttgagtgggtcggcgggcacggacgggactgattgatggatatatctgtcagacagacagaccctaaatagattgatcaacaattgttgatgggtgcatggccatggcgatctcaggtatcaatccattcacccatccattcatatacatatactgtatctcccccaattaattcatccgatcctcactgtcgatgtgctatctatcttgtgtacttttccatatgcatgattaggcagctttcatcaacagcaagaggcatatccatgcatgccctccagataaaaagctatactccatagtacctttaattcgacggacggcatggttctttttacatgagaaattcatcatatatctgatgattatgcaagcaattgcaagtacagctagctagattaattaaactgtgtgcatgtagttcatcgacaatcatatcgaacgattacaatgtcatccgctaattgtaattaatacttggaatttagtggggattgtccgggcccacatgtcatccgctgctactatatcaacagtattgcataggatgtgcatcccttggacttaagtagtactgaatatatatcctatctttatatatagttggtacccattaagaagcatttacttctataaagccacataatcaacaattttaagccatcagatcatattagtataaagataacaaccgctgaaccaagaagctacttattcattcaattcaatcatttattagttatccatctattcacctccctttgctccacctcatagtcacacgtagcactgctacatattttatgcataacaccatgttttccggatataatatgtggttattgtttaatatgtatgttttattttattatgcatgataaggttgcatataattattaggtatagttacctgaatccattttcagaaaaaacttgagtggggtagagagatgcaaactgtttaactacaacgatacccatattgcgcatgaagataatattcatatattataacaatacacaatgacacttgaaaaaacaaaacatgaatggtattgtaataacataaggcatatataaatccacattatcatatattttatatatacatagagttgcacttaaccatttaaaactatgattttgtttgacgataaatctataaaacccatggcaaagacgcggggcgggctgccaactagtatatatgtatgcctgacccatgattcttgtgtagatatctgtaaaaattattaatcaaacaaaatgcattttggagctgccacactgctagctagagtagctagagttggattctcgtttccaaggattagacgacaaggtagaatgaatgaatggacaaggatcgattaaattaagctagcagctagcaaccccatgagttaaaactcagagcatatgtagtatgtgcagtagatcagcaagtgcatggactgtggtataaccggccgtatatgtttagtataacctgccgatgtttggatggtggtttagggttgggcgacggaccatggaggcaggggttgtaggggttccgagcgaaagcttagcccaagtcattgggccaacaatgatcatacttttgggcgtgttaaccctccagaggacactgttgaggtacccctcctctcttagcaaagagctctgggtgtaaaccttgtctagttttttggacggacgacgacggcgtctttcggtgtcgcgaccctcttgagggcataatttttacctcttgagggcgtaatttttagagtcttcgttccgtggtggtggtgatcggtctcgcatagcgatagccaattcggtgcccggcttccctctctgtagcatgtgtttaggtggttggcacatgatccggggcgtgtgctctggtgtacatccttgcttgatagccaactgtcaatgtaaaacttttcttgtaacattttcttcctatcttaataatattggatggtctccttcggctattccagcaaaaaccagccgtatatacccagagattaataattaggctgcaatactagcactctcttcttttacatggaaacaaattcaatagtccacatccatagttttttttttagaaatgcttttcttaatatatactgccaattataattcaaatggagtccattcaattcactgccgcacatcgttacagatgagagcagtttggtcgaacctaattaatgcatccaaggcatggaatggaggagtaactaaaaacattactcgcagagaactggtggtactgatcgatcgagtgtgattttctttcctctgcatgcagtgcaggctagtaactgatcaattcaagtgtgtgtgtgtttgtgtataatattcctaattagatataacaatcatcactagtgcactacagtagtcgtatggcgacttgcatcaagaatggaaggaacagaaagttgtttgattctccactgcatatattactataatgatatggcctggcgatcatacacagtatcatattattggtcgatctgtagctagctgtacataacatggttgcctagtgagctgcatatgttgtacttaacccccaaacaaatacaaagaagatgaatataagcacaaattaatagtgcgtcgcgagtgtctgtgttgtactgtgtaattctaaaaaaaaagtagtgatgtaagagcatcttaaaattttactcctaaaaatcttggattagctagtatcgtcccaaaaaaattgggcccaaatatcacctcctactccaagaatgcccctaaatttgatttccaccaactttaaaatatgccatatcatctcaagtaggttctgcttcgaccgtttatgtctttttatttttccggtaagagagggatcgatgctaggcgctgctaaccaatcgcacgctagcggctcactatgctgtgcaacaggacgatctcgtgcatgccttgcagttgcgacagcggacagcgtgggcatcagcaagtctacaaggcgcgtcgaggagggcagacagggctcggccatctcgcggcagggcactacagagtaacacatgaggtttcttggttgtctcgacgacgccctagacggaggggtagcgacgccttggacggaatggatgccgcacactagtcggagcagaggcgagcttgtcgatgcctttctgagcactgcccctgtgacggagggtcaccaacaccaggagcgctcggcaggatgcgacaactctagattgtcacgagaggagaagaaaaggtgcgagcggcaaaatcctcccatgatttcatcaatggttttgggtgtcagtaaatattgggaccgtctttggatatctctttaagacatggttttagattagattcctataatttatcttttagaactggtattagggagctcttggagatttctaataatctactactttatctgtttcacaatgtaaatcattctagtattttccacattcatattgattttaatgaacctaaatatatatgtctagattcattaatttcaatataaatgtgggaatgatataatgatttacattgtgaaacggagggagtacttgtactggagtagtatactaagtgatttggattaagttttggcagcgcctaaaactcggcccatcccagaaatgggctcccaggtgaatgaggagcccatacagatgaagtctggtgggtggttggcccatccatgttcctcttcttcctcctccgactccgacccgcagccgcaggaacccaagaggagatcggaagaaagagagagagattgaggaggaggaggaggaggagccatggctgcggtggtgcgtggcgtgttgaacggcatccgggagaagggcctctccaacttcctccgccatgcccgcgacgaaggctacttgtaagctacctataacccctctcctcctccatctatgctacgcagggcgccgatccggatctccatgcgtcccgtccgctacctgtttctcctctttaattaggccccgatccatactagtttcctctccccttcgattcagcaccgaatcccctcgattagggttgttgcttcatgccgcccagcccaaccgattggccaatggctatccgaccctcgcttttcttttcgctgcatttctcgataccatctgcttgctccatcaaactgaatatcgcttttgtatcatttgcagcaaatgccttctggatggaaacctcttgtaagttcccccttcttactagctctccgtttattctttttttttacacatatctggatgtgtctgtttgtctccccacaggtcgccgcagcctaatgtagtaattatcatcctctcttttcaggcaaactaaaatccacaatatcggcgccacacttgtaggagtagacaagttcggcaacaaatattatgaaaaactacatgacactcagtatggtgagtgaggtttctcgcatacgctacattttattctattatgcaattttaattcatttcaatcatggaatgtactagagtagcatcaattatcttctcacaacaagacatgctatgctatcctgttttgcttttttttttttttgccatcttgttttcttttcttccacttctgagatttgtaactttgctcataagtgatcaccctgggcttgattggtatgcatgtctttgtagtaatgtaacgtttcttactttctgtctcctccaaagagaggtgctttctacaaaactaaatactggtaaccctgcaggaaggcacaggtgggtagaatatgcagagaaagggcgctacaatgcatcccaagtgccccctgaatggcatggatggctgcaccacatcaccgacagcactggggacgaggcaagttttcttctttgtgttggctgtgtttcctagctttggtcctccgacataactataggttatggtaatgctttatcgtatgccactgacttaggaatttggatcttggaaaaaaaatgtcttgccctcaaaaccaaacaagtagacacaaatttggcatcaaaagtgaaacaaccgaatgtccagacaagtcaaggaaagcttatctgaaaagggcaaatcttggttattgcttcccatggctaaatgagcaaacatgcatgtttagttaagttagcaaacaggggagcctttagaatttactgcagtctgtatatgatgaaaactctggtggtgcttgttacttgtactgtccagtgtgatgcttagaaatgttattaccttttaggcgttttcttatgtaatattcagcggtgaattcacctcccgggcagctgcctaggcttaacgccattgaaccatttagcctagtgataaaacaacaccgatttgattagattccctggcaagttaattagttgtaggtgccaggtagcaagctgcaggcctgtttggctgtgtcccacagcatgaaggtagcaaccggtggcccaaggtcatccttgcctaatttagttaccttcagttaatcatgttgatgtggcccacagtctactcagccagcatgtatcccatagcccaggaaaggcatacaaaaggaatatttttatcttatatttcttgcagagttgttatgatgctatgatgtagtataaatttgagtaaatttcacaaaactacagatttaaggccaagtatcacataacttcatatttaatatcgacgttatcacaaaactacagaatttagaggtcaaatcattagcactaccattatattggagctataaacattgtagttttatgattgaattggcactaaacctgtaattttgataaatttgctacttaatctatagttttgtgaccatatatctaaatctatagttttgtgataaactgataaatttaaaactaaatatgtagttttgtgaaatttactctataaattttcatttatctttttttatctcgcgtctccgaagagacttcatttacttttttattaggcttatctactttttatctactagaaaatctgctggaatttatatactcattggatcataaatttataacaaaattgtgactccgatagaaatttgagcttatagacatgtttgatcatactggttttcattagggttgagcaccacccaggcttccaaaaattgctggctttgccactggtaatagttgctgggaatgtgggtgggtgttgtggttggatgggaaaggtgattctgacatacttgggtatgttgtggcagctactggagcagaatgctaaagcgtacatcgtggatcacaaggagaacttctccggcgagggtgaggaactgatctaccactccaaggggcatgctctaaacccaggacaaagggactggacgaggtaccagccgtgggaaccaaagaaagaagaggcaacctaattaaggcactgatccagtgtgtcatttgatttggtgtctaaaacaacagtcagccggctcggtgggctgaatctgaataatgttgtcttgaggattgtttacctgagaatggaagaacatgatggagttttaattcccatatgatatgtttgtttatttttgatggagcggagcgtcgtccccattgaatggacgagggttgaatgctggtttgctgaaatgaaatattgtcgattgtctggatttgtgatgtgatagaacgtcggtatcgtccgtccttgactgggctggtagctgctggatctggatgtgagagagggctactggctacgtggttggcttcgtctcggtggaatgaaattggggcggaagcggctgccacgactcattgtgtagtgtctgcatgtgttgtttgtgaatattttctgctggctactcctaataataagatattttgattgaatatgacgtatcctagtaatttggaccggcttcatatttagattcattatatgtgtcgcattcaactaaaattttttatatttatggacaaatggagtagctccctactgctaatatttgctgaaggctcacccccaacaaaaaaaaaaataaagaagggaaagggaaagaaagactgctgctgagtttgtgacagcagcaatgtctgtcaaagtttcacaaaggaaagataaagaaagactgctaagacggttgctaaagtttcggcacgtaggaaggaaaggaaaagaaagactgttaagaaggcggctggtttgattgaccatgtgccgttcataggagtagtccatgttatgtagccaaatgactcgtatagttagcttggaggactgagctttgtgggtgggttggttggttggttatacaaagacgctacgagtccgggaataagggggcaactaggaagttcctcttcctcctccgagaacgagaacccacacctccataacttcaatttccaagttatatatatataaaaaaggcaatggcggacgatcctctctccaactccaccaccaacaacaaggtacttgtcgatcttgcttctaccaattccaattactactactccatcggctcggcagattgatttgattgtttgcttcttcttttttctgattgatttcagagggcagaggggatccagctccagcacggcgactgcgagagcgagagcactgcgcccttgctgctcgcgccacacgagtcctaccgcctctccgccgcaatcctcccgtgggttcctcttctcctcctccttcttcctcctcttcttccttggtcggtaataaggctggcaccttcttctgcagcttcctatttccagctttgggcggccttctctatggctacgacatcggagcaacgtctggtgctaccatatcgctcaaggtctctattactatactccactattcatcgattttgttaataatagaactatatattacttgagcgattacccatcattttgctttgcagtcatccaccttcagtggcaccacatggtacaacttgtcatcgctgcaaaccggccttgtcgtaatgcccttaccctctcctccatttgtttctctttttttttccttgtacactaccacaatttcatttcttcttcccaattctcgttatgcttatgcaggtcagtggctcactctatggtgctctcatcggttccatcttggcattcaacattgccgattttctaggtctaatacccccacccacctcctctcttttcttttaacattgccctagtcttctgttttcgcttatgcttatctcttaccacaggacggcgcagagagcttattctttcttctgtctcatatttgattggagctcttctcacagcagcagcacctaacttccctatcatggtggttggccgctttttctatggcataggaataggattggtaatcaaccacaattatcttattcatgccatacttgacactgcaaaacacatacaaacaccacacggtgtttatgacgcttacgctaactctttgctttcgtcaggctatgcatgctgctccaatgtacattgcagagactgctccaagtcagataagaggcatgctcatttctctcaaggaattctttattgttcttgggatgcttgtaagttcacattacatgacctgcccttttccccctctcttcctttctctctcagactacttagtcatttacttacgtttctcttttgcagcttggctacattgcaggcagtctctttgtcgaagtggtttctggttggcgctacatgtatgccaccagtacaccattatgtctcatcatgggaattgggatgtgctggttacctgcttcacctaggtggcttctgttatgtgccatacaagggaagaggaatattatggagtcaaaagaaaatgctacccgttgcttatgtcgattgaggggtcaagcttctcctgatttggtttcggaacaagttgatttgattctggatgaactgtcatacgttgatcaagagaggcaagcaggcttcagtgagatctttcagggaaaatgcctcaaagcaatgataatcggatgtggcttggtgttctttcagcaggtggtctcttaagtcatcatatagccatactcgtatgttccatgatgtaaagatgaaactgacggtgtgtttcttatgcacttgctgtatgaatctgtcaggttactggtcaaccaagtgtgctatattatgctgcgacaatccttcaggtactgatgcttttctgtatgaattacgtatttcagctatgtccttttgtggtgctatggttggctctcaaaaaatggaagcccctacatgttataagatgttaccccgtattgctcaagaatataaaaaataatgttattcttgtaaggtcaagtggggctcacgggacctccagacaccatgctttcatcgctttagttcctgtatttttcatagttgtcgtttttctttcatgcagagtgctggattctctggtgcatctgatgctactcgtgtatcagttcttcttggcttactgaaggtatatagtacttcttaatattagttcacatataacacacgctgatattttcaaactttaagctgttccatatttgccattcccctatgaatgaacatgaactagcaacaaattactacaatagtacaaactgatacacccataagagcaataacctgtaccactatttgtcttgatattattcgatacgacaacactaacgaaaaaaaggacacagctagcactcaggcattgagacggcagcaccaaatacctgatgacatgaccatcttgggaggatccccttttcctttttatgtgctgcatctcctctcctcttcatctaaaattaatttgtgcatccataaaagtgaagcttgtttgtttcaagtgttttgagtctccactagaatatcttaccatcccagcaaaaaaaaagagagagaatatcatcaccatgtaagccagagaaaaaacaacatcctttgtcacaaaaatactaacaccaccatgcaacatgcaagggctcatgatgcaacaatgagcaattactaattgtaaaaactatgaagtttcgcgcaacaaatcgatagacctactgccacaaataccaatttaacaaaacagtgagctagtgagctacatgtcctagctgcatcaattcagtgcaacaaatcaacattattgcagatacagttggttttggtgcaagaaataaagaaacatgaacatctacaacaaataactcttgtgactaattttgggaagacaagttgcaacaaataaatactctctgcatcatttcaactgatgttgtgtttcttttgtagttgattatgactggtgtggcagttcttgtggttgacagacttgggagaagaccattactgattggaggtgttagtgggattgtaagtctagcctcaacatatgcactcttatctaaatatgataaaagcagtcatgagcttcttcaataaatatcaattcaatcattcacatgctcgttttctctgttcaatgtgatacacaactgatatctcaatagaactgtatctccttattttctgaaaaaaagtacttaatcgtatattttcatgttcagttgtatgtttctgtggaacaaagtagcatcgaaatttgtagggatgagttgactataggtgctataggcatagttttcacatgatggtttgttcgtatttctgaaaaatgcagtgatgttcttttgagtgaaataatacaataatcttcaaggagattttgctgcctcactcaacttatctgttaattggtttaatgtgcaggctgtttccttgtttttgttatcttcgtactacaccttattgaaggatgctccttatgtggctgtaatagcacttctactctatgttggctgctaccaggtactcacagccagtttacccttgtttggcatgaatgaaaaaaaatagaaattttatgtagcaaagtttcagttgatattctgcccgtgtatatatatttggctatctgtctaatgataagttattctgcagctgtcattcggtccaattggctggcttatgatttcggaagttttcccattaaggctgcgagggcgtgggttgagtattgctgttcttgtgaattttgcctccaatgcactagtcacttttgctttctccccattggaggtatgtctcaagttggtttgtgcaatggagtgtacatgacatgccagccaagaagaggctatgtatgagtgtactgactgctcttatatatgtgactgtggtgtaggatttgattggaactgggatcttcttctctgcgtttggggtgattcaagtggcgtctcttgttttcatattcttcatcgtgcccgagacgaaagggctcaccttgaaagaaattgaagccagcctgtagatccagctgccctgcggctgctggcacgtaggagaactgcttattattcagagatgttgcaagctgttggactgactgactgactatctttgtggtgtggtaaggtaacacagtgagatccattgagagtgagttatgttgctttcggtcgttgctttggttggagaaagagtatagttcaaacatatatgtccatactgggttgttgttcataatacatgagcacatcattttttttccttgagaacgatatatgtgtgattaatgctgtacagcaggagcagttggcttatgccatgttattgggcacctgctgaatatttggcatgatctaaaaataataatgtcttcgtcccagaataattacatttcatggaggttaaagaaaaattagcggcacacacaaatgaccacaataaccttatttaatgattacactgtatgtatgtagactttattaaaaatgcaatctttttaggatataatttaaatggtagaaatacaattagtgttatagaaccaaggaactaggtgtaaaagatagtgtagtgctaacctgtagctctagtttatgttttagagtaataaataaatttgtgaagaagggaatgcgaatgctacttccttcgtctaaaaaaacctgagactacatgaatctgaacagaagtgaagtatgtactagaatacgtcacatccaaatatccagtactatgttattttttatgggatggagagagtaggtctgaacatgagtctgacctgtgaattcagtttgttggatacagttgtggaacatgtgagatgaaagaatgagagatgagaaggaagacgtggcagcatgtatgtgttgcgtagagttgttgcacatgtatggctaggctaattaccgttccctccaagtccaaggaatacatgtgatgtgccaactgcctttttgtgtccgttgcgtgcttatttgacttaactgatcgaatcgatgatgaatggatggatcgtgcatgtgaatgatacttacttctctctgtttcaaaataaaacaatttaaaattaaacgaatatgatagatctttatctcgattcattatattaaggccgtgttcttctcggctagccgggttaaagtgatgtgtttgggaagggnnnnnnnnnnnnnnnnnnnnnnnnnnnnnnnnnnnnnnnnnnnnnnnnnnnnnnnn
